United States Patent 8,541,208 (PROCESS FOR THE PRODUCTION OF FINE CHEMICALS) - sequence listing, part 4

SEQ ID NO: 9831 - DNA, 2131 bp, Sus scrofa
  CDS (177)..(2087)
gaagttttagacttgcctccagcacagccttcttcaaaagtgtggcaccagctgatgagtatcaagaaatccctttcctgcaaaggggcagagtttattgtatttggaacccgtgacaactcataatggggagaaacttctaagcgaggagaaacagaacagcaggtcatgaaaatatggagaacaaatggtttttgtccatggttcgggatgactttaaaggtggaaaaattaatctagaaaaagctcagaaattacttgaaaaattagatattcagtgcaatactattcatgtgaaatgtatttttaaggataatgacaggctgaagcaaggaagaatcaccatagaagaattcagaacaatttatcgaattattgcacacagagaagaaattattgagattttcaacgcctatcccgaaaaccggaaaattctttttgaaaggaatctgattgattttttgacccaagagcagtattcacttgacattaatagaagtattgtttatgagatcattcaaaaatatgaacctattgaagaagttaagcaagcacaccagatgtcatttgaaggttttacaagagatatgggttcatctgaatgtctactatttaataatgagtgtggaagtgtttatcaagatatgacccatccattgagtgattattttatttcaagttcacataatacatacttgatatctgaccaaataatgggaccaagtaacctttggggatatgtaagtgcccttgtgaaaggatgccgttgtctggaaattgactgctgggatggatcgcaaaatgaacctgttgtataccacggttacacattaaccagcaagcttctgtttaaaactgttatccaagcaatacacaaatatgcattcataacctctgactacccagtggtgctctctttagaaaatcactgttccctttcccaacaagaagtgatggcagacaatttgcagtctgtttttggagatgccttgctttctgatgtgcttgatgattgtccagacagactaccttcaccagaggcattaaaattcaaaatattagttagaaacaagaaaataggaaccttaaaggaaactcacgaaaggaaaggttttgataagcatggtcaggtacaggaatgtgaagaagaagaggaggcagaacaagaggaggaagaaaatgaggtcagagattcagaaatattggatattttacaagatgatttggaaaaggaagagttgaaacggggagttggaattaaatttttcaagaaaaagaaggtaaaaatagctacggccctatctgatcttgttatttatactaaagttgagaagttcagaagttttcactattcaaggctttatcaacaatttaatgaaactaactctattggggaaacacaagcccgaaaactttcaaagttgagagccagtgaatttattcttcacactaggaagttcattaccagaatatatcccaaagcgacaagagcagactcctctaattttaatcctcaagaattttggaatataggttgtcaaatggtggccttaaatttccagacccctggtctgcctatggatcttcaaaatgggaaatttttagaaaatggtaactctggatatattttgaaaccacacttcttaagagatggtaaatcaatatttaatccaaacaaagcaccaatcaacagtaatccaattacacttaccataaggctcatcagtggtatccagttgcctcccagttatcattcatcatccaacaaagctgatacattggtgataatagaaatttttggtgtgccaaatgatcaaatgaaacagcagacacgtgtaattaagaaaaatgcttttagtccaagatggaatgaaacattcacattcattattcaggtgccagaattggcattaatacgttttgttgttgaaaatcaaggtttgataactggaaatgaatttcttgggcaatatactttaccagttctatgcatgaacaaaggttaccgtcgtgttcctctgttttctaaaatgggtgagagtcttgaacctgcctccctatttatttatgtttggtacatcagatagcagctaatagtgccagaaatatcgttagctacacatcacagtaa

SEQ ID NO: 9832 - protein, 636 aa, Sus scrofa
MENKWFLSMVRDDFKGGKINLEKAQKLLEKLDIQCNTIHVKCIFKDNDRLKQGRITIEEFRTIYRIIAHREEIIEIFNAYPENRKILFERNLIDFLTQEQYSLDINRSIVYEIIQKYEPIEEVKQAHQMSFEGFTRDMGSSECLLFNNECGSVYQDMTHPLSDYFISSSHNTYLISDQIMGPSNLWGYVSALVKGCRCLEIDCWDGSQNEPVVYHGYTLTSKLLFKTVIQAIHKYAFITSDYPVVLSLENHCSLSQQEVMADNLQSVFGDALLSDVLDDCPDRLPSPEALKFKILVRNKKIGTLKETHERKGFDKHGQVQECEEEEEAEQEEEENEVRDSEILDILQDDLEKEELKRGVGIKFFKKKKVKIATALSDLVIYTKVEKFRSFHYSRLYQQFNETNSIGETQARKLSKLRASEFILHTRKFITRIYPKATRADSSNFNPQEFWNIGCQMVALNFQTPGLPMDLQNGKFLENGNSGYILKPHFLRDGKSIFNPNKAPINSNPITLTIRLISGIQLPPSYHSSSNKADTLVIIEIFGVPNDQMKQQTRVIKKNAFSPRWNETFTFIIQVPELALIRFVVENQGLITGNEFLGQYTLPVLCMNKGYRRVPLFSKMGESLEPASLFIYVWYIR

SEQ ID NO: 9833 - DNA, 3056 bp, Brachydanio rerio
  CDS (165)..(2414)
gcggaacagctcagctcagctctcggtctcctctgttgattttcgccagtcagactttccgaaagttttatgccattgctttttgagcgtgaactgctggagtcaaaaacgctggatataattgagcacgaggaggacacaacagtctgcagaattgacgagacatggactcaaacggcgttactgataaaaaagttttggagggcgaccgtgacctgcagttcctgatgaacggcggagaccttctgaaggtgcgttctgagtcgtggaaaaagacgcgctacttcaagctgcaggaggactgcaagaccatgtggcacgaatccaaaaagacactaaagaccaaacagacattctctattgaggacattgaggaagtccgaacaggtcgacaaacagacagtctgaggaaatacacagaggagacattggagggtcgagcgttctccatcttgtttaagggtcgtcagaaaagcctggacctaatcgccagcactgaggaagaagccaagaaatgggtcagcggtttggagaaagtcatctcaagcttgaacaacctcagttcacagaagaagacggagcactggatctacagctccttgcggaaagcagacaaaaacctggacaacaagatgagtctgaaagaggtcaagagctttctgaaagacatcaacgttgaagtgcacgaagactacgctgaaatgctctttaaggaatgcgacaaatcgaacggtggattcctggagggaaacgagattgagcatttctacaaaatcctgacgaaaagagaggagattgatgtcatttatggggagtatgcaaagacagatggtctcatgagcgcaaatgacctgctgaactttctgctgactgagcagagagaagaggtgtcccaaaatgatgcccttcaactcattgagaaatatgaactcgatgaaaacgccaaagccaaacagcaaatgacccaggatggcttcctgatgtacttgcaccagccggaggggctgatctttaaccaggctcataaaagtgtttaccatgacatgaaccagcctctcagccattacttcatctcctcctctcacaacacatacctgatggaggaccagctcaaaggacccagcagcactgaggcctacataaaagctcttctgaagggctgccgctgcgtggagctggactgctgggatggatcagacggagagccggtcatttaccatggatatactctcacttcaaaaatcctcttcaaagatgtgattaaagccattaaagaatatgccttcaagacgtccgagtacccggtgattctgtctctggagaaccactgcggtgtggagcagcagaagatcatggctcagcatctgacctccattctgggcagcgcactggtcaccaaaccccttggagatcagatgcccacatgcctgcctgcaccagaggaactcaaaggccggttcattgtcaaagggaagagactagacaaactggaaaacgcattttctgatgagtccaagatggcagatgaagaaagtgtgtcagaggaagaagacgatgaaggtgacgaagaaaacaacgaaaagaagtctggctcgctgaagctggcgaaggagctttctgacattgtgatctactgcaagagtgtgcccttccatgggcttgaggattcccgggaaaagcattctttttatgagatggcctccttcaaagaggggaaagctttgaaactagcggaggagtcagcaactgaatatatccgtcacaacaccgacaagctcagtaggatttacccaggaggaatgaggacggactcctccaactataaccctgtgcccatgtggaatgcaggctgtcagatagtggctctgaacttccagactccgtgtttagagatggacctgaaccaggggctcttttatcaaaatggacgaagcggttacatcctaaaaccttcttacctgcgagagcgcgacactgagtttgaccccatcacccccaccaagggcccgtggctgaagagaaagactcttcatgtgatggtgatctcagcccagcagttgcccaaagtgggtaagagagagtccgccattgtggaccctattgtgaaagtgcaggtgtacggtgtgcccgctgacacagcagctgtggaaacatcctacattaagaacaatggttttaaccccatgtggaatgaaaacttccagttggaggtgtgtgtgccagatctggccttggtgcgtttcttgattgaggactacgactccacatcagacaacgagtttatcggccagtacacactgcccttcaacagcttgaggaacggatatcatcacgtgcctctgctcactcaggacggaaacctgctttcctcggccgggctgttcgttcacatcatggttgtggatacagaataacacacacacacacacacacacacacacacacacacacacacacacacacacacacacacacacacacagcttctctactgtatctgagataatcactgtattcaacagtgtgaaaaacatctgctatgaaaaaaacctgtgaggcagcttgagggattttaataggctaacgtaaagtttatacaacaactattttgaaattgttaaatgatggtctcgcatttaatattcacttttttaatatttgtaaaatatgatacattttagtatgcgcatatacatattaaatacatttagtattccttagtggcaaatatgcattgagggcaataattgtcagcgtgttcacttttaaccttagtcaaacagcagtaggtgttgttgtttttttaatagcagttttagcagaggaacaattgtatagaatagactaccaaatacacaggggcacttgtttagttttgaaagctgcattagtttttatctttgtcttttatgtagttgcttactatactttgttgtattaaatgtggtactcaatactgtcccataccgtcagccattctgatgaacgcattgccaactgtatacatttctataaaacagaaataaaggataaattattcaaaaaaaaaaaaaaaa

SEQ ID NO: 9834 - protein, 749 aa, Brachydanio rerio
MDSNGVTDKKVLEGDRDLQFLMNGGDLLKVRSESWKKTRYFKLQEDCKTMWHESKKTLKTKQTFSIEDIEEVRTGRQTDSLRKYTEETLEGRAFSILFKGRQKSLDLIASTEEEAKKWVSGLEKVISSLNNLSSQKKTEHWIYSSLRKADKNLDNKMSLKEVKSFLKDINVEVHEDYAEMLFKECDKSNGGFLEGNEIEHFYKILTKREEIDVIYGEYAKTDGLMSANDLLNFLLTEQREEVSQNDALQLIEKYELDENAKAKQQMTQDGFLMYLHQPEGLIFNQAHKSVYHDMNQPLSHYFISSSHNTYLMEDQLKGPSSTEAYIKALLKGCRCVELDCWDGSDGEPVIYHGYTLTSKILFKDVIKAIKEYAFKTSEYPVILSLENHCGVEQQKIMAQHLTSILGSALVTKPLGDQMPTCLPAPEELKGRFIVKGKRLDKLENAFSDESKMADEESVSEEEDDEGDEENNEKKSGSLKLAKELSDIVIYCKSVPFHGLEDSREKHSFYEMASFKEGKALKLAEESATEYIRHNTDKLSRIYPGGMRTDSSNYNPVPMWNAGCQIVALNFQTPCLEMDLNQGLFYQNGRSGYILKPSYLRERDTEFDPITPTKGPWLKRKTLHVMVISAQQLPKVGKRESAIVDPIVKVQVYGVPADTAAVETSYIKNNGFNPMWNENFQLEVCVPDLALVRFLIEDYDSTSDNEFIGQYTLPFNSLRNGYHHVPLLTQDGNLLSSAGLFVHIMVVDTE

SEQ ID NO: 9835 - DNA, 4103 bp, Brachydanio rerio
  CDS (16)..(3954)
gaacaaacaggggaaatggctgcgagcgcgggcttctcctccaatggacctgtaccctgggctctgagcgacaccgaggtgaacaatctgtaccgggatctggagctgggcaccgtactcacgctctattactccaaaaagtcccagagacccgagaggaggacgtttcaagtcaagctcgagaccaggcagattatctggaccagaggaacggataaaatcgagggcgaaattgatatccgggagattaaggagatccggactggacagaagtctcgggactttgagcgatatgtggaggacgtcacgacccggccggaccaggcccactgcttcgtcatcctctacggcactgagtttcgcctcaaatccctcagtctggcagcgacctcagacgaggagatggtgatgtgggtgaagggtctgacgtggctgatgtccgatacgctgagctcctccacaccgctgcagattgaaaggtggctgagaaagcagttttacgcagtggatcgtaaccgagaggacagaatttcctgtaaggatctgaaatgtatgttgtgtcaggtcaactacagagtgcccaacatgaagttcctccgagagaaacttccggacggcgagctgaggaatggagacgtgtcgtacagtcatttcgctcagctataccgcagtctgatgttcgacgcacagaaatcgatggagattccactgctgcagaggtttattgacagaccggagcagaagatctcgctcgaggacttccagaacttcctcattgaacagcagaaggagctgtgggctgcagacagtaataaggtgcaggagtacatgttccgctacctgaaggatcctctgagagagatcgaacagccctactttcaccaggacgagttcctcacctatctgttctccaaagaaaacaccatctgggacgctcagctggatcaggtgcggcccgaggacatgaacaaccccctgtcccactactggatctcctcgtcccacaacacctatctgacgggggaccagttttccagcgagtcgtctctggaggcgtacgcccgctgtctgcgcatgggctgcagatgcatcgagttggactgctgggacggtcctgacgggatgcctgtcatctatcacggtcacaccctcaccaccaagatcaagttcagtgatgtgctcaacaccatcaaagagcacgcattcgtcacgtctgactatcccatcatcctctccatcgaggaccactgcagcatcgtccagcagagaaacatggccactttcttcaagaaggtgtttggggagatgctgctgaccaaagcggtggacatttcagcagacggcctgccctcgccacaccagctcaagaggaagatcctcatcaagcacaagaagttagcggagggcagtgcgtacgaggaggtgtcgtcttcaacaccctactcagagaacgacatcagcaactccatcaagaacggcatcctgtacctggaggaccccatcaaccacgagtggtatccacacttctttgttctgaccagcaataagatctattactctgaagagacgtccagtaatcaagggaacgaggatgaggaggagcacagagagatctgcaacggtatggaccagcatgtgacggagaagtggtttcatggtaaactgggtgcaggtcgtgacggccgtcagatcgcagagcgcttgctgtctgagtactgcgtggagactggagctccagacggatccttcctagtgcgggagagcgagacctttgtaggagactacaccctctccttctggcgctctggtcgtgttcagcactgcaggattcactctcgacaggaagcaggaagtcccaagttctacctgacggataacctggtgttcgacactctgtttgcgctcatcactcattaccagcaggttcctctgcgctgcaacgagttcgagatgaagctgaccgagccggtgccgcaaaccaacgctcacgagagcaaagagtggtaccacgcgtgtctgtcccgcagtcaggctgaaaacatgttgatgagggtcccacgtgacggtgctttccttgttaggaagagaactgaattcaactctttcgccatttccttccgggctgaagggaagatcaagcactgtcgcgtccagcaggagggacagacggtggttttgggaacctcggagttcgacagtttagtcgatttaatcagttactatgagaaacatccactgtaccgcaagatgaagctgcgctaccccatcaacgaggaaacactggagaagatcggcactgctgagcctgattatgggtctctgtatgagggacgaaacccgggattctatgtggaagccaatcagatgcccacatttaagtgcacagttaaagccatgtatgaatacaaagcccagcgggatgatgagctctctttcatcaagaacgccatcattagtaacgtggacaaacaggagggaggctggtggaagggtgactgcggtggaaagaagcaactgtggttcccggccaattatgtggaggagatcagcccgacggcggtggagcccgacagatctgcctcagagaacagtcctctgggagatctcctgagaggaagtgtggacgtgtcttcctgtcagatcgtggtcagacctgaagggaaaggcagtcgtcagttcgtcttctctctggtgccggtggcgtctcctcgcaccggtcctgtgctggacatcgcagccagctctcaggaggagctgaaggactgggtggtgaagatccgagaggtcaccatgacatctgaagccaagcttgaagaggggaaaatgatggagagaagaaagaagatcgctttagagctgtctgatctggtcatctactgccggccggttccttttgatgaagacaaaattgggacggagcgcgcctgtttccgggacatgtcctcctttcccgagactaaagcagagaagtatgtgaaccgcgttaaagggaagaagttcctgcagtataaccgtctgcagctctcgcggatctacccgcgcggccagcgcctcgactcctccaactacgacccattacccatgtggctgtgcggcagtcagctggtggccctcaacttccagaccgcagataaacccatgcagatgaaccaggccatcttcatgctgaacggcaggagtggatatgtgctgcagccgcccatcatgagggatgacaacttcgacccgtttgaccgccactcgctcagaggagtggagcccatcacactcagcatagaggttttgggagcgcgtcacctgcccaaacacggtcgaggtattgtttgtccgctcatcgagattgaagtttgcggagcagaatatgacaatgccaagcagaggacagactcagaagcagacaatggtctgaaccccacctggaccaggaaactctttaggttcaccgtgtgcaatccttccttcgcattcctgcgctttgtggtctacgaaatcgacatgttcagtgaccagaactttctggcccaggccacattccccatcaactgcctcaaaacaggctaccgctcggtcccgctgaagaacagctacagtgaggatctggagctggcctgtctgctggtgcacatggacgtcatcagaggacgggtgggatatgagatgatccatgagaatggagacatgttgagtccgttctctccggctggggcgatggcgatggctatgcagacgggccgcgagcggatgaacgactctggctccgtctcctccacctcctccatgtctcctctgccctcgtctccggcgcaggctctagggtaccgcgggcgcgagggctcgttcgaggcccgctatcagacccctctggaggacttcagagtgtctcaggaggcgctgctggaccacgagaacaggaggctccgcagggctcgcgtcagcgccgataaccgagcgtaaaccgagcagatggatagacggagcagacgagacgcaaggccagcgacaggggattctgcagagctgatgatgatgatgatgatgtcgggacggtttgtttgggaatgggcatagcggcgctttcggacagatcctctctctcctgctca

SEQ ID NO: 9836 - protein, 1312 aa, Brachydanio rerio
MAASAGFSSNGPVPWALSDTEVNNLYRDLELGTVLTLYYSKKSQRPERRTFQVKLETRQIIWTRGTDKIEGEIDIREIKEIRTGQKSRDFERYVEDVTTRPDQAHCFVILYGTEFRLKSLSLAATSDEEMVMWVKGLTWLMSDTLSSSTPLQIERWLRKQFYAVDRNREDRISCKDLKCMLCQVNYRVPNMKFLREKLPDGELRNGDVSYSHFAQLYRSLMFDAQKSMEIPLLQRFIDRPEQKISLEDFQNFLIEQQKELWAADSNKVQEYMFRYLKDPLREIEQPYFHQDEFLTYLFSKENTIWDAQLDQVRPEDMNNPLSHYWISSSHNTYLTGDQFSSESSLEAYARCLRMGCRCIELDCWDGPDGMPVIYHGHTLTTKIKFSDVLNTIKEHAFVTSDYPIILSIEDHCSIVQQRNMATFFKKVFGEMLLTKAVDISADGLPSPHQLKRKILIKHKKLAEGSAYEEVSSSTPYSENDISNSIKNGILYLEDPINHEWYPHFFVLTSNKIYYSEETSSNQGNEDEEEHREICNGMDQHVTEKWFHGKLGAGRDGRQIAERLLSEYCVETGAPDGSFLVRESETFVGDYTLSFWRSGRVQHCRIHSRQEAGSPKFYLTDNLVFDTLFALITHYQQVPLRCNEFEMKLTEPVPQTNAHESKEWYHACLSRSQAENMLMRVPRDGAFLVRKRTEFNSFAISFRAEGKIKHCRVQQEGQTVVLGTSEFDSLVDLISYYEKHPLYRKMKLRYPINEETLEKIGTAEPDYGSLYEGRNPGFYVEANQMPTFKCTVKAMYEYKAQRDDELSFIKNAIISNVDKQEGGWWKGDCGGKKQLWFPANYVEEISPTAVEPDRSASENSPLGDLLRGSVDVSSCQIVVRPEGKGSRQFVFSLVPVASPRTGPVLDIAASSQEELKDWVVKIREVTMTSEAKLEEGKMMERRKKIALELSDLVIYCRPVPFDEDKIGTERACFRDMSSFPETKAEKYVNRVKGKKFLQYNRLQLSRIYPRGQRLDSSNYDPLPMWLCGSQLVALNFQTADKPMQMNQAIFMLNGRSGYVLQPPIMRDDNFDPFDRHSLRGVEPITLSIEVLGARHLPKHGRGIVCPLIEIEVCGAEYDNAKQRTDSEADNGLNPTWTRKLFRFTVCNPSFAFLRFVVYEIDMFSDQNFLAQATFPINCLKTGYRSVPLKNSYSEDLELACLLVHMDVIRGRVGYEMIHENGDMLSPFSPAGAMAMAMQTGRERMNDSGSVSSTSSMSPLPSSPAQALGYRGREGSFEARYQTPLEDFRVSQEALLDHENRRLRRARVSADNRA

SEQ ID NO: 9837 - DNA, 2630 bp, Rattus sp
  CDS (62)..(2332)
ccgctcggttgttgctcaagtgaatcacgccgggtcccctccgccgcgcgccccgacgggcatggactcgggtagggacttcctgaccctgcacgggctccaggatgacccggaccttcaggcccttctgaagggcagccagcttctgaaggtgaagtccagctcgtggcgtagggaacgcttctacaagctacaggaggactgcaagaccatctggcaggaatctcgaaaggtcatgaggtccccggagtcgcagctgttctccatcgaggacattcaggaggtacggatgggacaccgcacagaaggcctggagaagtttgcccgagacatccccgaggatcgatgcttctccattgtcttcaaggaccagcgcaacaccctagacctcattgccccatcaccagctgacgctcagcactgggtgcagggcctgcgcaagatcatccaccactccggctccatggaccagcggcagaagctgcagcactggattcactcctgcttgcgaaaggctgataaaaacaaggacaacaagatgaacttcaaggagctgaaggacttcctgaaggagctcaacatccaggtggatgacggctacgccaggaagatcttcagggaatgtgaccactcccagacagactcgctggaggatgaggagattgagaccttctacaagatgctgacccagcgcgcagagatcgaccgtgcttttgaggaggccgcaggatccgcggagaccctgtcggtggagaggctagtgacgtttctgcagcaccagcagcgggaggaggaggcagggccagccttggccctctctctcattgagcgctacgagcccagtgagactgccaaggcccagcggcagatgaccaaggatggcttcctcatgtacttgctgtcggctgacggtaacgccttcagcctggcacaccgccgtgtctaccaggacatggaccagccactgagtcactacttagtgtcttcttcccacaacacctacctgctggaagaccagctcacagggcccagcagcacggaggcctacatccgggctctgtgcaaaggctgccggtgcttggagctcgactgctgggatggtcccaaccaggaacccatcatctaccatggctacacttttacctctaagatacttttctgtgacgtgctcagggccatcagggactatgccttcaaggcatccccctacccagtcatcctgtccctggagaaccactgtagcctggagcaacaacgagtcatggcccgtcacctgagggctatcctggggcccatgctgttggaccagccactggatggggttacctcgagcctgccttcacctgagcaactgaagggcaagatcctgttgaaagggaagaagctgggagggctgctgcctgctggaggggagaatgggtccgaagccactgacgtgtctgacgaggatgaggctgctgaaatggaggacgaggctgtgcgcagccaagtgcaacacaagcccaaggaggataaactaaagctggtgccggagctctccgacatgatcatttactgcaagagcgtccactttggtggcttctccagtcctggcacctctgggcaggcattctatgagatggcttccttctctgagagccgtgccctccggttgctgcaagaatcaggaaatggttttgtccgtcataacgtgagctgtctgagcaggatctacccggctgggtggagaacagattcctccaactacagtcctgtggagatgtggaacgggggctgccagattgtggctctgaacttccaaacccctgggccagaaatggatgtttaccttggctgcttccaggacaatggaggctgtgggtatgtgctgaaacccgcctttctgagagaccccaacaccaccttcaactcacgtgccctgactcaggggccctggtgggctccgaagaggctccgtgtccggatcatctctggacagcagctgccaaaggtcaataagaataagaattctatcgtggaccccaaggtgatcgtggagatccatggcgtgggccgggacacggctagccgtcagacagcagttattaccaataatggtttcaacccacggtgggacatggagtttgagtttgaggtaacagtgcctgaccttgccctcgtacgcttcatggtagaggattatgattcctcttctaagaacgactttattggccagagtactatcccctggaacagcctcaagcaggggtaccgccatgtccacctcttgtctaagaatggagaccagcatccatcagccacactttttgtgaagatctccatccaggactaagcccgggggtctgatgcagtccgacctgagtgagtggagctgtgtccgcacctcggccaaggctgacattattgcaccgacctctggcgcggagcctgaggccctgaactgccttcagtgccaacacatcgcttgagcttctgcctctctggaggcccaggagtggtccgatccccggagcgctccaaaattccgttaggaacaacactgcatccctctccctaccctctagctgtctttatggataagtttttataaaaaaaaaaaatcaaaagaaaaaaaaaaaaaaaaaaaaaaa

SEQ ID NO: 9838 - protein, 756 aa, Rattus sp
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKLQHWIHSCLRKADKNKDNKMNFKELKDFLKELNIQVDDGYARKIFRECDHSQTDSLEDEEIETFYKMLTQRAEIDRAFEEAAGSAETLSVERLVTFLQHQQREEEAGPALALSLIERYEPSETAKAQRQMTKDGFLMYLLSADGNAFSLAHRRVYQDMDQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMARHLRAILGPMLLDQPLDGVTSSLPSPEQLKGKILLKGKKLGGLLPAGGENGSEATDVSDEDEAAEMEDEAVRSQVQHKPKEDKLKLVPELSDMIIYCKSVHFGGFSSPGTSGQAFYEMASFSESRALRLLQESGNGFVRHNVSCLSRIYPAGWRTDSSNYSPVEMWNGGCQIVALNFQTPGPEMDVYLGCFQDNGGCGYVLKPAFLRDPNTTFNSRALTQGPWWAPKRLRVRIISGQQLPKVNKNKNSIVDPKVIVEIHGVGRDTASRQTAVITNNGFNPRWDMEFEFEVTVPDLALVRFMVEDYDSSSKNDFIGQSTIPWNSLKQGYRHVHLLSKNGDQHPSATLFVKISIQD

SEQ ID NO: 9839 - DNA, 3753 bp, Drosophila pseudoobscura
  CDS (1)..(3753)
atgagctgcttcagtgcaatgaacgccccgctgctgggtgaaatggagcagaccattggcatgctggagcgcggtacaattgtgacgaagctgtacggcaagcaaaggcgtccggatcgtcgccatctaatgcttatcagggaaacgcgtcagctgctttggtcgacagtggccgcccaaacgccccggaccgactttgagggtgcgatacagctgcgcgagatccgtgagatacgtgtgggcaagcactcgaaggagttccgtctcttcgccgacgattgccagcgctacgagaacagcaaatgctttgtcatcttgtatggcaatcacttcaagctgaagagcttctcggtggtggccctatcggagatcgaggccgacaattgggtgcgtgggctccgctatatggttaaggacacagtgaacgcttcgtatccgctgcagatcgatcgctggctgcgacgcgaatactatcagatcgagaatgtcaactcgcattcggccaaatcgtcggaacaatcccagacgcaggtgaccatcaaggactttaagatgttcctggccagcgtcagctgcaaaatgaccaccagcaaattcatggagtgcttcaccgacgatgtccgacgaaagcatgacctcaagtttgatgacttttcgcgtctctatcagaagctcctactgccgcatagtttcgccaacattttgtgtgggggaacagccgcatcgagtgcgtttccctactcggaggaccagcagacagtgcgtcccacagagctgaagcgttttctggaaacagaacagcgtgatctgaacgtgggcgaactcaattccgggtccatatccggcttcatacgtgactttgtgcaggatgtggagcgcgatgtacaggagccctatctgacgctgtcggagttcgtcgactacctcttctcgaagcagaacgacctgtggaacagcaaatacgatgccatcttcatggacatgaacctgccgctctcctcgtactggatagcctcgtcacacaacacctacctgacgggcgatcaattctccagcgaatcatcgtgcgaggcctatgcccgggccctgcgcatgggctgtcgctgcattgagctcgactgttggaatggccccgataacttaccctacatattccatggtcacacaatgacatccaaaatcaagttcatggatgttgtaaagaccatcaaggatcatgccttcaccacctccgagtatcccgtcattctgtccatcgaacagaattgctctttagagcagcaacgaaatatggcacaggcgttaattgaggtctttggcgatatgctgctcacgcagccatgtgatcggaacgaacagcatttgccctccccctaccagctccgccgcaagataattctaaagcacaagaagctgccgcaatacgatgagacgacattcagcggcgtgggcataagtaacggtggcatagcagcggccgctgctggtggcggcggcggctcatcgcttacccatcgatcatcgttgagcggtggcgttggtgaaaatgagggtgaaaatatgcgcaaggtattcaaagaggggttgctgtacttcaaggatcccgtggacaagtcctggaatctctatcagtttgtgttgacccaacaagagctcatctacacctctgaaatcagcgaatcacatcgcaatggcacctcagaagatgacgactttggtctgtcgtcgtcctgttctttgaacaacacaatgcaacagaaacagaaggatacctcggccaacgatgagctgcattttggtgaaaactggtttcatggcaaattggaaggtggccgcaaagaagccgacgacctgctgcaaaagtataaacatcttggtgatggaacatttttggtgcgcgaatcggccacatttgtgggcgactatagcctctcgttttggcgtcggaatcgaccgaatcactgtcgcatcaaattaaagcacgagagcggctccattcgctactatttggtcgagaatttcatattcgattcgctgtattcgctgattgtttactatcgcaagaatatgctgcgcagctcggagttctcgataatacttaaggagccagtgccacagccgaagaagcatgaggaccaggactggttccatcccaacaccaccaaggagcaggccgagcaggggctgttcaagctggacattggttcgtttttggtacgcccctcggtgcagagcatcaatgcttttgtcatttcgttcacgatcaatcgaaagatcaaacactgtcggattattcaagagggacgactgtatgccatcgatacgatgcagtttgagtcgttggtgtcgctcatccattattatacgagaaatccgttgtatcgcaatgtgaagctctgccatcctgtgtcccaggatctgctgcgacaggcactggcggagaatgcacagcagggcacagatcacagtaacgatggcaacggggcttcgaattatatgggctccaatctggaggagcatgtcacctgcaaggctctgtacagctacaaggccaacaaaccggatgagctgtcctttcccaagcacgccatcatcacgaatgtccaaagaaacaacaccatgtggtggataggggactatggcggcatgataaagaagcatttgccagccaactatgtaaaggtgattgatgccgccacagaggattacaattcggtgaatgaggagggcaccgacggccgaaccgattcgattgagatatatggggccgtggcctcgctcttcgaatcaaatgagcctggcatcatattcaagctgcaaatacaaacgccaacgatgcaaaatccgtttgtgatcgggtttgacaatcaggagacggcctacgagtggataaaggccatccaggaggcggccttgatcgctagtcaactggccactgagcggcgcaaaaaagagcgcacggcgcgcgtggccaaggaaatgtccgatctgataatatatttccggagtgtaccatttcgtgagcactcctggattttccaggagatgtccagttttcccgaaacgaaggccgaaaagcagttcttccaacagaatacgcagctctttctctcgtatcatcgaaaccaaatcagtcgtgtgtatcccaaggggcagcgcctcgactcgtcaaacttcaatcccgtgcctttctggaatattggatctcagatgatagccctcaactatcagacgggcgacaaggccatgcaactgaatcaggccaaattccggaataatggccaatgtggctatatactgaagccgtcgttcatgaaggccgaaagtttcaatccaaacaacccgctgtccgatggcctcaatgaagtgcgtgtcagcatacgcctgatagcggcacggcatctgtttcgcggcggtaaatccaataatccacaaatcgtggtggaaatcatgggcgccagcttcgatactgggatcaaatatcgcaccaaagtcaatgagaatggcttcaatccggtgtggaatgaggcctgcgagtttaccgtacgcaatccacagtttgcgatcctccggttcgaagtccaggacgaggatatgtttgcagagacacatttcatagcgcaggcctgctatccattgacctgtgtgcgccagggctatcgcagtgtaatattgaggaacaaattcagcgaggaactggaactatcctcattgctggtcaacataaagataacaaatatcacttccacttag

SEQ ID NO: 9840 - protein, 1250 aa, Drosophila pseudoobscura
MSCFSAMNAPLLGEMEQTIGMLERGTIVTKLYGKQRRPDRRHLMLIRETRQLLWSTVAAQTPRTDFEGAIQLREIREIRVGKHSKEFRLFADDCQRYENSKCFVILYGNHFKLKSFSVVALSEIEADNWVRGLRYMVKDTVNASYPLQIDRWLRREYYQIENVNSHSAKSSEQSQTQVTIKDFKMFLASVSCKMTTSKFMECFTDDVRRKHDLKFDDFSRLYQKLLLPHSFANILCGGTAASSAFPYSEDQQTVRPTELKRFLETEQRDLNVGELNSGSISGFIRDFVQDVERDVQEPYLTLSEFVDYLFSKQNDLWNSKYDAIFMDMNLPLSSYWIASSHNTYLTGDQFSSESSCEAYARALRMGCRCIELDCWNGPDNLPYIFHGHTMTSKIKFMDVVKTIKDHAFTTSEYPVILSIEQNCSLEQQRNMAQALIEVFGDMLLTQPCDRNEQHLPSPYQLRRKIILKHKKLPQYDETTFSGVGISNGGIAAAAAGGGGGSSLTHRSSLSGGVGENEGENMRKVFKEGLLYFKDPVDKSWNLYQFVLTQQELIYTSEISESHRNGTSEDDDFGLSSSCSLNNTMQQKQKDTSANDELHFGENWFHGKLEGGRKEADDLLQKYKHLGDGTFLVRESATFVGDYSLSFWRRNRPNHCRIKLKHESGSIRYYLVENFIFDSLYSLIVYYRKNMLRSSEFSIILKEPVPQPKKHEDQDWFHPNTTKEQAEQGLFKLDIGSFLVRPSVQSINAFVISFTINRKIKHCRIIQEGRLYAIDTMQFESLVSLIHYYTRNPLYRNVKLCHPVSQDLLRQALAENAQQGTDHSNDGNGASNYMGSNLEEHVTCKALYSYKANKPDELSFPKHAIITNVQRNNTMWWIGDYGGMIKKHLPANYVKVIDAATEDYNSVNEEGTDGRTDSIEIYGAVASLFESNEPGIIFKLQIQTPTMQNPFVIGFDNQETAYEWIKAIQEAALIASQLATERRKKERTARVAKEMSDLIIYFRSVPFREHSWIFQEMSSFPETKAEKQFFQQNTQLFLSYHRNQISRVYPKGQRLDSSNFNPVPFWNIGSQMIALNYQTGDKAMQLNQAKFRNNGQCGYILKPSFMKAESFNPNNPLSDGLNEVRVSIRLIAARHLFRGGKSNNPQIVVEIMGASFDTGIKYRTKVNENGFNPVWNEACEFTVRNPQFAILRFEVQDEDMFAETHFIAQACYPLTCVRQGYRSVILRNKFSEELELSSLLVNIKITNITST

SEQ ID NO: 9841 - DNA, 3696 bp, Drosophila virilis
  CDS (1)..(3696)
atgagttgctttagtgcaatgaatacacccctattgggggaaatggagcagacaatttgcatgctagaacgcggaacaattgtaacgaaactatatggaaaacaacgacgccccgatcggcgacacctcatgcttatcagagaaacccgtcagctgttatggtccactgtcgctgcacagacacgcaccgagtacgagggaacgatccagttgcgggagatacgcgagatacgcgtcggcaagaactcaaaggagttccgactccatgccgatgactgccagcgcttcgagagcagcaaatgttttgtcattatgtacggcaacagtttcaagctgaagagcttctctgtggtggcgctctcggagatcgaagcggataactgggtacggggattaaggtatatggttaaggacaccatccattcaccgtatccactgcaaatcgatcgttggctgcggcgtgaatactattcgttcgagaatgttaactcgcacctgaccaaatccgaccagagctcccaagtgaccatcaaggatttcaaaacattcttgagcaacgttagctgcaaaatgagcaccagtaaatttatggaatgctttacagatgatataaaacgcaagcatgatctgaaattcgacgatttctcgcgtctgtatcagaaactcttgctgcccgttaatttcatcagtgtccttggtagtgcggagttcgcttattcggaggacaagaaaatagtaaggcccattgagtttaaacgtttcctggaaactgaacagcacgatttgaatgccttggatctgaatagcatatctagttttatgcgcgactttgtgcaggacgttgaacgcgatgtgcaggagccatatttaaccatctccgagtttgtcgattatctcttttccaagcaaaatgatctgtgggacacaagattcgatgccgtgttcatggacatgaaccagccgttgtcctcctactggatagcctcatcccataacacatatctaacgggtgaccagttctcgagcgaatcctcttgcgaggcttatgcacgtgctctccgcatggggtgtcgctgcatcgagctagactgctggaatggtcctgacaatttgccatacatattccatggtcacaccatgacatcaaagattaagttcatggacgtcatcaagactattaaagatcatgcattcacaacgtcagagtatccagtaattctatccatcgaacagaactgctccttggagcaacagcgaaatatggcacatgcgctgattgaggtctttggagatatgctgctcacacagccctgcgatcgaaatgagctgcatttgccgtcgcccaatcagctgcgtcgcaagataattctaaagcacaaaaagttgccgcaattcgatgaaaatgttagtgcaattaatttacctgcggttggtgttaataatggaacgatcgcttcatttagtcatcgatcttctctgggtggcgcaacggatgataacgagaatttgcagaaaatcttaaagaaaggcttgctgtactttaaggacccagtcgataaatcgtggaacctctatcagtttgtgctcacccaacaggagcttatctacacatccgaaatcagcgaatgccgcaacggcaattcagaagatgatgatttcggactgtcgtcctgtacgctgaatagcaatatgcagcagaagcagaaggatacatcggccaatgatgagctgcattttggtgaaaattggtttcacggcaagttagagggtggaagacaagaggcggatcagttgttggaaacgtacaaacacctgggcgatggcacattcttggtgcgcgagtcggccacgtttgtgggtgattatagcttgtccttctggcggcgcaatcggcccaatcattgccgtattaagctgaaacacgagaatggctcgattaagtattatctggttgagaactttgtatttgattcgttgtactcgttgattgtgtactaccgcaagaatatgctgcgtagctcagagttttccattatcctcaaggagccagtaccacaaccaaagaagcacgaaagtcaggattggtttcatccaaacaccacaaaggagcaggccgagcagggtctgttaaagctggacattggatcgtttctggtgcggccatcggtgcagagcgtcaatgcgtttgtcatatcctttacgataaatcgcaaaatcaaacactgtcggatcatgcaggagggtcgcctatatgccattgacacaatgcaatttgagtctttagtatcgctaatacactattatatgaggaatccgttatatcgcaacgtcaagctcgtccatccggtttcccaggagctcctgcgacagagcctaatagagaatgcccaattgcacggtgagcatagcaataacgatagctctggtgcttccaattatatgggctccaatctggaggaatatgtcacatgcaaggccctatacagctataaggccgacaagccagacgagctctcctttccaaagcacgcgatcataacgaatgtgcagaggaacaactccatgtggtggaaaggtgattacggtggcatgatacaacaacatctgccggctaactatgtcaaggtcattgattccgcaactgaggattataattcggtcactgaggagggcaacgatgggcgcaccgattcaattgagatctatggcgcagtggcgtctcttttcgagtcaaacgagcctggaattataataaagctgcagattcaaacgccaacaatgcaaaatccattcataatcggatttgacaaccaggagacggcgtacgagtggatcaagtccatacaggacgcagcactaattgctagtcaattggcgacagaacgacgtaaaaaggagcgcacggcacgcgtggccaaggagatgtccgatttgatcatctattttcgcagtgtaccgtttcgggatcactcttggatattccaagaaatgtccagctttcccgaaacaaaggccgaaaagcagtttatacaacaaaatatgccgctctttctgtcgtatcatcgcaatcaaattagccgtgtatacccgaagggtcaacgcttggactcatccaactttaatccggtgccattttggaacattggctcccaaatgattgcactgaattatcaaactggcgacaaggccatgcagctaaatcaggccaaatttcgaaataatggccaatgtggctacatactgaagccagcgtttatgatgtccgagaattttaatcccaacaatcccttgtctgacggcctcatcgaaacgaaggttagcgtacgcatcattgcagctcgtcatctattccgcggtggcaaatcgaataatccgcaaattgttgtggaaatcgttggcgccagctttgacagcggcatcaaatatcgcagcaaggtcaatgagaatggattcaatcccatttggaacgaatcctttgagttcacagtgcacaatccacagtttgcgctgctgcgcttcgaggtccaggacgaggatatgtttgccgaaacgcatttcatagcccaggcctgctatccattgacctgtgtgcgccaaggctatcgcagcgtgatcctgcgcaacaagttcagcgaggagctggagctgtcctcgcttttagtcaatatagagatttcaaatcgggaatctacttag

SEQ ID NO: 9842 - protein, 1231 aa, Drosophila virilis
MSCFSAMNTPLLGEMEQTICMLERGTIVTKLYGKQRRPDRRHLMLIRETRQLLWSTVAAQTRTEYEGTIQLREIREIRVGKNSKEFRLHADDCQRFESSKCFVIMYGNSFKLKSFSVVALSEIEADNWVRGLRYMVKDTIHSPYPLQIDRWLRREYYSFENVNSHLTKSDQSSQVTIKDFKTFLSNVSCKMSTSKFMECFTDDIKRKHDLKFDDFSRLYQKLLLPVNFISVLGSAEFAYSEDKKIVRPIEFKRFLETEQHDLNALDLNSISSFMRDFVQDVERDVQEPYLTISEFVDYLFSKQNDLWDTRFDAVFMDMNQPLSSYWIASSHNTYLTGDQFSSESSCEAYARALRMGCRCIELDCWNGPDNLPYIFHGHTMTSKIKFMDVIKTIKDHAFTTSEYPVILSIEQNCSLEQQRNMAHALIEVFGDMLLTQPCDRNELHLPSPNQLRRKIILKHKKLPQFDENVSAINLPAVGVNNGTIASFSHRSSLGGATDDNENLQKILKKGLLYFKDPVDKSWNLYQFVLTQQELIYTSEISECRNGNSEDDDFGLSSCTLNSNMQQKQKDTSANDELHFGENWFHGKLEGGRQEADQLLETYKHLGDGTFLVRESATFVGDYSLSFWRRNRPNHCRIKLKHENGSIKYYLVENFVFDSLYSLIVYYRKNMLRSSEFSIILKEPVPQPKKHESQDWFHPNTTKEQAEQGLLKLDIGSFLVRPSVQSVNAFVISFTINRKIKHCRIMQEGRLYAIDTMQFESLVSLIHYYMRNPLYRNVKLVHPVSQELLRQSLIENAQLHGEHSNNDSSGASNYMGSNLEEYVTCKALYSYKADKPDELSFPKHAIITNVQRNNSMWWKGDYGGMIQQHLPANYVKVIDSATEDYNSVTEEGNDGRTDSIEIYGAVASLFESNEPGIIIKLQIQTPTMQNPFIIGFDNQETAYEWIKSIQDAALIASQLATERRKKERTARVAKEMSDLIIYFRSVPFRDHSWIFQEMSSFPETKAEKQFIQQNMPLFLSYHRNQISRVYPKGQRLDSSNFNPVPFWNIGSQMIALNYQTGDKAMQLNQAKFRNNGQCGYILKPAFMMSENFNPNNPLSDGLIETKVSVRIIAARHLFRGGKSNNPQIVVEIVGASFDSGIKYRSKVNENGFNPIWNESFEFTVHNPQFALLRFEVQDEDMFAETHFIAQACYPLTCVRQGYRSVILRNKFSEELELSSLLVNIEISNREST

SEQ ID NO: 9843 - DNA, 2075 bp, Homo sapiens
  CDS (192)..(2018)
ctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 9844 - protein, 608 aa, Homo sapiens
MEMRWFLSKIQDDFRGGKINLEKTQRLLEKLDIRCSYIHVKQIFKDNDRLKQGRITIEEFRAIYRIITHREEIIEIFNTYSENRKILLASNLAQFLTQEQYAAEMSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 9845 - DNA, 2452 bp, Mus musculus
  CDS (72)..(2111)
gcttcttccttctcttctcctgtcccctggagaggtttgcccaacctctccaaagagggacacttgacatcatgtctttgctcaaccctgttctattgccccctaacgtgaaggcatatctgagccaaggggagcgcttcatcaagtgggacgatgaaacttcaatagcctctcctgttatcctccgtgtggatcccaagggctattacttatactggacatatcaaaatcagagccagaaactccgggaggtcttcaacatggactttccagacaaccacttcctgctgaaaacactcacagtggtgtccggccctgacatggtggacctcaccttctacaactttgtctcttacaaggagaacgtaggcaaggactgggctgaggacgtgctagctctcgccaaacacccgatgacagtcaatgctcctcgaagcacattcctggacaagatcctggtgaagcttaagatgcagctcaaccctgaagggaagattcccgtgaagaattttttccagatgtttcctgctgatcgaaaacgggtggaagctgccctcggtgcttgtcaccttgcaaaaggcaaaaatgatgctatcaacccagaggacttcccagaatccgtgtacaagagcttcctcatgagcctctgtcctcggccagaaatcgacgagatcttcacttcctaccactctaaagctaagccctacatgaccaaggaacacctgaccaaattcatcaatcagaagcagcgagaccctcgactcaactccttgctgttcccaccagcccggcctgagcaagttcaagtgctcattgacaagtacgaacccagcggcatcaatgtgcagaggggccagctgtcaccagaggggatggtctggtttctctgtggaccagagaacagtgtgctggcccacgatacactgctgatccaccaagacatgacacaaccactgaatcactatttcatcaactcctcacacaacacctacctgacagccggccagttctcaggcctttcctcggctgagatgtaccgccaggtgctgctgtctggctgccggtgtgtagagttagactgttggaagggcaagccccctgacgaagagcccattatcacccacggcttcaccatgaccacagatatcttgttcaaggaagcaattgaagccattgcagaaagtgcctttaagacctccccgtatcctgtcatcctatcatttgaaaaccatgtagactcaccccggcaacaggctaagatggctgagtactgcaggagcatgtttggagagaccttgctcacagatcccctggaaaatttccctctgaaacctggcatccctctgcccagccccgaggacctccggggcaagatcctcattaagaataagaagaaccagttttctgggccagcatcccccagcaagaagcctggtggggtggctgagggcagcctcccgtctagtgtccctgtagaagaggacacggggtggactgctgaggaccggactgaggtggaggaggaggaggtggtggaagaggaggaagaggaggagtcaggaaacctggatgaagaagaaattaagaagatgcagtcggatgagggcacagcaggcctggaggtgacagcttatgaggaaatgtccagccttgtcaattatatccagcccaccaagtttatctccttcgagttctctgcacagaagaacagaagttacgttgtctcttccttcacggagctcaaggcctacgagctgctctccaaggcctccatgcagtttgtggactataataaacgccagatgagccgtgtgtaccccaagggcacacgcatggactcttccaactacatgccccagatgttctggaatgctggatgtcagatggttgccctcaatttccagacaatggacctgcccatgcagcagaacatggcactgtttgagttcaacgggcagagtggctacctcctaaagcacgagttcatgcgcagactggacaagcagttcaaccccttctcagtggaccgcattgatgtggtggtagccaccaccctttccattacggcaaggcccagggctgacaaatggctgggagggctgggctcttgaaaagaaggctaaaaagcccacccctctacctcaaccccctttcctgatatcttgaagacttcaaccccaaccagttcctgcagtagcaagttgccttggaaactgcctcctcctcagcattggagtctgcctcttggtccccatggaaaccaaggggaagggctgaaactcccgtggggggaggggagagacagagacagagacagagtctggctatgctgggcagcaggagcccaagctccagaccagggggtaaacgtttgttgcttctttcttgtgtgggtggcctgcctctgctcggaagtcctggaaagcactcaggtccttaaagtgtgcctgcg

SEQ ID NO: 9846 - protein, 679 aa, Mus musculus
MSLLNPVLLPPNVKAYLSQGERFIKWDDETSIASPVILRVDPKGYYLYWTYQNQSQKLREVFNMDFPDNHFLLKTLTVVSGPDMVDLTFYNFVSYKENVGKDWAEDVLALAKHPMTVNAPRSTFLDKILVKLKMQLNPEGKIPVKNFFQMFPADRKRVEAALGACHLAKGKNDAINPEDFPESVYKSFLMSLCPRPEIDEIFTSYHSKAKPYMTKEHLTKFINQKQRDPRLNSLLFPPARPEQVQVLIDKYEPSGINVQRGQLSPEGMVWFLCGPENSVLAHDTLLIHQDMTQPLNHYFINSSHNTYLTAGQFSGLSSAEMYRQVLLSGCRCVELDCWKGKPPDEEPIITHGFTMTTDILFKEAIEAIAESAFKTSPYPVILSFENHVDSPRQQAKMAEYCRSMFGETLLTDPLENFPLKPGIPLPSPEDLRGKILIKNKKNQFSGPASPSKKPGGVAEGSLPSSVPVEEDTGWTAEDRTEVEEEEVVEEEEEEESGNLDEEEIKKMQSDEGTAGLEVTAYEEMSSLVNYIQPTKFISFEFSAQKNRSYVVSSFTELKAYELLSKASMQFVDYNKRQMSRVYPKGTRMDSSNYMPQMFWNAGCQMVALNFQTMDLPMQQNMALFEFNGQSGYLLKHEFMRRLDKQFNPFSVDRIDVVVATTLSITARPRADKWLGGLGS

SEQ ID NO: 9847 - DNA, 1941 bp, Mus musculus
  CDS (1)..(1941)
atgcctggtccccagccgtctgctgccagccagaccacaggagccgtggcttgcctggcagaggtactcctctgggttggagggagcgtggtagtgtcaccaagatggcagctcagccttgtagtggagcgatgcatgagtgccatgcaagaggggacccagatggtgaagctccgtggcagctccaagggattggtccgcttctactacctggatgagcaccgctcctgcctccgatggcgtccctcccgcaagaacgagaaagccaagatttccatcgactccatccaggaggtgagtgagggccggcagtctgaaatcttccagcgctacccggacagcagctttgaccccaactgctgcttcagcatctaccatggcagccacagagagtcgctggacttggtctcacccagcagtgaagaggcacgtacctgggtcaccggccttcgctacctcatggctggcatcagcgatgaagacagcctagcccgtcgccagcgtaccagggaccagtggctgaagcagacgtttgatgaggctgacaagaacggggacggcagcctgagcatcagtgaggttctgcagctgctacataaactcaacgtgaacctgccccggcagagggtgaaacagatgttcagggaggcggacacagatgaccatcaggggacattaggctttgaggaattctgcgccttctacaagatgatgtctacccgccgagacctctacctgctcatgctgacctacagcaaccataaggaccacttggatgcctccgacctgcagcgctttctggaggtggagcagaagatgaacggtgtgaccctggagagctgtcagaacatcattgagcagtttgagccttgcctggaaaataagagcaaggggatgctggggattgatggctttaccaactacacccggagccccgccggtgacatcttcaaccctgagcacaacagagtgcaccaagacatgacgcagccgctgagtcactacttcatcacctcgtcccacaacacctacctcgtgggtgaccagctcatgtcccagtctcgggtggacatgtatgcctgggtcctgcaggccggctgccgctgtgtggaggtggactgctgggacgggcccgatggagaacccattgtccatcatggctacactctgacctccaagatccttttcaaagatgtcatcgaaaccatcaacaaatatgccttcatcaagaatgagtacccagtgatcctgtccattgagaaccactgtagtgttgttcagcagaagaagatggcccagtatctgactgacatcctcggggacaagctggacctctcctcagtgagcagcgaagatgccaccatgcttccatctccacagatgctcaagggcaagatcctggtgaaggggaagaagctccctgccaatatcagtgaggatgcagaagaaggcgaagtatctgatgaggacagtgctgatgagatggaggatgactgcaagctcctcaatggggatgcctccaccaatcggaagcgtgtggaaaacattgcaaagaagaagctggattctctgatcaaggagtcaaagatccgtgactgtgaagaccccaatgacttctctgtgtccacactatccccctctggaaagcttgggcgcaaagcagaggccaagaagggtcagagcaaggttgaggaagacgtggaggccggggaagacagcggggtgagcaggcagaatagccgcctcttcatgagcagcttctccaagcgcaagaaaaaaggtagcaagataaagaaggtggccagcgtggaagagggggacgagaccctggactccccaggaagccagagcccgagggactgcccggcaaaagaagaccatgaagctgtcacgagccctctcggacctagtgaaatataccaagtctgtggggacccatga

SEQ ID NO: 9848 - protein, 646 aa, Mus musculus
MPGPQPSAASQTTGAVACLAEVLLWVGGSVVVSPRWQLSLVVERCMSAMQEGTQMVKLRGSSKGLVRFYYLDEHRSCLRWRPSRKNEKAKISIDSIQEVSEGRQSEIFQRYPDSSFDPNCCFSIYHGSHRESLDLVSPSSEEARTWVTGLRYLMAGISDEDSLARRQRTRDQWLKQTFDEADKNGDGSLSISEVLQLLHKLNVNLPRQRVKQMFREADTDDHQGTLGFEEFCAFYKMMSTRRDLYLLMLTYSNHKDHLDASDLQRFLEVEQKMNGVTLESCQNIIEQFEPCLENKSKGMLGIDGFTNYTRSPAGDIFNPEHNRVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVVQQKKMAQYLTDILGDKLDLSSVSSEDATMLPSPQMLKGKILVKGKKLPANISEDAEEGEVSDEDSADEMEDDCKLLNGDASTNRKRVENIAKKKLDSLIKESKIRDCEDPNDFSVSTLSPSGKLGRKAEAKKGQSKVEEDVEAGEDSGVSRQNSRLFMSSFSKRKKKGSKIKKVASVEEGDETLDSPGSQSPRDCPAKEDHEAVTSPLGPSEIYQVCGDP

SEQ ID NO: 9849 - DNA, 4227 bp, Mus musculus
  CDS (108)..(3812)
gacgccgcggggccagagcgggccgcgcgggagcgtgtggagagagcagtggcaccgtcggttcccgtcggggctccgtaggtccccgagccgcccctggcttagccatggcgggcgcgaggcccggcgtccacgcgctgcagctggagccgcccaccgtggtggagaccctgcggcgcgggagtaagttcatcaaatgggacgaggaggcctccagtcggaacctggtgaccctgcgtgtggaccctaatggcttcttcttgtactggacaggacccaacatggaggtggacacactggacatcagctccatcagggacacaaggacaggtcgttatgcccgcctgcccaaggaccctaagattcgagaagtactgggctttggaggtcctgacacccggctggaggagaaactgatgacagtggtggccgggccagatccagtaaataccacattcttgaacttcatggccgtgcaagatgacacagtcaaggtctggtcagaggagttgtttaaactggccatgaacatattggctcagaacgcctcccggaacaccttcctgcggaaagcatacacgaagctgaagctgcaggtgaaccaggatggacggattccggtcaagaacattctgaagatgttctcggcggacaagaagcgggtggagacggcgctggagtcctgtggcctcaacttcaaccgagttgagtccattcgccctgatgagtttcccttggaaatttttgagcggttcttgaataaactgtgtctgcgcccagatattgacaagatcctgctggagataggtgccaagggcaagccgtacctcactctggagcagctcatggactttatcaaccagaagcagagagacccgagactcaacgaagtgctgtacccgccacttcggtcctcacaggctcggctgctcattgagaagtacgagacgaacaaacagttcctggagcgcgaccagatgtctatggagggcttcagccgctacctgggaggggaggagaatggtatcctgcctctggaggccctggatctgagcatggacatgacccagccactgagcgcatattttatcaactcctcacacaacacctatctcactgcgggccagctggctggaccatcatcggtggagatgtaccgccaggcactgctgtggggctgccgctgtgtggagctggatgtatggaagggacggccaccggaggaagagcctttcatcactcatggtttcaccatgaccactgaggtgccattgcgtgatgtgctagaggccatcgctgaggcagccttcaagacctcgccctaccctgtcatcctctcctttgagaaccatgtcgactcggcaaagcagcaggccaagatggctgagtactgccgctctatctttggggatgcgctgctcattgaccctctcgacaaatacccgctatctgcgggcatccccctgcctagtccacaggacctgatgggccgtatcctggtgaagaataagaagcgacatcggcccagcacaggtgtccctgacagctcagtgcgcaagcggcctctggaacagagcaactcggccttgagtgagagctcggccgccacagagccctcctcacctcagcttgggtcccccagctccgacagctgccctggcctaagcaatggggaggaggtgggactcgagaagaccagcctggagcctcagaagtctctaggtgaggagagcctcagccgggaacctaatgtgcccatgcctgaccgtgaccgagaggatgaggaggaagatgaagaagaagaggaaacaacggatccaaaaaagcccaccactgatgagggcacagccagcagtgaggtcaatgccacggaggagatgtcaacgctcgtcaactacgttgagcccgtcaagttcaagtccttcgaggctgctcgaaaaaggaacaagtgcttcgagatgtcatccttcgtggagaccaaggcaatggagcaactgaccaagagtcctatggagtttgtggaatacaacaaacagcagctcagccgcatctaccctaagggcacacgagtggactcctccaactacatgcctcagctcttctggaacgtgggttgccagcttgttgccctcaacttccagaccttggatttgccaatgcagctcaacgcaggcgtgtttgagtacaatgggcgcagcgggtacttgctcaagcccgagtttatgcggcggccggacaagtcttttgatcccttcactgaggtcatcgtagatggcatagtggccaacgccttgcgggtcaaggtgatttcggggcagttcctgtctgacaagaaggtgggcatctacgtcgaggtggacatgtttggcctcccagttgacacaagacgcaaatatcgtacccggacatcccaggggaactcattcaaccctgtgtgggacgaggaaccctttgacttccccaaggttgtgctgcccacgctggcctcacttcgcatcgcagcctttgaggagggtggcaaatttgttgggcaccgtatcctgcctgtctctgctatccgctcaggataccactatgtctgcctgcgaaacgaggccaaccaacctttgtgcctgcctgccctgcttatctacactgaagcttctgactacatcccagatgaccaccaggactatgcggaggccttgattaaccccatcaagcacgtaagcctaatggaccagcgggccaagcaactagccgctctcattggggagagtgaggctcaggccagcacagagacatatcaggagaccccgtgtcaacagccagggtcacagctcccctccaaccccacacctaacccactggatgcctcacctcgctggccccccggtcctaccacttcctccactagctcctccctcagtagcccagggcagcgagatgatttgattgccagcatcctctctgaggtgacccctacacctctagaggagctcagaagccacaaggctatggtgaagctacggagccggcaggatcgagacctgcgggagttgcataagaagcaccagcgcaaggctgtggccctcacccgccgccttctggatggcctggcccaggccagggctgaggggaagtgccggccctcccccagtgccctgggcaaggccaccaactcggaggacgtgaaggaggaagaggaggccaaacagtatcgagagttccagaaccgacaagtacagagcctgttggagctgagggaagcccaggcagatgtggagaccaagcggaagctggagcatctacgacaggctcatcagcggctcaaggaggttgtcctggatacacacacaacacagttcaagaggctgaaggagctgaatgaaagggagaagaaggaactccagaagatcctggacaggaagcgcaacaacagcatctcagaggccaagacaagggagaaacacaagaaggaggtggaactgacagagattaatcggcggcacatcactgagtcggtaaactccatcagacggctggaagaggcccagaagcagcgccatgaacgcctggtggcagggcaacagcaagtcctccagcagctagaggaagaggaacccaagctgctggcccagctgacccaggagtgtcaggaacagcgagagaggttgccccaggagatccgtcggtgcctgctgggcgagacagcagagggactgggggacggccccctggtggcctgtgccagcaatggtcatgcacctgggagtggtgggcacctgtccagcgctgactcggagagccaggaggagaacacccagctttgaactggctgagcaagaggtggccacaagtctgggtgggcactgggctatgggtagaagacactaatactttgggttttttttaaccttttatctttagaaattttatttttttaaaatctgaggcaaatgcctcacactaactctaactccctgcatcttcctgggacctcttggtcctcagcctccccttctaacttcaggcctagggaaagggctagggcttgtaccccataacattcacctaagataggtactccccgattcccaaggagcagctagtggaaccctggagttctgggtagtagaaagcaaccctttatatttggggagttttgtttgtttgtttgtttgttttttacatgaataaaagtggacttcagggaaaaaaaaaaaaaaaaaaaaaaaaaaaaaaaaa

SEQ ID NO: 9850 - protein, 1234 aa, Mus musculus
MAGARPGVHALQLEPPTVVETLRRGSKFIKWDEEASSRNLVTLRVDPNGFFLYWTGPNMEVDTLDISSIRDTRTGRYARLPKDPKIREVLGFGGPDTRLEEKLMTVVAGPDPVNTTFLNFMAVQDDTVKVWSEELFKLAMNILAQNASRNTFLRKAYTKLKLQVNQDGRIPVKNILKMFSADKKRVETALESCGLNFNRVESIRPDEFPLEIFERFLNKLCLRPDIDKILLEIGAKGKPYLTLEQLMDFINQKQRDPRLNEVLYPPLRSSQARLLIEKYETNKQFLERDQMSMEGFSRYLGGEENGILPLEALDLSMDMTQPLSAYFINSSHNTYLTAGQLAGPSSVEMYRQALLWGCRCVELDVWKGRPPEEEPFITHGFTMTTEVPLRDVLEAIAEAAFKTSPYPVILSFENHVDSAKQQAKMAEYCRSIFGDALLIDPLDKYPLSAGIPLPSPQDLMGRILVKNKKRHRPSTGVPDSSVRKRPLEQSNSALSESSAATEPSSPQLGSPSSDSCPGLSNGEEVGLEKTSLEPQKSLGEESLSREPNVPMPDRDREDEEEDEEEEETTDPKKPTTDEGTASSEVNATEEMSTLVNYVEPVKFKSFEAARKRNKCFEMSSFVETKAMEQLTKSPMEFVEYNKQQLSRIYPKGTRVDSSNYMPQLFWNVGCQLVALNFQTLDLPMQLNAGVFEYNGRSGYLLKPEFMRRPDKSFDPFTEVIVDGIVANALRVKVISGQFLSDKKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRAKQLAALIGESEAQASTETYQETPCQQPGSQLPSNPTPNPLDASPRWPPGPTTSSTSSSLSSPGQRDDLIASILSEVTPTPLEELRSHKAMVKLRSRQDRDLRELHKKHQRKAVALTRRLLDGLAQARAEGKCRPSPSALGKATNSEDVKEEEEAKQYREFQNRQVQSLLELREAQADVETKRKLEHLRQAHQRLKEVVLDTHTTQFKRLKELNEREKKELQKILDRKRNNSISEAKTREKHKKEVELTEINRRHITESVNSIRRLEEAQKQRHERLVAGQQQVLQQLEEEEPKLLAQLTQECQEQRERLPQEIRRCLLGETAEGLGDGPLVACASNGHAPGSGGHLSSADSESQEENTQL

SEQ ID NO: 9851 - DNA, 2134 bp, Arabidopsis thaliana
  CDS (276)..(1910)
atctctcagttcttcgaccaaaaacatttttctggattcgaagaatcaaaccctaaaagttattaacaatggggaaggagaagaaaacagagtcgtataataacgatagcggtagttacaattacagaatgttcaaattttataaccgtaaattcaagatcaacgaagtcacacccaccgacgacgtccgtgacgctttttgtcaattcgccgtcggtggcggtggtggaggaaccgatggagattcaagtgatggtgacggatcaaccggtgtaatgggtgcagagcagctttgttctttcctcgatgatcacggtgagtcaacaaccgtcgcggaggctcaacggttgatcgatgaggttatacgacggagacaccacgtcacgcgcttcacgcgccacggacttgacctcgacgatttcttcaatttcttattttacgacgatctcaatcctcccattacccctcacgtgcatcaagatatgacagctccattgtcacattactttatatacacaggacacaattcgtatcttacggggaatcaactaagcagcgattgtagcgaagtccctgtgatcaaagccttgcaacgaggcgttcgagtcatcgagctcgatctttggcctaactctactgggacagatatcaatgtccttcacggaagaacgcttacaacgcctgtaccgctgatgaaatgcttgaaatcgataagagattacgcgttttctagttcgccttatccggttatcatcactttagaggatcatcttacacctgatcttcaagccaaagttgctgagatggctacacagatatttgggcagatgttgtattaccctgaatcagatagcttactggaatttccttctcctgcttcactgcttcatcggataatcatctccaccaaaccgcctaaagaatatctcgaatcgaggaacccgattgttaaacaaaaggataataatgtatctccatcttcagaggatgaaacacctagaacagaggagattcagaccctagaaagtatgttgtttgaccaagattttgaaagcaagagtgatagtgatcaagaggatgaagaggctagtgaagatcagaaacctgcatacaaacggttgatcacgattcatgctgggaaaccaaagggaacggtgaaagaagagatgaaagttgtggttgataaagtgagacgtttgagtttaagcgagcaggaacttgacaggacttgttcatctaatagtcaggatgttgtaaggtttacgcagcggaatttgcttcggatataccctaaagggacaagatttaactcctcaaactacaaacctcttatcggttggactcacggagcgcaaatgattgctttcaacatgcagggatatgggaaatctctgtggttgatgcacggtatgtttagagccaatggaggttgtggatatgtcaaaaaacctaacttcttgatgaagaaagggtttcacgatgaagtctttgaccctaggaagaaactccctgttaaagaaacgttaaaggtgaaagtgtatatgggagatggatggcgtatggacttcagtcatactcactttgatgcatattctcctcctgatttctacactaagatgttcatagtgggtgtaccagcggataacgcgaaaaagaagacaaaaataatcgaagacaattggtatccaatttgggatgaggaattcagcttcccattaaccgttccagagcttgcattgcttaggatcgaagtaagagagtatgatatgtcggagaaggatgattttggtggacaaacatgcttgcctgttgcagagttaagaccagggattcgatctgtgcctttgtatgacaaaaagggtgagaaaatgaaatcagtacggcttcttatgcgtttcatcttcgaatgatttggcttaacagaaatgtgtgtctctgagaaagaatttgcaccatttcaaaaagcttttgaggtattgtataatgtagcttgaaagatcaaaatgatctttgctctgatatctccagaaagtgaatttacctaaccatattgaagaaaatgtaatttatagagtctatattttttttcaatatgtaaaatctattgtaagatgattatccatgcttgcaattt

SEQ ID NO: 9852 - protein, 544 aa, Arabidopsis thaliana
MGAEQLCSFLDDHGESTTVAEAQRLIDEVIRRRHHVTRFTRHGLDLDDFFNFLFYDDLNPPITPHVHQDMTAPLSHYFIYTGHNSYLTGNQLSSDCSEVPVIKALQRGVRVIELDLWPNSTGTDINVLHGRTLTTPVPLMKCLKSIRDYAFSSSPYPVIITLEDHLTPDLQAKVAEMATQIFGQMLYYPESDSLLEFPSPASLLHRIIISTKPPKEYLESRNPIVKQKDNNVSPSSEDETPRTEEIQTLESMLFDQDFESKSDSDQEDEEASEDQKPAYKRLITIHAGKPKGTVKEEMKVVVDKVRRLSLSEQELDRTCSSNSQDVVRFTQRNLLRIYPKGTRFNSSNYKPLIGWTHGAQMIAFNMQGYGKSLWLMHGMFRANGGCGYVKKPNFLMKKGFHDEVFDPRKKLPVKETLKVKVYMGDGWRMDFSHTHFDAYSPPDFYTKMFIVGVPADNAKKKTKIIEDNWYPIWDEEFSFPLTVPELALLRIEVREYDMSEKDDFGGQTCLPVAELRPGIRSVPLYDKKGEKMKSVRLLMRFIFE

SEQ ID NO: 9853 - DNA, 4074 bp, Plasmodium falciparum
  CDS (1)..(4074)
atgaaccttagtgcgaaaatcgattcaaatggatataataataatatagtagaaaaaaatgatgataaaagaataggtagaattatgagcgatgatgaaaatgaaagaaaggatataatatataataatgagaagaataagagaacgtctgaaataaaagttcttaaaaatgatatggataataataaaaacgacaacagtattcaatctaagttatcttttgatataaagaatgtattaacacatgcatatttaccaatatgcttagaaaaaatgaaggagggagaatatgtttataaatggaataataatatatttcaaaagaaaaccttaaaatttttttatttagatgttaataattattgtataagatggaattcaaaaaagaaaaaattaagtgaaaaaaagaacccatccttatatatatgtgatataataaaaatcttagatggttcagaatctttatttttcaaaaagaaagaagatgataagaatttatctattgaaattataagtacacaaagaaatttaagattaacctttttagatatacaaagatggaaaatgtggttatttggtcttatgtattatcaatataaattagttaataaaggaaatgggaaaaaaaaaatgaaatcctttttatatgaaagtaataaattatatgataattatatcatatcaggattaaaagatattaatgcattaacattatctcaattatacattatattgagaagtcttaatatatatttgaatatgcaaatattatatcattatttttctatttataaaaataaagctgttataaattatataggttttacgaaaatattagaacatattttctcaaatacacatatttcgatatattttaatgaatataaagataaaaaatttaattatatagataaaaaaaaatttattgaattcttaatcgatatacaatgtgaaggcaagtgtgaagaatttatatttaataattattatcaaaatgataccaacccaaacttaacgcgtgagaaaaatacagaaaaattagaaagagaaaagaaaaatgatgaagatgatacacattataacttagatatgatgcaatcatctgcacataataataaaatttataatgtaaataatcaaatggacgacatttccataaaatacaaaaatgaagatgatgtaaaacctaaacatatatttaataatgacaataaagaaaattgtaataaggaagaaaataattatagtaaaagtgaaaataatacatatttcaataatgataataataataataataaagtaagaaatgaagccattattaataattatgattgtaatattattaaaaaaataagtaaccaatatataaatcaggatgatataaaatataatatggatatatccaatacattaatattctctgataattctataatacatgatgaagattattttttaatattggatatattaaaaagtaagtacttctatcatgatcaaaataaagtaggtaataaaaaaaacacacatgataataattataataattataataataatagtgctaatgcatcatgtcaccataatttaaaagatgaaaaagaatctaaattaaacagtaataataataataacaataataataataataatgtagatacttgtatcaatgttattaataaaaatataccaaatatatatcccataaaagttaatgttatatataaattattaaatattattaaaaaatataatatcccatttgttataaataatgatgataatcaatatttaactgaaattggtttagtttatttcttattatcaaaagaaaatagtattatgtgcccagagtatgcaaaggtatatcaaaatatgaatttacccttatgtaattactggattaatagtagtcataatagttatttagctagaaaacaaatatttagtacaagtaatatagaacaatatatatatatattattagatggttgtaggtgtgtagaatttgattgttattattttaataaaaatatagtagtgtatcatggattttatggatataaattaacttcttctatattattttgtgatactttaatagcatgtaaaatgtttggttttaccacatctccatatccaataatattatcattagaaattcattgtaaaaataaacataaaaatctaattgctaaaatattaatatccatattgggtaaccaattatatatacctaaaacaacagacgaaattaataatataactccaaataattgtaaaaataaatttttagttaaatataaacattttgagaataatgatagttcaggattttattatctttttgaaggactacaaagtgttatgtatgatgaactaaattatatgtctgatattcttgatgaaaatgatgaattggattatgataatgaggatatggatgttttgcaacaaaattgtcaaggcgagttattacataatgatgatgtcgatgttgaaaattttgatgcagatgaggatgaatatgaaatggagaaaacttttggagagtacatagaaaaaagtatagaaaaaaaatataaccaagatagtattaatcataaacaattatacatgaaaaatagcgacagtaataataatgtatctatagaaaaagaaaactatgaagaaaaacacaataaatttgtggaagatacgaaaaaacctagaaatattttaaatataataaaaaaaaatgataataatatggataatgattcatctgataataataataataataatgtgaagatacctaaaaattctattacatcatgtattgagaaaaaagataaaagtaaagatttagaggaacagaaaaaaaaacatattttgaaaaaaacagataattttaatttaaaaaataacaatctgctaaatgaatattcctgcttaaaaggatatgtatttcgaaatttttatgaaaccagaaattataatgaaatatgttccattagtgaaaataaatttattaaattaattaaaaaaaacgaaaacgaaattattaaatataatcaaaaaaccctaacaagggtttatccatcaggaacacgactagcatctaccaatttcaatcctttaatattttggaatgcaggtatacaagttgtagcattaaattatcaatataatggattaagtatgttgttaaataaaggaaggtttttagaaaatggtggaaaacactcaggctatattttaaaacctgaattattaagatttaatgaaaaacaagattataataccttattattagatttacaaatattgtcattacatcaaataaatttactattttcaataaaaaataaatatcatgaaaaaaaactaaaaaagaaattatttcaaatggatatgattcaaagaattcaaacacataaaaaaataaaaaagaaaatcaaaaactggaaagatctacaaaaattagaaaaagagaagaaaaatatacttttttcagatgttcagtcagatgataataaaaataaacatattagttatgaattacttcttaacaaaattaatgataatgatgatgttaattatatacataataaatgtttaaatgtagaaaagaaatatgaagacatgttaacagaatataaatcgttcttattatgttcttcatccttatcacatagtagtagcttcaatagttgtagtagtaacacaactacatcaaatgatggaaataaaacacattccaataaaaataattcatccaaatataaaaacaaaaatttttatcaaacatttgaagaattaaaaaaagcaaataatttatttttttatctctatcttactatatccattcatggatataatgagaacaaatattactttaaaactgaaattgcaaaagttaatttttatgacattaattattgttggtcaaaaccatccactttccaaatgaaaatatcttatccttccttggctcttatagtatttgaattaaaggcatatgatactgtaaaaagtgaaataatagcttgcgcctgctttccaattacgatttgtaccattgtgcgataa

SEQ ID NO: 9854 - protein, 1357 aa, Plasmodium falciparum
MNLSAKIDSNGYNNNIVEKNDDKRIGRIMSDDENERKDIIYNNEKNKRTSEIKVLKNDMDNNKNDNSIQSKLSFDIKNVLTHAYLPICLEKMKEGEYVYKWNNNIFQKKTLKFFYLDVNNYCIRWNSKKKKLSEKKNPSLYICDIIKILDGSESLFFKKKEDDKNLSIEIISTQRNLRLTFLDIQRWKMWLFGLMYYQYKLVNKGNGKKKMKSFLYESNKLYDNYIISGLKDINALTLSQLYIILRSLNIYLNMQILYHYFSIYKNKAVINYIGFTKILEHIFSNTHISIYFNEYKDKKFNYIDKKKFIEFLIDIQCEGKCEEFIFNNYYQNDTNPNLTREKNTEKLEREKKNDEDDTHYNLDMMQSSAHNNKIYNVNNQMDDISIKYKNEDDVKPKHIFNNDNKENCNKEENNYSKSENNTYFNNDNNNNNKVRNEAIINNYDCNIIKKISNQYINQDDIKYNMDISNTLIFSDNSIIHDEDYFLILDILKSKYFYHDQNKVGNKKNTHDNNYNNYNNNSANASCHHNLKDEKESKLNSNNNNNNNNNNNVDTCINVINKNIPNIYPIKVNVIYKLLNIIKKYNIPFVINNDDNQYLTEIGLVYFLLSKENSIMCPEYAKVYQNMNLPLCNYWINSSHNSYLARKQIFSTSNIEQYIYILLDGCRCVEFDCYYFNKNIVVYHGFYGYKLTSSILFCDTLIACKMFGFTTSPYPIILSLEIHCKNKHKNLIAKILISILGNQLYIPKTTDEINNITPNNCKNKFLVKYKHFENNDSSGFYYLFEGLQSVMYDELNYMSDILDENDELDYDNEDMDVLQQNCQGELLHNDDVDVENFDADEDEYEMEKTFGEYIEKSIEKKYNQDSINHKQLYMKNSDSNNNVSIEKENYEEKHNKFVEDTKKPRNILNIIKKNDNNMDNDSSDNNNNNNVKIPKNSITSCIEKKDKSKDLEEQKKKHILKKTDNFNLKNNNLLNEYSCLKGYVFRNFYETRNYNEICSISENKFIKLIKKNENEIIKYNQKTLTRVYPSGTRLASTNFNPLIFWNAGIQVVALNYQYNGLSMLLNKGRFLENGGKHSGYILKPELLRFNEKQDYNTLLLDLQILSLHQINLLFSIKNKYHEKKLKKKLFQMDMIQRIQTHKKIKKKIKNWKDLQKLEKEKKNILFSDVQSDDNKNKHISYELLLNKINDNDDVNYIHNKCLNVEKKYEDMLTEYKSFLLCSSSLSHSSSFNSCSSNTTTSNDGNKTHSNKNNSSKYKNKNFYQTFEELKKANNLFFYLYLTISIHGYNENKYYFKTEIAKVNFYDINYCWSKPSTFQMKISYPSLALIVFELKAYDTVKSEIIACACFPITICTIVR

SEQ ID NO: 9855 - DNA, 2966 bp, Mus musculus
  CDS (73)..(2430)
gccgcgggctgtgttcccgttgcccggttctcacgcacagatcccgggcctggccctgggcccttcgagaccatgctgtgcggtggctggaaaaggagtcgccgctcgccggaggaatcccgggtgtccgcccaggtcgcagcgcccctcgcgttcccgccctcgcccgcgtcgtcggacagcagcaccaaaaggcctgggctacgggcactgaagaagatgggcctgacggaggatgaggatgtccaagccatgctgcggggctcccgactcctcaagatccgctcacgcacgtggcacaaggagcggctgtaccggctgcaggaggacggcctgagcgtgtggtttcagcggcgcatccctcgcgcagcttctaagcacatattcttcgtgcagcacatcgaggctgtccgggagggtcatcagtcggagggcctgcggcgcttcgggggcgccttcgcgccagcgtgctgcctcaccatcgccttcaagggccgccgcaagaacctggacctggcagcgcccactgcggaggaggcacagcgctgggtgcgaggactggccaagctgcgggcgcgcctggatgccatgagccagcgggagcgcctagaccattggatccattcctatctgcaccgggccgactccgaccaagacagtaagatgagcttcaaggagatcaagagcctgctgaggatggtgaacgtggacatgaacgacatgtacgcttaccgcctcttcaaggagtgtgaccattccaacaacgagcgtctagagggggccgagatagaggcgttcctgcggaggctgctaaagcggcctgagctggaggagatcttccgccggtactccggtgaggaccgggtgctgagtgcctctgagctgctggagttcctggaagaccagggcgaggatggtgccaccctggcctgtgcccagcagcttatccagacttatgagctcaatgagacagccaagcagcacgaactgatgacgctggatggcttcatgatgtatctgttgtcgcctgagggggccgccctgaacgtggcccacacgtgtgtgttccaggacatgggtcagcccctcgcccactactttatctcgtcctctcacaatacctacctgacggactctcagatcggagggaccagcagcacagaggcttatattagggcctttgcccagggatgccgctgtgtggaacttgactgctgggaggggccgggaggggaacctgtcatctaccatggccacacgctcacctccaagatcctctttcgagatgtgatccaggctgtgcgtgaccacgctttcacgtcgtccccatatcctgtaatcctatccctcgagaaccactgcgggctggaacagcaggctgtcatggctcgccaccttcgaagcatcctgggagacatgctggtgacacaggccctggactcccagaaccccgaggagctgccatctcctgagcagctcaagggccggatcttggtgaaggggaagaagctgccagctgctcggagtgaggatggtcgaattctgtcagacagggaggaggaagaggaggaggaagaggaggcggaagaggccttggaagctgcagagcagaggagtcgagccaagcagatctccccagagctctcagcgctggctgtgtattgctgtgctacccgcctgcggaccctggaacccagtcctggcccgcctcagtcttgcacggttggctccctcagcgagcgcaaggccaggaagttcaccagggaggcagggaccagctttgtcaggcacaacactcagcaactgacccgagtgtacccactggggctgcggatgaactcagccaactataacccccaggagatgtggaactccggctgtcagctggtggctctgaactttcagactcctggttatgagatggacctcaacacagggcgcttcctcataaacgggcaatgtggctacgtcctcaaacctgcttacctcaggcaactcaacaccacctttgaccctgagtgccctggaccccccagaactactctggcaatccaggtgttaacggcccagcagctacccaagctgaacgcagagaagcccagctccattgtggatcctctggtgcgcgtggagatccacggggtgcccgaagactgtgcccagaaggagacagactacgtcctcaacaatggcttcaacccctgctgggagcagactctgcagttccgactgcgggccccagagctggtgctggtcaggtttgtggtagaagattatgacaccacctctcccaatgattttgtgggccagtctacactgcctctcagcagcctgaagcaagggtaccgccacatccacctgctgtccaaggatggagcctcgctcgctccagccacgctcttcgtgcacatccgcattcagaactcttgagggcgtcactgacttaaccctaacatcagcagggctggcgtcgtggcacggagccctctctggagcacaagaccatgggagtcccagcccctcacaccaggtccctgtctgggtcaccaggtgctgtgcacacctgggtgctaggagctgtttggttgctcagtgagagagaggaccatgattggtgtcctgaccagtggatttcaggggcctccaaccttggggctctgaggtggtctcagattccctggtcaacttgaggagcaggacacgtgtccttctgccctccagcggggccatcgtaaccttcatccctgagaagggcacagccaccttcactgcctcctttcagggtgagcagaaccccagagcctccttccccttagaagggacttttctggcttctccttccctttctgtctcaggcaggtggggagcagctgagccctgggagaaacctggcagtaggtttgtaacttgtgttatagaagagcccaagagggcagaagagtaactatttaaaaaaaaaaaaaaaa

SEQ ID NO: 9856 - protein, 785 aa, Mus musculus
MLCGGWKRSRRSPEESRVSAQVAAPLAFPPSPASSDSSTKRPGLRALKKMGLTEDEDVQAMLRGSRLLKIRSRTWHKERLYRLQEDGLSVWFQRRIPRAASKHIFFVQHIEAVREGHQSEGLRRFGGAFAPACCLTIAFKGRRKNLDLAAPTAEEAQRWVRGLAKLRARLDAMSQRERLDHWIHSYLHRADSDQDSKMSFKEIKSLLRMVNVDMNDMYAYRLFKECDHSNNERLEGAEIEAFLRRLLKRPELEEIFRRYSGEDRVLSASELLEFLEDQGEDGATLACAQQLIQTYELNETAKQHELMTLDGFMMYLLSPEGAALNVAHTCVFQDMGQPLAHYFISSSHNTYLTDSQIGGTSSTEAYIRAFAQGCRCVELDCWEGPGGEPVIYHGHTLTSKILFRDVIQAVRDHAFTSSPYPVILSLENHCGLEQQAVMARHLRSILGDMLVTQALDSQNPEELPSPEQLKGRILVKGKKLPAARSEDGRILSDREEEEEEEEEAEEALEAAEQRSRAKQISPELSALAVYCCATRLRTLEPSPGPPQSCTVGSLSERKARKFTREAGTSFVRHNTQQLTRVYPLGLRMNSANYNPQEMWNSGCQLVALNFQTPGYEMDLNTGRFLINGQCGYVLKPAYLRQLNTTFDPECPGPPRTTLAIQVLTAQQLPKLNAEKPSSIVDPLVRVEIHGVPEDCAQKETDYVLNNGFNPCWEQTLQFRLRAPELVLVRFVVEDYDTTSPNDFVGQSTLPLSSLKQGYRHIHLLSKDGASLAPATLFVHIRIQNS

SEQ ID NO: 9857 - DNA, 3715 bp, Mus musculus
  CDS (124)..(3510)
ccacgcgtccgcggacgcgtgggcggacgcgtgggcggacgcgtgggtcgcgcgcagcggcccgaggcggcggcggcggggacgcggggacgcggctttgtgcaggcgggtcgtggggcgcccatggcggagtgtggccggggcgccgcaggaggggccctgcccacctccccgagcccggccctaggcgccaagggcgccctgaaagccggagccggggaaggcggaggtggtggcgggggaggtcgcctcggccacgggcgggcgcgctatgacagcggcggggtttccaacggagactgcagcctcggcgtgtccggggacgaagcccggaccagccctggcaggggacctctaggcgtggcgctcgcgcggacccctagcccagctgccggtccggtccccagggacagcaaaccgggcggcctgccccgccggagcagcatcatcaaggatggcacgaagcagaaaagggagcggaagaagacggtgtcattcagcagcatgccgacagagaagaagatcagcagcgcaagtgactgtatcaactcaatggttgagggctctgaactcaaaaaggttcgttctaactccagaatttaccatcggtattttctgctggacgccgacatgcaaagcctgaggtgggagccatctaagaaggattctgagaaagccaagattgatatcaaatctatcaaggaagtgagaacaggaaagaacacagatatattccgcagcaatggcatttctgagcagatctctgaagattgtgcattttcagtcatatatggagaaaattatgagtcacttgatttggttgccaattctgcagatgttgcaaacatctgggtgacaggactccgctacctgatttcttatgggaaacatacacttgatatgctagaaagtagccaagacaacatgaggacttcttgggtttcacaaatgtttagtgaaattgatgtagatggtcttggacatataactctgtgtcatgctgtccagtgtatcagaaacctcaatcctggtctaaaaacaagcaaaattgagcttaaattcaaagaattgcataaatcaaaggacaaagctggtactgaaatcacaaaggaggaatttattgaggtctttcatgaactttgtactagacctgaaatttacttccttttagttcagttttcaagcaataaagaattccttgataccaaggaccttatgatgtttcttgaggcagaacagggtgtagcacatatcaatgaggaaataagcctggaaattattcacaaatatgagccatccaaagaaggccaggaaaagggctggctctccatagatggattcactaactacctgatgtcacctgattgttacatctttgatccggaacataagaaggtctgtcaggatatgaagcaacctctgtctcattactttataaactcatctcataatacatacttaatagaggatcagttccggggtccctctgacatcacgggatatatccgcgctctgaaaatgggttgcaggagcgttgaattagatgtgtgggatgggccagataatgagcctgtgatttacacaggccacaccatgacctctcagatagtcttccgcagtgtcatcgacatcattaacaagtacgcgttctttgcttctgagtatcctctcatcttatgtttagaaaaccactgctctattaaacaacagaaggtgatggttcaacacatgaagaaaattttaggagacaagctgtatacgacatcacccaacatggaggaatcttatctaccatccccagatgtcctgaaagggaaaatactaatcaaagcaaagaagctgtcttcaaattgctccggcgtggaaggggatgttactgatgaggatgaaggagcagaaatgtctcagaggatggggaaagagaatgtggaacaacccaaccatgtgcctgtgaagcggtttcagctttgcaaagaactgtccgagctggtcagcatctgtaaatccgtccagttcaaggagtttcaggtgtcatttcaggtgcagaagtactgggaagtgtgctcctttaatgaagtacttgcgagtaaatacgccaatgagaaccccggggactttgtgaattacaataagcgtttcctcgccagggtcttccctagtccaatgagaattgactcaagcaacatgaaccctcaggatttttggaaatgtggctgtcagattgtagccatgaacttccagactccagggctgatgatggacctaaacgttggctggtttaggcagaatggaaactgtggctatgttcttcgaccagccatcatgagggaagaagtctccttcttcagtgccaacaccaaggactctgtccctggagtttcacctcagttgcttcacatcaaaatcatcagcggccagaactttcccaaacccaaagggtcgggtgccaaaggtgacgtggtggacccttatgtctatgtggaaatccacggaattcctgccgactgcgcggagcaaaggacaaaaacggtgaaccagaatggagatgctcctatttttgacgagagctttgagtttcagattaacctccctgaactagccatggtgcgctttgtcgtgctggacgacgactacatcggcgatgagttcatcggccagtacaccattcccttcgagtgtttacagacgggctaccgccatgtgcctctgcagtccctgactggagaggtcctcgcccacgcttctctgttcgtccacgtggctattactaacaggagagggggagggaagcctcacaaacggggcctttccgtgaggaaaggaaaaaagtcccgggaatacgcctctctgagaacactgtggattaaaactgtagacgaggtgttcaagaacgcccagccccccatacgggatgccacggacctgagagagaacatgcagaatgcagtggtgtcgttcaaagagttgtgtggcctctcctccgtggccaacctcatgcagtgcatgcttgccgtgtctcctcgattcctggggcctgacaataaccccctggtggtcttgaaccttagtgagccctaccccaccatggaactgcaagccatcgtgcctgaggtgctgaagaagattgtaacaacttatgacatgatgatgcagtccctcaaggcactgattgaaaatgcagacgctgtgtatgaaaagatcgtgcactgtcagaaggcagccatggaatttcatgaacacttgcacagcataggcaccaaggaggggctgaaggaacggaaactacagaaggcagtggagagctttacctggaatattacaatcttaaaggggcaagcggatcttctgaaatatgctaagaatgagaccctggagaacctgaagcagatccactttgcagctgtttcctgtggactgaacaaaccaggcactgaaaactccgaggcccagaagccacgccggagcctagaagccatccctgagaaagccagtgatgaaaatggagactaagggtcctcccagtcactgtggacttcccaccgagaaccagtcagcaggcgcactggctcactgatcaggatgagagctgggatgtctgtcggagcacaactggaatacccaactgcagcccatcactgctgtgaatgtatgtagcaacccacgtgtgaaggcaaataaactctttaacaagaaactctaaaaaaaaaaaaaaaaa

SEQ ID NO: 9858 - protein, 1128 aa, Mus musculus
MAECGRGAAGGALPTSPSPALGAKGALKAGAGEGGGGGGGGRLGHGRARYDSGGVSNGDCSLGVSGDEARTSPGRGPLGVALARTPSPAAGPVPRDSKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISEQISEDCAFSVIYGENYESLDLVANSADVANIWVTGLRYLISYGKHTLDMLESSQDNMRTSWVSQMFSEIDVDGLGHITLCHAVQCIRNLNPGLKTSKIELKFKELHKSKDKAGTEITKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKILGDKLYTTSPNMEESYLPSPDVLKGKILIKAKKLSSNCSGVEGDVTDEDEGAEMSQRMGKENVEQPNHVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNVGWFRQNGNCGYVLRPAIMREEVSFFSANTKDSVPGVSPQLLHIKIISGQNFPKPKGSGAKGDVVDPYVYVEIHGIPADCAEQRTKTVNQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNNPLVVLNLSEPYPTMELQAIVPEVLKKIVTTYDMMMQSLKALIENADAVYEKIVHCQKAAMEFHEHLHSIGTKEGLKERKLQKAVESFTWNITILKGQADLLKYAKNETLENLKQIHFAAVSCGLNKPGTENSEAQKPRRSLEAIPEKASDENGD

SEQ ID NO: 9859 - DNA, 2187 bp, Mus musculus
  CDS (195)..(2138)
cccccccggcaagccatgccaactgtgaaggttttaagaacttagcttctggacaagttttcttcgaaagtgaaaagcagtagcagcgagaacagctgatgacggtcacaaaaagacagtgttacttctaagacaagtgacaccttagacgaagagccctctatgggaggacaagcggcccagatcatgaaatcatggaaagccaacttcatgagctcgcagaagcaagatggtttttgtcaaaggttcaggatgattttagaggtggaaaaatcaacgttgaaattactcacaaactgcttgagaaacttgatttcccatgccactttgctcatgtgaaacatatttttaaggaaaatgacagacagaaccaaggaagaatcaccattgaagagtttagagccatttaccggtgtattgtacatagagaagaaatcacggagattttcaacacgtatactgaaaataggaaaattctttctgagaacagtctgattgagtttctaacccaagagcagtatgaaatggagatcgatcactctgattcagtagagatcatcaataagtatgagcctattgaagaagtaaagggtgagcgacagatgtcaattgaaggtttcgcaagatacatgttttcatcagaatgtctactgtttaaagagaactgtaaaaccgtgtaccaagatatgaatcatccattaagtgattattttatttcatcatctcacaacacatatttgatatccgatcaaatattgggaccgagtgacatttggggatatgtaagtgctcttgtgaaaggctgccgctgtctggaaattgactgctgggatggatcccaaaatgagcccattgtgtaccatggttacacattcaccagcaagcttctcttcaaaactgtggtccaagcaataaacaagtatgcctttgtgacatctgattacccagtagtgctgtccttagaaaatcactgctcccctggtcagcaggaagtgatggctagcattctgcagagcacctttggagacttcctgctttcggacatgcttgaggagtttccagatacactaccgtctccagaggcactaaaattcaaaatattagtgaaaaacaggaaagtgggaaccttatctgaaacccacgagaggataggaaccgacaaaagtggccaagtgctagaatggaaagaagtcatctatgaagatggtgatgaagactcaggaatggatccagaaacatgggatgtcttcctatcacggatcaaggaggagagggaagcagatccctcgacattgagtggaatagcaggcgtcaagaaaaggaagaggaagatgaaaatagccatggccttatctgatcttgtcatttatactaaggctgagaagttccgaaacttccaatattcaagagtctatcagcaatttaatgagaccaattcgattggagagtctcgagctcgaaaactttccaaattgagagtccatgagtttattttccacaccgcggcattcatcaccagagtataccccaaaatgatgagagcagactcttctaactttaaccctcaagagttttggaatgtaggatgtcagatggtggccttgaactttcaaacccctggactgcctatggatttgcaaaacgggaaatttttggataatggaggctctggatatattttgaagccagacatccttagagatacaaccctgggctttaacccaaatgaaccagaatatgacgaccatccagttaccctcacaatccgaatcatcagtgggatccagttgcctgttagctcatcctctaacacgcctgacatagtagtgatcatagaagtctacggtgttccaaacgaccacgtgaagcagcagactcgtgttgttaagaataatgcttttagtccaaagtggaatgaaacatttacatttcttattcaagtgccagaactggcattgatacgttttgttgttgaaactcaacaaggcttattatcaggaaatgaattactcgggcagtacactttaccagttctttgcatgaacaaaggttatcgtcgtgttcctctgttttccaaatccggtgcgaaccttgaaccttcctcactgtttatttatgtttggtacttcagagagtgacgcatgtaactgacgcgttagctacacatcacagtaaacagtccaaagg

SEQ ID NO: 9860 - protein, 647 aa, Mus musculus
MESQLHELAEARWFLSKVQDDFRGGKINVEITHKLLEKLDFPCHFAHVKHIFKENDRQNQGRITIEEFRAIYRCIVHREEITEIFNTYTENRKILSENSLIEFLTQEQYEMEIDHSDSVEIINKYEPIEEVKGERQMSIEGFARYMFSSECLLFKENCKTVYQDMNHPLSDYFISSSHNTYLISDQILGPSDIWGYVSALVKGCRCLEIDCWDGSQNEPIVYHGYTFTSKLLFKTVVQAINKYAFVTSDYPVVLSLENHCSPGQQEVMASILQSTFGDFLLSDMLEEFPDTLPSPEALKFKILVKNRKVGTLSETHERIGTDKSGQVLEWKEVIYEDGDEDSGMDPETWDVFLSRIKEEREADPSTLSGIAGVKKRKRKMKIAMALSDLVIYTKAEKFRNFQYSRVYQQFNETNSIGESRARKLSKLRVHEFIFHTAAFITRVYPKMMRADSSNFNPQEFWNVGCQMVALNFQTPGLPMDLQNGKFLDNGGSGYILKPDILRDTTLGFNPNEPEYDDHPVTLTIRIISGIQLPVSSSSNTPDIVVIIEVYGVPNDHVKQQTRVVKNNAFSPKWNETFTFLIQVPELALIRFVVETQQGLLSGNELLGQYTLPVLCMNKGYRRVPLFSKSGANLEPSSLFIYVWYFRE

SEQ ID NO: 9861 - DNA, 1785 bp, Pisum sativum
  CDS (1)..(1785)
atggcttccaaacagaaacaaacttacagcgtttgtttttgctgccggcgccgatttaagctcggcatatcggaagcaccgtcgcagataagagaactttatcacaattactccgatgagagcgccatcatgactgcatctcacctacaaaggttcctcattgaggtgcagggagatgagaacatcacagagaatgaagcacaatccatcatcgacggtcataaacatttgagtatctttcatcgaagaggtctcaatctcgaaagtttcttcaagtttctcttcagtgataacaagcctcccctcttagcttctcgcggggtgcatcaagttatgagtttaccgttgtctcattattacatacacactggtcataattcctatcttactggaaatcagcttagtagtgactgcagtgatgcccctatcatcgttgcacttcagggaggggtgagggttattgaattggatatatggcctaatggatccaaggatgatattgaagttcttcatggaaggacattgactactcctgtggcgcttatcaaatgtttgaggtctattaaggagtatgcgttcgttgcgtcggaatatccggttgtaataacgttagaagaccaccttactcctgatcttcaagccaaagtggcccagatggttactcaaacatttggagacatactattttgtcctagctcggaaagcttgaaggaatttccttcccccgactcactcaaaaggaggattatcatatcaacaaaaccacctaaagagtaccttgaggcaaaagaggtacaggaaaaggaggaattgacgaagggaaagtcttcaggtgatgaagaagcttggggcaaagaagtccctagtttgagaggcggtaccatatctgattacaagaacaatgacgacgacgatgaagatgatcttaatgaggaggaagattctgaagaagcagaaaagtcacgccaaaatggatccggtgaatatagacgtttaattgcaattcatgctgggaaacctaaaggtggattagtggaaggtctcaaagtggatcccgataaagtgagacgtctaagtttaagtgagtcacagctcgaaaaggcggctgaaacatatggaaaagaaattgtcaggtttactcagaggaatatactgagagtgtatccgaaaggtactcgcattacctcgtcaaattataatccattaattgggtggatgcacggagctcagatggttgcgtttaacatgcaggggtatggaagatctctttggttgatgcaaggaatgttcaaagccaatggaggctgtggttttgttaaaaaaccagattttctattaaaaactggtcccaataatgaggtttttgatcctaaagcttctttgccattgaaaactactttgaaggtgactgtatatatgggggaaggatggtattatgattttgaccatacacactttgatcaattctcacctccagacttctatgcaagggtggggattgctggagtcccttttgatactattatgaaaaaaactaaaacagtagaggatagttggttgccttcttggaatgaggtattcgagttcccactttcggttccggagttggcgctgcttcggatagaagttcatgagtatgacatgtctgagaaggatgactttggtgggcaaacatgcttacctgtgtgggaactaagaactggaattcgagcagttccgttacattcccgcaaaggaggtaaatacaacaatgtaaagcttctcatgcgctttgagttcatctga

SEQ ID NO: 9862 - protein, 594 aa, Pisum sativum
MASKQKQTYSVCFCCRRRFKLGISEAPSQIRELYHNYSDESAIMTASHLQRFLIEVQGDENITENEAQSIIDGHKHLSIFHRRGLNLESFFKFLFSDNKPPLLASRGVHQVMSLPLSHYYIHTGHNSYLTGNQLSSDCSDAPIIVALQGGVRVIELDIWPNGSKDDIEVLHGRTLTTPVALIKCLRSIKEYAFVASEYPVVITLEDHLTPDLQAKVAQMVTQTFGDILFCPSSESLKEFPSPDSLKRRIIISTKPPKEYLEAKEVQEKEELTKGKSSGDEEAWGKEVPSLRGGTISDYKNNDDDDEDDLNEEEDSEEAEKSRQNGSGEYRRLIAIHAGKPKGGLVEGLKVDPDKVRRLSLSESQLEKAAETYGKEIVRFTQRNILRVYPKGTRITSSNYNPLIGWMHGAQMVAFNMQGYGRSLWLMQGMFKANGGCGFVKKPDFLLKTGPNNEVFDPKASLPLKTTLKVTVYMGEGWYYDFDHTHFDQFSPPDFYARVGIAGVPFDTIMKKTKTVEDSWLPSWNEVFEFPLSVPELALLRIEVHEYDMSEKDDFGGQTCLPVWELRTGIRAVPLHSRKGGKYNNVKLLMRFEFI

SEQ ID NO: 9863 - DNA, 1667 bp, Homo sapiens
  CDS (26)..(1237)
gtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatggtcaaggtaatatggtcattattccagcatgagccaattagtttactatttctgtgggcatagactgcaccctagattgctatgtggtaaatgtgctcttgtgaccacaggtgaaccatagaaaacatagatatagtataattagaaattcatcagtgcttctggaaatcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 9864 - protein, 403 aa, Homo sapiens
MDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNGQGNMVIIPA

SEQ ID NO: 9865 - DNA, 3113 bp, Sus scrofa
  CDS (185)..(2503): n means a or g or c or t/u
cgtccgctggcagtgacagcagcaagctgcagcagaagaggggaggaagccagagagtgcaagaggagcaaaggagaaaagaagcctggctgggtttcctcgtgccacagtggaagtcatcgcagacacaggattgctgtcgcacccacggtgactctggcaccagctggtggagcagtgggtcatggcgtccctgctgcaaggcctctctgcttctcctggctcagggctgcccatcaatcaagacctgctgctgatgcagaaaggtatgctgatgcgcaaggtgaggtccaaaagctggaagaagctaagatactacagacttcaggacgatggcatgacagtctggcatgcccggcaggccggaggcagggccaagcccagcttctcaatctccgatgtggaaacggtgcgtgggggccatgagtctgagttgctgcgcaacctggcagaggagttccccctggagcagggcttcaccatcgtcttccatggccgccgctccaacctggacctggtggccaacagtgttgaggaggcccaggtctggatgcaagggctccagctattggtggactttgtcactaacatggaccaacaggagcggctggaccaatggctgagtgattggttccagcgtggagacaaaaaccaggatgggcggatgagtttcggagaagtccagcggttactgcacctgatgaatgtggaaatggaccaagaacatgccttccagcttttccagacagcagacacatcccagtctgggactctggagggagaagaatttgtagaattctataagtcattgactaagcgtgctgaggtgcaggaattgtttgaaaacttttcatctgatgggcagaagctaacactgctggaatttgtggatttcctccaagaggagcagaaagaaggagaacgtgcttctgatcttgctctggaactcatcgaccgccacgagccttcagatagtggcaaactgcggcacgtgctgagcctggacggcttcctcagctacctctgctcgaaggacggagacatcttcaatccgacctgcctccccatctaccaggatatgactcaacccctgaaccactacttcatcaactcctcccacaacacctacctagtgggggaccagctttgtggccagagcagcgtggagggttacatacgggccctgaaacgggggtgccgctgcgtggaggtggatatatgggatggacctaacggggaacctgttgtttatcacggacacaccctgacctctcgcatcccgttcaaagatgttgtggccgctatagcacagtatgccttccagacatcagactatccagtcatcttgtccctggagaaccactgcagctgggagcagcaggagatgatagcacaccacctgactgagatcctgggggagcagctcctgagcaccaccttggatgggcagcttcccactcagctgccctcccccgaggagcttcggaggaagatcttggtgaaggggaagaagttaagaacacttgaggaggatcttgaggaagaggaggaagagccagaagagtctgaactggagggggagcaggaggctgagctggagctggaggcccagtttgaatctgagccccaggagctgagccctcgcagtaaagacaaaaagaagaaagtcaaggccatcttgtgtccagccctctctgccctggttgtctacttgaaggcggtctcattctacagcttcgctcattcgagggagcactatcgcttctatgaaatatcatctttctctgaagccaaggccaagagcctcatcaaggagtccggcaatgagtttgtgcagcacaacacctggcagttaagccgtgtgtatcctggtggcctgaggacagattcatccaactacaacccgcaagaattctggaatgcaggctgccagatggtggccatgaatatgcagactgcggggcttgagatggacctctgtgatgggctctttcgccagaacgctggctgtggctacgtgctgaagccagacttcctgcgtgacgctcagagttccttccaccccgagaggcccatcagcccttccaaagcccagaccctcctaatccaggtaatcagtggtcagcaactccccaaagtggacgacagcaaagaggggtccattgtggatccactggtgagagtggagatctttggcgtccgcccagacacagcccggcaagagaccagctacgtggagaacaatggttttaatccctactgggggcagaccctctgcttccgggtcctggtacctgaactggccctgctgcgttttgtggtaaaagattatgactggaaatcccgaaacgacttcgtcggtcagtacaccctgccctggaactgcatgcagcaaggttaccgccacatacacctgctctccaaggatggcatcagcctccacccagcctccatcttcgtgcacatctgcatccgggaagggatagagggggttgaatcttaaggtgggcatttcacaggaagggtgggtgcgctggctttagataataagggaaacctggacgtgtgctccagaaagcaaacagagctggtgaaaatactcagagctgggctgagtatttcctaggcaattacttcagctttcctgacaaggacctatgtttcaccttctcttccctttccccaagcctctgtcatcactcctgtctcttccctctgcatcctctatactggagttcctggcttcctcttgctgtaggctcactgccatacccagatccaggactcctctttcccacccactctggctcaaaggcggagtgcagctagaaatccagagaggggcttggggcagaaagattcagagaggcactatctcctccactcccaattcctcaagtccagagccagaggaaggagaaagcgagcctcgaggctccccaggcaaaggctggggaagatctgacctcaagactgtacaatgacactcaagagaacagcgaatggtcctcagagtccccagtggactgcttctccccagccccaccggtataaatagaacttctctccaaaaaaaaaaaaaaaaaaaaaaaaaaanagaaaaaaaaaaaaaa

SEQ ID NO: 9866 - protein, 772 aa, Sus scrofa
MASLLQGLSASPGSGLPINQDLLLMQKGMLMRKVRSKSWKKLRYYRLQDDGMTVWHARQAGGRAKPSFSISDVETVRGGHESELLRNLAEEFPLEQGFTIVFHGRRSNLDLVANSVEEAQVWMQGLQLLVDFVTNMDQQERLDQWLSDWFQRGDKNQDGRMSFGEVQRLLHLMNVEMDQEHAFQLFQTADTSQSGTLEGEEFVEFYKSLTKRAEVQELFENFSSDGQKLTLLEFVDFLQEEQKEGERASDLALELIDRHEPSDSGKLRHVLSLDGFLSYLCSKDGDIFNPTCLPIYQDMTQPLNHYFINSSHNTYLVGDQLCGQSSVEGYIRALKRGCRCVEVDIWDGPNGEPVVYHGHTLTSRIPFKDVVAAIAQYAFQTSDYPVILSLENHCSWEQQEMIAHHLTEILGEQLLSTTLDGQLPTQLPSPEELRRKILVKGKKLRTLEEDLEEEEEEPEESELEGEQEAELELEAQFESEPQELSPRSKDKKKKVKAILCPALSALVVYLKAVSFYSFAHSREHYRFYEISSFSEAKAKSLIKESGNEFVQHNTWQLSRVYPGGLRTDSSNYNPQEFWNAGCQMVAMNMQTAGLEMDLCDGLFRQNAGCGYVLKPDFLRDAQSSFHPERPISPSKAQTLLIQVISGQQLPKVDDSKEGSIVDPLVRVEIFGVRPDTARQETSYVENNGFNPYWGQTLCFRVLVPELALLRFVVKDYDWKSRNDFVGQYTLPWNCMQQGYRHIHLLSKDGISLHPASIFVHICIREGIEGVES

SEQ ID NO: 9867 - DNA, 3445 bp, Homo sapiens
  CDS (89)..(2458)
ctcagagccggggccgggccagagcggcgccccgctgccctgtccccgcgtgcagaccccgggcccggccccggccccccgccaagccatgctgtgcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagctgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccacacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttcaaaaaaaaaaaaaaaaaaaaa

SEQ ID NO: 9868 - protein, 789 aa, Homo sapiens
MLCGRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 9869 - DNA, 1782 bp, Medicago truncatula
  CDS (1)..(1782)
atgtcttctaaaccgaaaaaacaaacatacagcgtatgtttctgctgccggcgccggtttaaactcggcgtatcagaggcaccgccggaaataaaagagctttaccatcgttactccgatgaaggcgggatcatgacagcatcccacctgagaagctttctgattgaggtgcagaaagaagagaagatcacagaagaagaaacacaagcaatcattgatggtcataaacatttgagtatctttcatcgtaaaggtcttaatcttgaaagtttcttcaagtttctcttcggtgatactaatcctcctcttttaccttccactggggtgcaccaagatatgagtttaccattgtcacattattacatattcactggtcataattcatatctaactggaaatcagcttagtagtgactgcagtgatgcccccatcatcaaagcacttcagagaggtgttagggtgattgaattggatatatggcctaatgactccaaggatgatgttgatgtccttcatggaatgacattgacgactcctgtggcacttatcaaatgtttgatgtctattaaggagtatgccttcgttgcgtctgaatatccggttgtaataaccttagaagaccatcttactcctgatcttcaggccaaagtggctcagatggttactcaaacatttggagacatactgttttgtcctacctcagaaaccttgaaggaatttccttcacctgattcacttaaaaaaaggattatcatatcaaccaagccacctaaggagtaccttgaagctaaagaagaaaaggaaaaggaggaatcacagaagggaaagcctttaggtgatgaagaagcttggggcaaagaagtcccaagtttaagaggcggtactatagctgattacaagcaaaacagtggtatcgatgaagatgatcttaaggaggaggaagattccgatgaagcgtcacggcaaaatacatcagatgactacagacgcttaattgctatacatgctgggaagcctaaaggtggaatagtggaatgtctcaaagtggagcctgataaagtgagacgtctaagtttaagtgagtcacagcttgaaaaggctgctgaaacatacggaaaagaaattgtcaggttcactcagcagaatatattgcgagtgtatccgaaaggtacacgcattacctcatcaaattataatccattaattgggtggatgcatggagctcagatggttgcatttaacatgcagggttatgggagatctctttggttgatgcaaggaatgtttaaagccaatggaggatgcggttttgttaaaaaaccagattttctattaaaaactggtcccaataatgagattttcgatcctaaagctaatttgccatcgaaaactactttgaaggtgactgtatacatgggagaaggatggtattatgatttcaagcatacacattttgatcagttctcacctccagacttctatgcaagggttggaatcgctggagtcccttttgacactgttatgaaaaaaacaaagtcaatagaggatagttggttgccttcttggaatgaggtatttgaattcccgctttccgttccggagctggcactgcttcgcatagaagttcatgagtatgacatgtctgagaaggatgattttggtggacaaacatgcttgcctgtgtgggaactaagaagcggaattcgagcaattccattacattcccgcaaaggagataaatacaacaatgtaaagcttctcatgcgctttgagttcatctga

SEQ ID NO: 9870 - protein, 593 aa, Medicago truncatula
MSSKPKKQTYSVCFCCRRRFKLGVSEAPPEIKELYHRYSDEGGIMTASHLRSFLIEVQKEEKITEEETQAIIDGHKHLSIFHRKGLNLESFFKFLFGDTNPPLLPSTGVHQDMSLPLSHYYIFTGHNSYLTGNQLSSDCSDAPIIKALQRGVRVIELDIWPNDSKDDVDVLHGMTLTTPVALIKCLMSIKEYAFVASEYPVVITLEDHLTPDLQAKVAQMVTQTFGDILFCPTSETLKEFPSPDSLKKRIIISTKPPKEYLEAKEEKEKEESQKGKPLGDEEAWGKEVPSLRGGTIADYKQNSGIDEDDLKEEEDSDEASRQNTSDDYRRLIAIHAGKPKGGIVECLKVEPDKVRRLSLSESQLEKAAETYGKEIVRFTQQNILRVYPKGTRITSSNYNPLIGWMHGAQMVAFNMQGYGRSLWLMQGMFKANGGCGFVKKPDFLLKTGPNNEIFDPKANLPSKTTLKVTVYMGEGWYYDFKHTHFDQFSPPDFYARVGIAGVPFDTVMKKTKSIEDSWLPSWNEVFEFPLSVPELALLRIEVHEYDMSEKDDFGGQTCLPVWELRSGIRAIPLHSRKGDKYNNVKLLMRFEFI

SEQ ID NO: 9871 - DNA, 1946 bp, Arabidopsis thaliana
  CDS (1)..(1794)
atggaaggaaaaaaagagatgggtagttacaaattctgtctgatcttcacaaggaagttcaggatgacggagtctggtcctgtcgaagacgtcagagatcttttcgagaaatacaccgaaggcgatgctcatatgtcgccggagcagctacagaagctcatgacggaggaaggaggagaaggagaaacaagtctagaggaagcagagagaatcgttgacgaggttcttcgccggaaacatcacattgcaaagttcaccagacgaaaccttactcttgatgatttcaattattacctcttttctactgatcttaatcctcctatcgccgatcaggtccatcaaaacatggatgctccattgtcacattactttatattcacaggccacaattcctatttaactggaaatcagctaagtagcaactgcagtgaacttcctattgcagatgcattgagacgaggcgtgagagttgttgagttggatctttggccacgtggtaccgatgatgtctgcgttaaacatggaaggacattgacaaaggaagtgaagttgggaaaatgtttggaatctattaaagctaatgcctttgctatttcaaagtatcctgttattattactcttgaagaccatctcacgccaaaacttcagtttaaagttgctaagatgataactcagacatttggagatatgttgtattaccatgattctcaaggttgtcaagaatttccttcaccggaagagttgaaggaaaagattctaatttcaacaaaacctccaaaagagtacttagaagctaacgatactaaggagaaagataatggagaaaaaggtaaggattcggatgaggatgtatggggcaaagagccagaagaccttatttctacgcaatctgatcttgacaaggtgacaagcagtgtaaatgatctcaatcaagatgatgaagaaagggggtcttgtgagtctgatacgtcatgccaattacaagcaccagaatacaagcgtcttatcgctatccatgccgggaagccaaaaggcggtttacggatggctttaaaggttgatccaaataaaatcaggcgacttagtctgagtgagcaattacttgagaaagctgtagcatcatatggtgcagatgttatcagattcactcagaagaattttctgaggatatatcccaaaggcacaaggtttaactcttcaaactataaacctcagatcggttggatgagcggagctcaaatgattgcattcaacatgcaggggtatggcagagcattgtggctgatggaaggaatgtttcgagcaaatggagggtgcggttatgtcaagaagccagattttcttatggatgcaagtcctaatggacaagatttttaccccaaagataattcgtctccaaagaaaactttaaaggtgaaagtctgtatgggagatggatggctcctagacttcaaaaaaactcactttgattcttattctcctccagatttcttcgttagagtgggtattgctggagcacctgttgatgaggtgatggagaaaacaaaaatagagtatgatacatggacacctatttggaataaggagttcacattccctttagcagttcctgaacttgctctgctccgtgttgaagttcatgagcacgacgtgaatgaaaaagatgattttggaggtcaaacttgtttaccagtttcagagataagacaaggcatacgcgctgttccactctttaatcgcaagggagtgaaatacagctccacacggcttcttatgcgcttcgagtttgtctgagacgccatttttgtgcgtgtatccatctagatttatatcttcttactttattcgatatgctgtgttttatgtgttcttatgcttcttcattgatgaataaaatttgatctttacatgagaaatatatagatcttctgaaaaaaaaaaaaaaa

SEQ ID NO: 9872 - protein, 597 aa, Arabidopsis thaliana
MEGKKEMGSYKFCLIFTRKFRMTESGPVEDVRDLFEKYTEGDAHMSPEQLQKLMTEEGGEGETSLEEAERIVDEVLRRKHHIAKFTRRNLTLDDFNYYLFSTDLNPPIADQVHQNMDAPLSHYFIFTGHNSYLTGNQLSSNCSELPIADALRRGVRVVELDLWPRGTDDVCVKHGRTLTKEVKLGKCLESIKANAFAISKYPVIITLEDHLTPKLQFKVAKMITQTFGDMLYYHDSQGCQEFPSPEELKEKILISTKPPKEYLEANDTKEKDNGEKGKDSDEDVWGKEPEDLISTQSDLDKVTSSVNDLNQDDEERGSCESDTSCQLQAPEYKRLIAIHAGKPKGGLRMALKVDPNKIRRLSLSEQLLEKAVASYGADVIRFTQKNFLRIYPKGTRFNSSNYKPQIGWMSGAQMIAFNMQGYGRALWLMEGMFRANGGCGYVKKPDFLMDASPNGQDFYPKDNSSPKKTLKVKVCMGDGWLLDFKKTHFDSYSPPDFFVRVGIAGAPVDEVMEKTKIEYDTWTPIWNKEFTFPLAVPELALLRVEVHEHDVNEKDDFGGQTCLPVSEIRQGIRAVPLFNRKGVKYSSTRLLMRFEFV

SEQ ID NO: 9873 - DNA, 1985 bp, Arabidopsis thaliana
  CDS (102)..(1838)
aggagttgttatttaactaaattgcaggaactttttgaagagaatccagcggttgaaaaatataaatagaggttggctggtgtgattgtgaagtatctgggatgaagagagatatggggagttacaaaatgggtttgtgttgcagtgacaagctcaggatgaacagaggagctccacctcaggatgtggtgacggcgtttgtagagtataccgagggcaggagccacatgacggcagagcagctatgtcggttcttggttgaggtgcaggacgagactgaagtgttggtttcagatgcagagaagatcatagaaagaatcacatgtgaaagacatcatatcactaagttcttgaggcatacgctgaacctcgatgatttcttcagtttcttgttctcagatgatctgaatcatccaattgatagtaaggtgcatcaagacatggcctctcccttgtcgcactatttcatttacaccagccataattcgtatctgactggaaatcagatcaacagcgaatgcagcgacgtacctctcataaaggcattaaagagaggtgttcgagctcttgaacttgacatgtggcctaactctactaaggacgacatacttgttctccatggctgggcatggacacctccagttgaactagtcaaatgcttgagatctataaaagaacatgccttttatgcatctgcataccctgtgatcttaactttggaagatcatttgactccagatcttcaagccaaagcagctgagatgatgaaagagatattcatggatatggtgtattttccagaggctggtggtttaaaagagtttccttcaccagaagatctcaagtacaaaattgtaatatctacaaagcctcctaaaggtagcttaagaaaggacaaggattctgagtcagatgcatcaggaaaggcgtcatcagatgtttcagcagacgatgagaagactgaggaagaaacaagtgaggccaaaaatgaagaggatggatttgatcaagaatccagcaacttggatttcctcacctatagtcgcctaataacgattccttctggaaatgctaaaaatggattaaaggaagcactaacaatcgataatggtggagttagacggctgagtttgagggagcagaagttcaagaaagccactgaaatgtatggaaccgaagtcataaaattcacacagaagaatctgttgagaatatatcccaaggctacccgagtaaattcctccaactataggccatacaacggttggatgtacggagctcaaatggtcgctttcaacatgcagggctatggaagagctctttggatgatgcatggtatgtttaggggaaatggtggatgcgggtacgtgaaaaaaccggactttatgatgaacaataatctcagtggagaagtgttcaacccgaaagcgaagttacccataaagaaaactctaaaagtgaaagtatacatgggcaaaggatgggactctggtttccagcgaacatgtttcaacacttggtcctctcctaacttctacacaagggtggggataacaggagtaagaggtgataaggtaatgaagaaaacaaagaaagaacaaaagacatgggagccattctggaacgaggagtttgagtttcagctaacagtaccggagctggcgttgctaagaatagaagttcacgactacaacatgccagagaaggacgatttctcgggtcagacatgtttgcctgtgtcagagctgagacaaggcatacgttctgttcctttgtatgatcgcaaaggcgagagactagtttcagttacacttctcatgcggtttcactttctttaaacacagagtttccttaaaacagagtttctttcttctttataataataataatacttcaaagagagtggaactttttggcatatgaaaaacggactaaatcaaaatttgtcactcgttaataaaaaattaaagacttggtcttttttg

SEQ ID NO: 9874 - protein, 578 aa, Arabidopsis thaliana
MKRDMGSYKMGLCCSDKLRMNRGAPPQDVVTAFVEYTEGRSHMTAEQLCRFLVEVQDETEVLVSDAEKIIERITCERHHITKFLRHTLNLDDFFSFLFSDDLNHPIDSKVHQDMASPLSHYFIYTSHNSYLTGNQINSECSDVPLIKALKRGVRALELDMWPNSTKDDILVLHGWAWTPPVELVKCLRSIKEHAFYASAYPVILTLEDHLTPDLQAKAAEMMKEIFMDMVYFPEAGGLKEFPSPEDLKYKIVISTKPPKGSLRKDKDSESDASGKASSDVSADDEKTEEETSEAKNEEDGFDQESSNLDFLTYSRLITIPSGNAKNGLKEALTIDNGGVRRLSLREQKFKKATEMYGTEVIKFTQKNLLRIYPKATRVNSSNYRPYNGWMYGAQMVAFNMQGYGRALWMMHGMFRGNGGCGYVKKPDFMMNNNLSGEVFNPKAKLPIKKTLKVKVYMGKGWDSGFQRTCFNTWSSPNFYTRVGITGVRGDKVMKKTKKEQKTWEPFWNEEFEFQLTVPELALLRIEVHDYNMPEKDDFSGQTCLPVSELRQGIRSVPLYDRKGERLVSVTLLMRFHFL

SEQ ID NO: 9875 - DNA, 5002 bp, Caenorhabditis elegans
  CDS (183)..(4478)
ccagacccctctccacacgtactctatatcggctcaacacacacggaggagagccacgtggcagggaaagacgacggcgcaacgtcgtcgcgtcgccttcttcgcatcttctgaatatttcagaagaaggagaattattgtagttgaagactttattttttcctggtaaccggcaagaagagatggcaaaggagttccagttcaattggaagcccactattatccctgaacttcttcatggatcggttttcgatcgatatgatgatgaaagtacgtgtctggaactaaatgctcaagttcgaattgacgagaacggtttctttctccggtggctgatcgaaggaaaagatgctgtcgtactcgatatgggccaaatatgggaagctcgcacgggcggcctacccaaagacggccgaattatgttcgaattggagcagcgcggagccagcgaaacgatagctgaacgcacgatatggatcacgcatggccaggatttagtcaatgttcagtcgttttttcttgtcgccgaaagtgtcgagttggcaaaaacgtgtagagcgggcattaatgatattctaaagtcgtccagaatacgacacgtgtgtccaactacccaattgatgaaataccatacatggctcaccatgaatgtcaacgaacgacgaaaaatcccgatcaagttgataatcaaaacattttcgtctggaaaacctgaaaaaatggttcaaaagtgtctaaatgacttgggtcttggaggcgataagtacacgccggcacgggtcatcaatcgatcgatgggcaagaagtttcggaatttctacaagtgcagtcggggacgaaaacgaaaggagcgcgaagaacttgacgtcgacatcctcacctttgaaaaattccagaggctctataacaagatttgtccgagaaccgaagttcaagagctgtttgttaaattatccggacagaaagagtacctaaccaaagagcgactcatcaattttctgaatgaagaacaacgtgatccacgactcaacgagatcctcttcccattttttgattctcagcgtatcgttgcgcttctcaaaaaacacgaaaacgacataaaatatcaagaagatggaaaaatgtccggtgacgggtttctccgattcctgatgtcagacgagaacccgccagtgtttctagaccgaattgaaatgtttatggatatggatcaaccgctgtgtcactactacatcaatagttcccataacacgtatcttaccggacggcagtatggtggaaaatcgtcttctgagatttatcgacaagttttgctcagcggatgtaggtgtattgagcttgattgttgggatggtactggtgaaaataaaggagaacccattatcactcacggaaaggccatgtgcacagacgtgttcttcaaggacgtcctggtacaaattcgagacaccgcatttgcccggtcggattttccagtggtcctttccttcgaaaaccattgctcaaaatcaaatcagctgaaaatggccaaatattgtatggacatttttggagatatgctgctgtccaaaccgtttgaagatgcgcctcttgaccccggagtctccctaccttctccaaaccgcctgcgaaagaagatccttatcaaaaataagcgattaaaaaccgacatcgaacgtcaccaacttgaccaatttctgcgggaaggcaaactggacgaggaggacgagctgaatgagacgcccgaagttgtcggagaggactccgtatcacctcgaagcggcgggagcggtggcaccggagccccggaagaagtggatgatgacacgtccgacgacgacgatgacccgtcggttcagacatcgctgaacgtgatgcgcaccatcccgaccgtgaacaccacatcgaacaacggatcgaatcgatcggcaagaagttcactggacaccccatccccatccggtgggagcctgatggttccagatagggcaacatcgacagcgacgtcgatcaagaacgccgtgctcgcgaggtctccgaacttctcctcgttgagacaaaagttgtcgttcaagcggagacaatcaccactagcaggcgatcagcgtgctcatccggaagtcgagcaacccgtgagctcatcctctccagccacaccgtccatcagcggacccccgccgtgtgccacgtcatcaggttcaacgtcatcaatcactattaccacaacgggatgctccacgtcatcgtcgggaccctcaaaacatattctagggggtgaaatgcccgccaaggaaaacgacgaagcacatccggagctaaagcagaatttcattgctaaaaatttgaaaggattcgggttttcgaaaaaacaaccggtactgacaaaagaagaagaggagcggattttcgccgagtatcattataccggggcaactacgaatatacatccgttactctcttcactggtcaattatacacatcctgtcaagttttctggatttgacgttgcggaagccaacaacctgcacttccacatgtcctcattttctgagtcaaccggtctcggctacctaaaacaatcggcgccggaatttgtgaactacaacaaacgacaatcgagtagaatttatccgaaaggagccagagttgattcttccaattttttgccgcaaattttctggaacgccggatgtcaaatggtgtcgctcaactttcaaactcccgatgtctacatgcaattgaacatgggaaaattcgagtacaacggtggctcggggtatctgctaaaaccagatttcctccgaagacccgacagaacattcgacccattttccgagagcccggtggacggagtgattgcagcacattgtagtgttcgtgtcatctcgggtcaattcctatcggatcgcaaaatcgggacatacgttgaggtggaaatgtacggactacctactgacactattcgtaaggagcacaagacgaaggtaatacccgggaacggactgaatccagtttacaacgaggatccgtttgtcttccgaaaagttgtgctccccgagctcgccgtgctccggttcgccgtctacgatgagaacggcaagcagctgggtcagcggattcttccgctggatgggcttcaggcaggatatcggcatatttcgctgaggtctgacacgaatcagagcttcattctgtcacctgtgctctttgtgcaaattgtgatcaagacttatgtgccggatgagctcagtggcctcgtcgatgctctcgccgacccacgagcattcctctcggagcagaaaaaaaggcaggaagccctggctcacatgggtgttgacgatagtgatattcctgatgtgcccaacaccaggaatatggctctccgacacgtgaaacaacctccaaggcagaacggatcgtcagctgatctgctggcaaacaacggccaaactgggtcggctaggggtgatcagaccagctcgatggcttcaagtactattcggtcacccaacgaacaaccgcagccagtggctgtggataaatttaaggttgacccaatcgaagttgacgatttacgacgagacaaagcttttgcaaaattgctcaagagatttcaaaaagagttggatgatctcaggaagaaacatcagaagcagagggatagcattcaaaaacagcagccggctcgccgccgtaattcgtccatagcgtggatccaaaccaacgtcgacaagctcatcacaaataaccgacgttccacgaaaaaagaaaaaggctcaaggagatccctgacggcttcagtatcatctggatgtggaagtgcatctggaactgtgactgtcagtgtttgcagtccttctggcgcgagttgcagtgggtactccactgggggtccttcgacaccggtggcatgtaactctgatggtaccgggtctccagcgactattggaagtccagtgccacaagatttggtcaataatgatagggtccgatctctcgtgaacactcaaaccggagaatggtccgctatggtccgtagacatgacgaggaagagtttgagctgaaaaaagtacagctcaaagagcaattcgatctgctaagaaaactcatgagtgaagctcaaaagaaccaaatgttggctctgaagctccggttagaagccgaagggaaagatctaaagcagacgcagacgaaaaaaagcatggaagatgcgaaagttattcaattggacaaaggtattaagaccaaggcagaacgtgatcgtcgtgtcaaggaactcaacgagaagaacctgaaaatgtttgtggaggagaggaagagattagccatgaaagcccaaaagcacgaagagcaactcacaaaacgacatctcgaccagctcgagcaactagacaaggatttccataaggccttggatgcggaggtcggcaactacaaagaagagcaactggctgctcaaccgacttctgtcgtttgatttaagattcatgccaacaactttttaaacattcctcccagtaaaacacttctacgaaacgtgtcagtaggcgagcacttgcattatcgattttttttactttagattatcgatattttccaggaaaaatcgataaatcaatagcatttttttcaaaagagtatcttattcaattattaaatagaaaaaccccatgaacaaacaaacagacaaacaaaatgcttaattatcagattcccactcccgattccgttccatccaaatgtttcattcctttcctcacaatttttgggtattattttttttcagaaattcagattagtggtattttttatatattttatctgttctccccatcccgttccgcgtcttgaaaaaaatttcacgaagttccgcaaattctctctctctattgccactatctcttcgtgtccttttcccctgcgattctggtattttttgaaagtttcctaattttttttgatttgaaaatgaaaaaagttttaatgaaaattatatatttg

SEQ ID NO: 9876 - protein, 1431 aa, Caenorhabditis elegans
MAKEFQFNWKPTIIPELLHGSVFDRYDDESTCLELNAQVRIDENGFFLRWLIEGKDAVVLDMGQIWEARTGGLPKDGRIMFELEQRGASETIAERTIWITHGQDLVNVQSFFLVAESVELAKTCRAGINDILKSSRIRHVCPTTQLMKYHTWLTMNVNERRKIPIKLIIKTFSSGKPEKMVQKCLNDLGLGGDKYTPARVINRSMGKKFRNFYKCSRGRKRKEREELDVDILTFEKFQRLYNKICPRTEVQELFVKLSGQKEYLTKERLINFLNEEQRDPRLNEILFPFFDSQRIVALLKKHENDIKYQEDGKMSGDGFLRFLMSDENPPVFLDRIEMFMDMDQPLCHYYINSSHNTYLTGRQYGGKSSSEIYRQVLLSGCRCIELDCWDGTGENKGEPIITHGKAMCTDVFFKDVLVQIRDTAFARSDFPVVLSFENHCSKSNQLKMAKYCMDIFGDMLLSKPFEDAPLDPGVSLPSPNRLRKKILIKNKRLKTDIERHQLDQFLREGKLDEEDELNETPEVVGEDSVSPRSGGSGGTGAPEEVDDDTSDDDDDPSVQTSLNVMRTIPTVNTTSNNGSNRSARSSLDTPSPSGGSLMVPDRATSTATSIKNAVLARSPNFSSLRQKLSFKRRQSPLAGDQRAHPEVEQPVSSSSPATPSISGPPPCATSSGSTSSITITTTGCSTSSSGPSKHILGGEMPAKENDEAHPELKQNFIAKNLKGFGFSKKQPVLTKEEEERIFAEYHYTGATTNIHPLLSSLVNYTHPVKFSGFDVAEANNLHFHMSSFSESTGLGYLKQSAPEFVNYNKRQSSRIYPKGARVDSSNFLPQIFWNAGCQMVSLNFQTPDVYMQLNMGKFEYNGGSGYLLKPDFLRRPDRTFDPFSESPVDGVIAAHCSVRVISGQFLSDRKIGTYVEVEMYGLPTDTIRKEHKTKVIPGNGLNPVYNEDPFVFRKVVLPELAVLRFAVYDENGKQLGQRILPLDGLQAGYRHISLRSDTNQSFILSPVLFVQIVIKTYVPDELSGLVDALADPRAFLSEQKKRQEALAHMGVDDSDIPDVPNTRNMALRHVKQPPRQNGSSADLLANNGQTGSARGDQTSSMASSTIRSPNEQPQPVAVDKFKVDPIEVDDLRRDKAFAKLLKRFQKELDDLRKKHQKQRDSIQKQQPARRRNSSIAWIQTNVDKLITNNRRSTKKEKGSRRSLTASVSSGCGSASGTVTVSVCSPSGASCSGYSTGGPSTPVACNSDGTGSPATIGSPVPQDLVNNDRVRSLVNTQTGEWSAMVRRHDEEEFELKKVQLKEQFDLLRKLMSEAQKNQMLALKLRLEAEGKDLKQTQTKKSMEDAKVIQLDKGIKTKAERDRRVKELNEKNLKMFVEERKRLAMKAQKHEEQLTKRHLDQLEQLDKDFHKALDAEVGNYKEEQLAAQPTSVV

SEQ ID NO: 9877 - DNA, 8358 bp, Rattus norvegicus
  CDS (567)..(7412)
ctggagcgcggagcgcgggctggcggcgggggcggcgggctagagcagtggacggcggctgcgcgccccgctgtgctctgcccggcttctgttcgctcctgggaatcggctgtgcggctgacactctgtaactgggactctccacggctctggggacgcacgcgcgtggaccaggtccccagggacgcggcactctggtcccgccgcacgtctggctggagatctaagggaacagaaaacactcaaactggatttttaaatcattgcacattaacgatacaaccccaagttgcagaatgtgaccttgaacaaaatccttctaaaaaattagcttcaggcaacagagaaaagaaaagtgaactgttgttttgaaatactggtgtaaaacaaactgtccttgtaggaaattacaactggaaaattttgtttggctcttaatatatctgaatgaaaggaactgtcaccttacttctcacgactggaattatctgagattatctgttgtctggacatgatcgccagggaagggaacacagaagagtagcaactcaaggacgctggtcaagatgacgtccgaagaaatggccgcttccttcctcatcccggtgcctcaaaggaaagtggcttctgcccagtcagtggcagaggagcggggtgaaaaggtctcagaagccggcattcctaagacacgagctggcagacagggtgggctcacccctcgtaccatctcacagcggaacgaacctgaggaagagtctcctagaactgatttttcccaggtcttctcaatagcgaggggggaactagacagcgacgagaatcacaatgaaaggtgctgggaggaaaatgtgccaggttccacgaaaaaccacgcggttaactgcaacagcttattgcaaagccaccagcatgcgcttcccccgagccagctctgtgaagtctgtgactctgtcacagaagaacacctgtgtttgcagcctgggattccttctccactggaaaggaaggtgtttcctgggatcgaactggagatggaggactctcccatggacgtgagccctttgggaaaccagcctgggatcatggagtccagcggacctcactctgaccgcaacatggcggtatttcatttccattatgcaggtgacaggacaatgccaggtgctttccataccctgtcagaaaaattcattttggatgactgtgcaaactgtgttactcttcctggggggcagcaaaacaaaaattacatggcgtatacttgcaaactggtggagttgacaagaacctgtggtagtaagaatgggcagctgaagtgtgaccactgcacctcgctgcgggatgaatacctgtgctttgaaagctcctgccggaaggctgaggctctctcctcaggtggtggcttttgcgaggacggatttactcatggtccctctgccaagacttttctgaaccctttggaggaattctctgataattgtgaagacgtggacgatatttttaaaggcaaaaaggagcggtccactttgttagtccgaaggttttgtaaaaatgacagggaagttaagaagtctgtgtatactgggacaagggccattgtgagaaccctgccttctggccacattgggctggctgcttggagttacgtcgatcagaagaaagctggtctcatgtggccttgtgggaatggaatgagacctctgtccacagtggacgtaaggcaaagtgggagacagcgtctgtctgaagcccagtggtgtctgatctacagtgccgtgagaagagaagagacagaagatacggttggctctcttctgcattgctccacacagctcccaacccctgacacagcccatggaaggatcggagatggtccctgcctaaagcaatgtgtgcgagacagcgagtgtgagtaccgtgccaccctccaaaggacgtccatagctcagtacatcaccggttctctcctagaggcaaccacatctttaggagcaagaagcagccttctcagttcctttggaggatccactgggcgaataatgctgaaagaacgccaaccgggcacttctatggccaattccagtcctgttccttcaagttcagctggaatcagcaaggagctgattgatctccagcccctcattcagttcccggaggaagtagccagcatcttaacagaacaggaacagaacatttaccgcagggtcctgcccatggactacctctgtttcttaacccgggacttgagttcccccgagtgtcagagatcactgccccgtctcaaagcatgcatctcagaatcaatcctcatgtctcaaagtggagagcacaatgcccttgaagacctcgtgatgagatttaacgaggtgagctcctgggtaacatggctgatcctcacggcaggctccatggaggagaagcgggaagtcttttcttatttggtgcatgtggccaaatgctgctggaacatgggcaactacaatgctgtcatggagttcctggctggcctcaggtcaaggaaagttctgaagatgtggcagttcatggaccagtctgacatcgagaccatgaggagcctgaaagacgccatggctcagcatgagtcttccgtggagtacaagaaggtagtgacccgagccttgcacatccccggctgcaaagtggttcccttctgtggggtgttcctgaaggagctctgtgaggtgcttgatggtgcctctggcctcctgaagctctgcccacgatacagctcccaagaagaagccctggagtttgtagcggattacagtggacaagataacttcttacagcgagtggggcagaatggcttgaagaatccagagaaggagctcacggtcaacagcatctttcagatcatccggagctgcagccgaagcttggagacggaggacgaggagagcgccagcgaagggagcggctctaggaaaaactccctcaaggacaaaacccggtggcagtttataattggagatttgctggattcagacaatgacatctttgagaagtccaaagagtgcgaccctcatggatcagaggagtcacagaaagcctttgaccatgggacagagctcatcccatggtatgtgctgtccatccaagcggatgtgcaccagttcctcctgcagggggccacagtcatccactatgaccaggacacacatctctccgcccgctgctttctccagttgcagcctgacaatagtaccttgacctggatgaaacctcccactgcctccccagctggtgccagactcaagctcggtgtgcttagtaacgtggccgaacctggcaagttcccatcactgggcaacgctggggtgagcggcctggtagagggaatcctggatctgttttcagtgaaggctgtgtacatgggacaccctggcattgatatacacactgtgtgtgtccagaacaaacttagtagcatgcttctgtcagagactggggtgacgctgctctatgggcttcagaccaccgacaatagattactgcacttcgtggcaccaaagcacacagctaaaatgcttttcagtggattgctggaactcactacagctgtgagaaagatacggaagttccctgaccaaagacaacagtggcttcggaaacagtatgtcagcttctatcaggaggatggtcggtatgaaggcccaaccttggcacatgctgtggagttgtttggtggtaggagatggagcactagaaaccccagccctgggatgtcagcaaagaatgccgagaagcccaacatgcagagaaacaacaccctaggcataagcaccaccaagaaaaagaagaaaatgctcatgaggggggagagtggagaggtgacggacgatgagatggccacccgcaaggccaaaatgtacagagagtgtcgcagccggagcggctctgatcctcaagaggctaatgaacaggaagactcagaggccaatgtcatcactaaccctcccaaccccctccattccagaagagcctactcattgaccacggctgggtcccccaacttggctaccgggatgtcatctcctatcagtgcctggagtagcagcagctggcatgggcggatcaaaggaggaatgaaaggcttccagagcttcatggtctcagacagtaacatgagtttcattgaattcgtcgagctgttcaaatcattcagcataaggagccgcaaggacttgaaggacatctttgacatctactctgtaccctgtaatcggtctgcttctgagtcaaccccactgtacaccaacctgacaatcgaagaaaataccaatgaccttcagcctgacctagatttgctgactagaaacgtctccgacttggggctgttcatgaagagtaagcagcagctttctgacaaccagaggcagatatctgacgccattgctgctgcaagcattgtgactaatggcactgggattgaaagcacgtccctgggcatatttggggtcggcatactccagctcaacgacttcctggtgaattgccaaggagaacactgcacatatgatgaaatcctcagcatcatccagaagttcgagcccaacatcagcatgtgtcatcaaggtctattgtccttcgaagggtttgcaaggtttctgatggataaagacaatttcgcctcaaaaaatgacgagtcgcgggagaacaagaaagacctgcagctacccctctcctactattacatcgaatcttcgcacaacacctacctcaccggccatcagctcaagggggagtcctctgtggagctctacagccaggtcctcttgcaaggatgcagaagcatagagctggactgctgggatggagatgatgggatgcccattatttatcatggacatacgctgacaaccaagatccccttcaaggaagtggtggaagccatcgatcgcagtgccttcatcacctccgacctgccaatcatcatatccattgagaaccattgctcattgcctcagcaacggaaaatggcagaaattttcaagagtgtgtttggagaaaagctggtggctaagttcttgttcgagaccgatttctcagatgacccaatgcttccctcacctgaccaacttagaaggaaagtgcttcttaaaaacaagaagctaaaggcccatcagacacctgtcgacatcctcaaacaaaaggctcatcagttagcatccatgcaaacacaggctttcactggtgggaatgccaacccgccacctgccagtaatgaggaagaggaagacgaggaggacgaatatgattatgattacgagtccctgtctgatgacaacattctggaagacagacctgagaacaaatcatgtgccgacaagcttcagtttgagtacaatgaagaagtccccaagaggataaagaaagcagacaactcctccggcaataagggaaaggtctatgacatggaactgggagaggagttttaccttcctcagaacaaaaaagaaagcaggcagattgcaccggagctctctgacctcgtcatctattgccaggcggtaaaatttccaggcctgtcaactctaaattcatctggctctggcagagggaaagaaaggaaaagcaggaagtccatttttggcaacaatcccggcagaatgagcccaggggagacagcgtcatttaacagaacatctggaaaaagttcttgtgaaggaattcgacaaatctgggaggaacctccactcagcccaaacacatccctcagcgccatcattagaactcctaaatgctatcatatctcgtcactgaatgaaaatgccgccaaacgtctgtgtcgcaggtattctcagaaactgatccagcacactgcttgccagctgctgaggacctacccggcagcgaccagaatcgactcatccaatcccaaccccctcatgttctggctccatgggatacagcttgtagctctaaactaccagacggatgaccttcctttacatttaaacgctgccatgtttgaggcgaatggtgggtgtggctatgttttgaagccccctgtcctgtgggataaaagctgtcccatgtatcagaagttttcaccactggaaagagacctggacgccatggatcctgctacctattctttaaccatcatctctggccagaatgtgtgtcctagtaacagcaccggaagtccgtgcattgaagttgacgtcttgggcatgcccctggacagctgccatttccgcacaaaacccatccaccgaaacactctgaaccccatgtggaatgagcagtttctcttccgggttcactttgaagatcttgtatttcttcgttttgcagttgtggagaacaacagttcggcgataacggctcagagaatcattccactcaaagctttaaagagaggatatcggcatcttcagctgcggaacctccacaacgagatcttggaaatctctagcttattcataaacagcaggaggatggaagataatccctctggcagtacccggccagcctctttgatgttcaatactgaagagaggaaatgttctcagactcacaaagtcacagtgcatggtgtcccaggtccagagccctttgctgttttcacaataaacgaaggcaccaaggcaaagcagcttctccaacagattttggcagttgaccaggacaccaaacttacagccgcagactattttctgatggaagagaagcattttatatctaaggaaaagaatgaatgcaggaaacaaccattccagagagctgtgggcccagaggaagatattgtgcagattttaaacagctggttcccagaagaaggctacgtaggcaggattgtcttaaagccccaacaagaaaccctagaagagaaaaacattgtccacgatgacagagaggtgatcttgagctcagaagaggagagtttctttgtccaagtgcacgatgtctctccagagcagcctcgaactgtcatcaaagccccacgtgtcagcactgcacaggatgtgattcagcagaccttgtgcaaagccaaatattcctacagcatcctgaacaaccccaatccgtgtgactatgtgcttttggaagaggtaatgaaagatgcacccaataagaagtcttctaccccgaagtcctcacagaggatcctcttggaccaagaatgtgtgtttcaagcccaaagcaagtggaagggtgcagggaaattcatccttaagctaaaggagcaggtgcaggcatccagagaagataaaaggaggggcatctcctttgcaagtgaactcaagaaactcacgaagtccactaagcaaacccgaggactcacctcgcctcctcagcttgtggcctcagaaagtgtgcaaagcaaggaggagaaacccatgggtgccttggcctctggtgacacagcgggctaccagtcgtgagccagtgcagcacatttgatccagggatatgaaggggaaggcccttgatgagaagctatcaagaatggacatggtggaaagaagtatactttacctccatcacattcaaactggaaattgatgatttccgaactccagaacctcctcacacccgatgagaggttcatgcagaggacaagcaaaacggcacagaactgccaaccaacttcctgaggaatgaagcagggacacccagggcattgcccggggcattatgggtggaaaagccacccctcaagctgaaggcaacaaggaacacctgtaaagggccaggcggtaaacattttagggtcggggccacgtggcttctgtcgaattcagttagctcagctactggatggcaaatgaagctgtcgacaacaggtacaagaatgaacatctgactgaacaataaaactttatttatggacacttaaatcggaacctcatataattttcacatgtcacacatgtttaagtgtttcaaccacttaaaattgtaaaatctttcctagtttaagggtcagacaaaaacaacatgaggctggctcgaggaccagcttgctgacccagcttgggagaactgggagccaaaggcacagaggttagaaaacctcgaaaattggccgtgggtttaatgagaagtggaagtctggggacattggaaatgtaaatatgtcctgttagatttgttagcaattattcaaattagttcctatattgtgtacccaggtgcactctttgggctgcctttcctcaaatagaaatgtttttccgaaagctacgacccatgcgtccacagactgtcccattttcagttctcacaaagtgaatttagaatgatgtacaatttagtgtctatcgagttgtgatgtcctcataagaaaacctaaaagcaaaaagtagactgaaaaaaaaaaaaaaaaaa

SEQ ID NO: 9878 - protein, 2281 aa, Rattus norvegicus
MTSEEMAASFLIPVPQRKVASAQSVAEERGEKVSEAGIPKTRAGRQGGLTPRTISQRNEPEEESPRTDFSQVFSIARGELDSDENHNERCWEENVPGSTKNHAVNCNSLLQSHQHALPPSQLCEVCDSVTEEHLCLQPGIPSPLERKVFPGIELEMEDSPMDVSPLGNQPGIMESSGPHSDRNMAVFHFHYAGDRTMPGAFHTLSEKFILDDCANCVTLPGGQQNKNYMAYTCKLVELTRTCGSKNGQLKCDHCTSLRDEYLCFESSCRKAEALSSGGGFCEDGFTHGPSAKTFLNPLEEFSDNCEDVDDIFKGKKERSTLLVRRFCKNDREVKKSVYTGTRAIVRTLPSGHIGLAAWSYVDQKKAGLMWPCGNGMRPLSTVDVRQSGRQRLSEAQWCLIYSAVRREETEDTVGSLLHCSTQLPTPDTAHGRIGDGPCLKQCVRDSECEYRATLQRTSIAQYITGSLLEATTSLGARSSLLSSFGGSTGRIMLKERQPGTSMANSSPVPSSSAGISKELIDLQPLIQFPEEVASILTEQEQNIYRRVLPMDYLCFLTRDLSSPECQRSLPRLKACISESILMSQSGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSVEYKKVVTRALHIPGCKVVPFCGVFLKELCEVLDGASGLLKLCPRYSSQEEALEFVADYSGQDNFLQRVGQNGLKNPEKELTVNSIFQIIRSCSRSLETEDEESASEGSGSRKNSLKDKTRWQFIIGDLLDSDNDIFEKSKECDPHGSEESQKAFDHGTELIPWYVLSIQADVHQFLLQGATVIHYDQDTHLSARCFLQLQPDNSTLTWMKPPTASPAGARLKLGVLSNVAEPGKFPSLGNAGVSGLVEGILDLFSVKAVYMGHPGIDIHTVCVQNKLSSMLLSETGVTLLYGLQTTDNRLLHFVAPKHTAKMLFSGLLELTTAVRKIRKFPDQRQQWLRKQYVSFYQEDGRYEGPTLAHAVELFGGRRWSTRNPSPGMSAKNAEKPNMQRNNTLGISTTKKKKKMLMRGESGEVTDDEMATRKAKMYRECRSRSGSDPQEANEQEDSEANVITNPPNPLHSRRAYSLTTAGSPNLATGMSSPISAWSSSSWHGRIKGGMKGFQSFMVSDSNMSFIEFVELFKSFSIRSRKDLKDIFDIYSVPCNRSASESTPLYTNLTIEENTNDLQPDLDLLTRNVSDLGLFMKSKQQLSDNQRQISDAIAAASIVTNGTGIESTSLGIFGVGILQLNDFLVNCQGEHCTYDEILSIIQKFEPNISMCHQGLLSFEGFARFLMDKDNFASKNDESRENKKDLQLPLSYYYIESSHNTYLTGHQLKGESSVELYSQVLLQGCRSIELDCWDGDDGMPIIYHGHTLTTKIPFKEVVEAIDRSAFITSDLPIIISIENHCSLPQQRKMAEIFKSVFGEKLVAKFLFETDFSDDPMLPSPDQLRRKVLLKNKKLKAHQTPVDILKQKAHQLASMQTQAFTGGNANPPPASNEEEEDEEDEYDYDYESLSDDNILEDRPENKSCADKLQFEYNEEVPKRIKKADNSSGNKGKVYDMELGEEFYLPQNKKESRQIAPELSDLVIYCQAVKFPGLSTLNSSGSGRGKERKSRKSIFGNNPGRMSPGETASFNRTSGKSSCEGIRQIWEEPPLSPNTSLSAIIRTPKCYHISSLNENAAKRLCRRYSQKLIQHTACQLLRTYPAATRIDSSNPNPLMFWLHGIQLVALNYQTDDLPLHLNAAMFEANGGCGYVLKPPVLWDKSCPMYQKFSPLERDLDAMDPATYSLTIISGQNVCPSNSTGSPCIEVDVLGMPLDSCHFRTKPIHRNTLNPMWNEQFLFRVHFEDLVFLRFAVVENNSSAITAQRIIPLKALKRGYRHLQLRNLHNEILEISSLFINSRRMEDNPSGSTRPASLMFNTEERKCSQTHKVTVHGVPGPEPFAVFTINEGTKAKQLLQQILAVDQDTKLTAADYFLMEEKHFISKEKNECRKQPFQRAVGPEEDIVQILNSWFPEEGYVGRIVLKPQQETLEEKNIVHDDREVILSSEEESFFVQVHDVSPEQPRTVIKAPRVSTAQDVIQQTLCKAKYSYSILNNPNPCDYVLLEEVMKDAPNKKSSTPKSSQRILLDQECVFQAQSKWKGAGKFILKLKEQVQASREDKRRGISFASELKKLTKSTKQTRGLTSPPQLVASESVQSKEEKPMGALASGDTAGYQS

SEQ ID NO: 9879 - DNA, 2207 bp, Oryza sativa
  CDS (147)..(1946)
cggcacgaggtccaattccaattataattccaagaggctcatcatcaactcaactgaagaagaagaagaagaagaagaagaagaagaggaggagggttcggcacgaggtgggaagggagggggaggaggaaggcgatcgatcggcgatgggcacgtacaagtgctgcctcatcttcaagcgccgcttccgctggaacgacgcgccgccgcccgacgatgtccgcgccctcttcgccaaccactccgccggcggtggcccccacatggccgccgacggcctccgcgcctacctccaggccaccggcacgaggacggcgacgtggacatggagcggctggtggagcagatccggcagctgcaggggcgcggcgggcgcatcccgcgggtggggcgggcactcccactcctgcacggtggacgacttccaccgattcctcttctcccacgagctgaacccacccatccggcacgggcaggggcaggtgcaccacgacatggccgccccgctctcccactacttcatctacaccggccacaactcctacctcaccggcaaccagctcagcagcgactgcagcgacctccccatcatcagggctctccagaggggcgtccgcgtcatcgagctcgacatgtggcccaactcctccaaggatgacatcagcatcctccatggcaggacgcccaccaccccggtctccctcctcaaatgcctcctctccatcaaggaacacgcctttgaggcctccccttacccggttatcatcacgctcgaagaccacctcacccccgatctccaggacaaagcagccaagatggttcttgaagttttcggcgacatcctctactaccctgacaaagatcacctcaaagagttcccttcgcctcaagacctcaagggccgtgtcctcctctccaccaagccccccaaggagtaccttcaagccaaggatggtaatgctgccaccatcaaagaggacgccaaggccgccgccactgacgatgccgcatggggaaaagaagtcccagatattcactctcaaatccactctgccactaaacatgaccaaagagaagatgacgacgacaccgatgaagacgaagatgacgaggaggaggagcagaaaatgcaacagcatctagctccacagtacaaacaccttattaccatcaaagcaggaaagccaaaaggtactctacttgatgccttacagagtgacccagaaaaggttagaaggctcagtttgagcgagcaacaacttgccaaattggcagatcatcatggtaccgaaattgtcaggttcacacagagaaacctactgaggatatacccaaagggcactcgggtcacatcatccaactataatccatttcttggttgggtgcatggtgctcagatggtagcgttcaatatgcagggatatggaagagctctttggttgatgcatggattttataaagctaatggtggctgtggttatgtgaagaaaccagatttcttaatgcaaactgatccagaggtttttgacccaaaaaaatccctatcttccaagaaaaccttgaaggtgaaagtatacatgggggatggttggcggatggacttcacgcagacccactttgatcaatattctcctccagacttttatgcacgggtggggatagcgggagtaccagcggactcggtgatgaagagaacgagggcgatagaggataactgggtgccggtgtgggaggaggatttcaccttcaaactgaccgtgccggagatcgcgttgctgcgggtggaggtgcacgagtacgacatgtcggagaaggacgacttcggcggccagacggtgctgccggtgtcggagctcatcccggggatccgagcggtggcactccacgaccgcaaagggatcaagttgaacaacgtcaagcttctcatgcgcttcgagtttgaatgacccaacacaccgacactttctttctcgccgcattgcattgcactgtgcctgtgcctgtgcagcatccatcatttggtttggtttttcatgttcctgtgcatacgcatttgtgtctgtacataggctcggtcctgtatattgtttgtgagtaacatgtaacaataaggcttcacgccatgttcattcctcctgtttgaacccctccaaatatattaataccgaaggtacaaaatatctcaacggcaaaaaaaaaaaaaaaaa

SEQ ID NO: 9880 - protein, 599 aa, Oryza sativa
MGTYKCCLIFKRRFRWNDAPPPDDVRALFANHSAGGGPHMAADGLRAYLQATGTRTATWTWSGWWSRSGSCRGAAGASRGWGGHSHSCTVDDFHRFLFSHELNPPIRHGQGQVHHDMAAPLSHYFIYTGHNSYLTGNQLSSDCSDLPIIRALQRGVRVIELDMWPNSSKDDISILHGRTPTTPVSLLKCLLSIKEHAFEASPYPVIITLEDHLTPDLQDKAAKMVLEVFGDILYYPDKDHLKEFPSPQDLKGRVLLSTKPPKEYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKSLSSKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSELIPGIRAVALHDRKGIKLNNVKLLMRFEFE

SEQ ID NO: 9881 - DNA, 3107 bp, Homo sapiens
  CDS (196)..(2484)
gccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggcaaaaaaaaaaaaaaaaaaa

SEQ ID NO: 9882 - protein, 762 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 9883 - DNA, 2038 bp, Digitaria sanguinalis
  CDS (61)..(1953)
ccctccgctcatccatccgccctccgaaatcgccctccctgaaacctcgcggcgcgaaaaatgcccaaacgagacaaaggagctcgcccgcgcgtttccccaccccacacacctccgccggggacggagagcgaggccgagggggcagacgacgaggcgggggcgtcgtccgcggcggagatggggacgtacaagtgctgcatcttcttcacgcacaagttcgcgatcgacgacaccaccacgccggaggatgtgcgcacgctcttctcccgctactccggaggctcgccctacatgggccccgacgacctccgccgctacctcgccaactggggaggggccggcggcgaggtcgccgagcagatcgtcgaccgggtattgcaggaccgcagccgcaccccgcggttcgggaggcccgcgctcaccgtcgacgacttcatgcacttcctcttctccgaggatctcaacccgcccctccgccactccaaggtccaccaggacatgaacgcaccactatcgcactattttatacacactggacacaactcatatctgaccggtaatcaactcagcagtgactgcagtgatgtccccattatcaaggcacttcaactaggtgttcgtgtaattgaattggacatatggccaaattcttctaaagatgacattgatgttctccatggaaggacactgactgccccagtatcactaattaagtgcttgagatccatcaaacaatatgcttttgttgcatctccgtatcctgttattataacattagaagaccaccttacacctgatcttcaggcgaaagtagctcagatggttcttgaagtgtttggggacatgctatattaccctgaatcaaaacatcttcaagaatttccttcacctgaagctctaaaggggcgtgtcatgctctcaacaaaacccccaaaggagtaccttgaagcaaagggtggtaccataaaggatagagaaattgaacaccagtttaaaaagggagaaaaggaagaagcagcttggggagtagaagttccagatattcaggatgagatgaaagtagccgacagaaatgaagatgatatattatttcgagaaagaggtttggatgatgacgatgagcagaaaacgtgcaagcatgtggcaccagagtataaacacctcattactatcaaagctggaaagccaaagggtgctctcgtggatgccttaaaaaatgatcctgataaagttaggcgtctcagtttgagtgagcaagaacttgcaaaagtggcatcaaatcatggtcccaacattgtgagcttcacacatagaaatatgctgagaatatacccaaagggaacccgcttcaattcatccaactataatccatttcttggctgggtgcatggtgctcaaatggtggcattcaatatgcagggacacggtagagcactttggttaatgcatggttttttccaagccaatggaggctgcggttacgtgcagaaacctgatttcttgatgcaaacttgtccagatggaaaggtgtttgatcccaaggcagatttaccggtcaaggcaacattaaaggtcaaggtatacatgggcgaaggttggcacaaggacttcaagcagacacatttcgacacatactcacctccagatttctatgtagaggttggcatcgccggagttccattagactcggtgatgaggaagacgaaagccgtggaggataactgggtccccgtgtgggaggaggaattcgccttcccgctgactgtccctgagatcgcggtgctccgcgtggaggtgcacgagcaggatgtgagcgaggacgacttcggcgggcagacggcactgccggtcgaggagctgcggccggggatttgcgccgtcccgttgttcgatcacaaggggcacaagttcaacaacgtcaagctcctcatgcgcttcgagttcacctagcgtcctgtagcacagaacggctatgttgccatgtctgatgatcgatgcttgtttgcattaaaaaaaaaaaaaaaaaaaaaaaaaa

SEQ ID NO: 9884 - protein, 630 aa, Digitaria sanguinalis
MPKRDKGARPRVSPPHTPPPGTESEAEGADDEAGASSAAEMGTYKCCIFFTHKFAIDDTTTPEDVRTLFSRYSGGSPYMGPDDLRRYLANWGGAGGEVAEQIVDRVLQDRSRTPRFGRPALTVDDFMHFLFSEDLNPPLRHSKVHQDMNAPLSHYFIHTGHNSYLTGNQLSSDCSDVPIIKALQLGVRVIELDIWPNSSKDDIDVLHGRTLTAPVSLIKCLRSIKQYAFVASPYPVIITLEDHLTPDLQAKVAQMVLEVFGDMLYYPESKHLQEFPSPEALKGRVMLSTKPPKEYLEAKGGTIKDREIEHQFKKGEKEEAAWGVEVPDIQDEMKVADRNEDDILFRERGLDDDDEQKTCKHVAPEYKHLITIKAGKPKGALVDALKNDPDKVRRLSLSEQELAKVASNHGPNIVSFTHRNMLRIYPKGTRFNSSNYNPFLGWVHGAQMVAFNMQGHGRALWLMHGFFQANGGCGYVQKPDFLMQTCPDGKVFDPKADLPVKATLKVKVYMGEGWHKDFKQTHFDTYSPPDFYVEVGIAGVPLDSVMRKTKAVEDNWVPVWEEEFAFPLTVPEIAVLRVEVHEQDVSEDDFGGQTALPVEELRPGICAVPLFDHKGHKFNNVKLLMRFEFT

SEQ ID NO: 9885 - DNA, 4729 bp, Watasenia scintillans
  CDS (426)..(3764)
gatcagccgtagactaggagaggggatagaagcacctacctgtacggctcttgatatatacatatatatcgcgggctgatacaacaagttttaaacacttgaaaacactttttcttttttttctaaaaaggaaaaagtgtaatagtgtttgaatttcttgttgccttttcacctgtttttttatcttcattccggagcagatttggacgcggacggacttttatttactatttttcttagcaaccagggtttacaaaaagagaaaaaaacttgagttctgaagttttataaaaaaaaatcaaggtgcacctaagggtggaaaaaatcacccttttgcgtcgggacatcagatcatttatgtggatttcttttaactaaacatccccaaccttgtggtcgtgagttgagaccccaaaaccctcaacatggccggagtagaaaccgccgttcgtcaaattgagctgaaatggcccaatgtgccagaacagctagtaaaaggcgataagtttcttatgtgggaagaggattcctcaaaaaccactgaagttctcgtcagagttgatcctaagggatatttcatcttctggaaaatcgaaggaaaggaagatacagaatgtttggatttggcctatctccgagatattcgaactgggaaatactcaaaatgtccaaagggcaaagtcaaagatatgggtacaagctatggctcatcaaatattcccctccaggataaatgtgttacaatttgccatggcaacaactacattgacttagaatggatccattttattgccgaaaattcaggcgtcgctcagaaatggtgtgatgaagtattcaaatatgcctacaacttgttgtccctcaacaagaaccagttgggtgaatgggaaaaactttatttccgattgacagtcgtagaaatggagaataagaaagttcccgtaaaagtcctccagaaatgtctttctaaagacaaagatgacagaacaaggatttcgaaagcacttgagacaatgagttggccttcaggaaagaatgatggcattgacataaaaacttttgattttgattccttcttcaagttctacttgacccttcttgatcgatctgaaattgaaggtatcttcaaagagctgtccaaaaacaagggtagtatcacaacacccgatttcaaagaattcttgaacgagatgcagcgtcatcccagtttgcataaaactcttttccccctctacaccgatagtcagtgtgatggattaatcaatgattatgaaagcgctgttaacaaaaaaggaaagaagaaaggacaactgaccaaagaaggtttactctatttccttatgtgcgaagaaaataacttgactccaatgcatcgattggatttgggggccaacatgaaactctcattggctgcctattacatcaactcttcccacaacacctatttgactggtcaccagttgactggtaaatcctccgttgaaatttatcgccaagtcttgcttactggatgtcgatgtttggagttggattgctgggatggaaaagacggagaaccaatcatcactcacggtttcactatgtgtacggaagtttccttcgaggatgttgtccatgctatcggagagtgcgccttcaaagtgtccgaatacccagtcatcttgtctttcgagaaccattgctcagtcccccaacagaagttgctggccaaatattgtcatgaggctttcggagagatgcttctcagtgaacccattgatggtcacccgctgaagccaggcgttactttgccaacaccatatgatttgaagaagaaaatcctcattaagaacaagaaaatgcacaaaggtgctggagatgatgaagatatggcaggactgacagatgaagagaagaagaaaattgagaaggaaaagaaagatgctggtacagcagccaaagaagcagaagctgcggaagagatgtctgatcttgtaaactacatccaacccgttcatttcacaacttttgaacaagcccaaaagaaagacagacattatgagatgtcctccatggtagaaactcaggctttgaataagctgaaagacaatccagaggactttgtagattacaacaagaaacaactgactaggatttaccccaaaggtaccagggtagactccagtaactacgtaccccagatctactggaacgccggttgtcaattggtcgcattgaacttccaatgtttcgatgttgccatgtgcgtcaacttgggtgtgtttgaatacaatggtagttcaggttatttggtcaaacctgaatttatgagaaaactcgataagagattcgatcctttcacagaatccactgtcgatggtattgtagcaggaactattgaaattaagatcatctctgcccagttcttatctgacaagaaaatttcatcatacgttgaagttgagatgtacggtctgcccaccgacactgtgagaaagaagttcaagaccaaaactgttgctaacaatggcattgatccctattataacgagaaagctttcacatttaagaaggttgtattgcctgaccttgctgtcgtccgaatcatcgtatctgaagatggcggtaaattcattggtcatcgtgtcatgccactggatggtatcaaaccaggttacaggcatattccccttcgaaatgagagtaacagacctttgggtttggcttcagtgtttgctcacattgtagccaaggattacgtatcggatgcattcgcagattttgctgatgctttgcttaatccaattgcctaccaatgtgcacaagatgctcgtgccgctgctttgtgcgcttttgaagatgatcctgaggctgccttagatgctgctaagccgactggaaaacctggaaaaggaaaaggaaaaggaaagggaggagtaaagagtccgaaagggggcaaaaaggcttgggctggtgctcaaaagaaagtcagtactggaaatattgccaaaactgctctcatgggagcaaagaaaccagccgccacgcctggcagtccacctccaccaccaaaaggagatgaatctgaatttgtccagaattcaaagatgaaggatgaagctaactgcgctccacccaaattggaagatttgaagaaaaacaaagcttacaccaaaattgcatcgaaacgagacaaagaagttgattcactcaagaagaagaacgaaaaggctcaatcgagtatgaagaaaaagctgaaggatgaagagaagaaagccaaaaagaaggagagtgaagataagttcaatcaaatacataaagagaacatggataaatatgtggcattgtgcactgaacattacaacgcagaagcagatatcgccaagaagtacatcgagtccctgaatgattgcctgaagaccttaatagggtcctgcacggatgatatcaagaagaagcttcagacgatccacgataaagaggttgaggcaatgaacaaagagatgaacaaaaaatcaaaagtggaacagaaagagttgggaaaggaaactaaagacaaagaagaattggcaaggaaaaagcgtgaatcaagtaagaaacttattgatggaatcgttcaagagagaaataagttgaaggccctgaaggaaagacaagaaaaaggcttagacaagaaggttgaggaattgaccaaagagtttgaggcagagaaagccagtgcggagactacactgaagcaacaaattgacgagaaactgaagaaggctaaagaggattggtcctgaattattcattggtctcctcttcttcttatttctctcctctattctaggaaaaaaataaaattaaccaagaatttgatgccagagagctcctcctggaagcggggtattcgatgaagaaagtcaacagtagggattacgtcacaccgttatgacgatggccaataccaaaaaagttatggcaaattagcacaaataaatatagaaaattcacttgaagctggatatttgatggagaacgtcaacaatttacacagacaaacatacaaaattcccctcaaaacggaatattatggccttgttacgataaatcaacacgaacaaatataggaaaattcacctggaagcggaatattccatggaggaagtcaacgatggctaataccaaaaattagtacaaacacagagaaactcattagaaagcagaattttttatgctactgcaagaatattgttacggccttatgacgacaaattagcacgaatagctatagaaaatttgatcgaaagcagaatatttgttcaagaaaatcaatagttaagagtttgtcaccaacttacgatgacggacaatacccgaaataataattaaaatttactcccacaattattgaaagattcacctgatagccatataaaaaaggaggtgtaaacagatggccaaaaccaaaaacaatatagcaaacacgaacaaacatagaaaattctcatcgaagcggaaagtcaatggcaaggactatgtgtctgccttatgatgacggcgaataccaaaaaattaatgttgcaaaatagcacgaacaaatatagaaaaattcacggcattccacaactagagatttcataaccgaatgtggaacactctttttttgtgattttcaccgaacgaacgtacacactttttctaaaaaccaatttatcaacaccacagaaaattttttcgaaatttgagaatttcaaaaaaaagttgg

SEQ ID NO: 9886 - protein, 1112 aa, Watasenia scintillans
MAGVETAVRQIELKWPNVPEQLVKGDKFLMWEEDSSKTTEVLVRVDPKGYFIFWKIEGKEDTECLDLAYLRDIRTGKYSKCPKGKVKDMGTSYGSSNIPLQDKCVTICHGNNYIDLEWIHFIAENSGVAQKWCDEVFKYAYNLLSLNKNQLGEWEKLYFRLTVVEMENKKVPVKVLQKCLSKDKDDRTRISKALETMSWPSGKNDGIDIKTFDFDSFFKFYLTLLDRSEIEGIFKELSKNKGSITTPDFKEFLNEMQRHPSLHKTLFPLYTDSQCDGLINDYESAVNKKGKKKGQLTKEGLLYFLMCEENNLTPMHRLDLGANMKLSLAAYYINSSHNTYLTGHQLTGKSSVEIYRQVLLTGCRCLELDCWDGKDGEPIITHGFTMCTEVSFEDVVHAIGECAFKVSEYPVILSFENHCSVPQQKLLAKYCHEAFGEMLLSEPIDGHPLKPGVTLPTPYDLKKKILIKNKKMHKGAGDDEDMAGLTDEEKKKIEKEKKDAGTAAKEAEAAEEMSDLVNYIQPVHFTTFEQAQKKDRHYEMSSMVETQALNKLKDNPEDFVDYNKKQLTRIYPKGTRVDSSNYVPQIYWNAGCQLVALNFQCFDVAMCVNLGVFEYNGSSGYLVKPEFMRKLDKRFDPFTESTVDGIVAGTIEIKIISAQFLSDKKISSYVEVEMYGLPTDTVRKKFKTKTVANNGIDPYYNEKAFTFKKVVLPDLAVVRIIVSEDGGKFIGHRVMPLDGIKPGYRHIPLRNESNRPLGLASVFAHIVAKDYVSDAFADFADALLNPIAYQCAQDARAAALCAFEDDPEAALDAAKPTGKPGKGKGKGKGGVKSPKGGKKAWAGAQKKVSTGNIAKTALMGAKKPAATPGSPPPPPKGDESEFVQNSKMKDEANCAPPKLEDLKKNKAYTKIASKRDKEVDSLKKKNEKAQSSMKKKLKDEEKKAKKKESEDKFNQIHKENMDKYVALCTEHYNAEADIAKKYIESLNDCLKTLIGSCTDDIKKKLQTIHDKEVEAMNKEMNKKSKVEQKELGKETKDKEELARKKRESSKKLIDGIVQERNKLKALKERQEKGLDKKVEELTKEFEAEKASAETTLKQQIDEKLKKAKEDWS

SEQ ID NO: 9887 - DNA, 2416 bp, Homo sapiens
  CDS (81)..(2114)
aaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggagggaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagataagaaagacaggaaggaggagtatttttgtgcctcagactcccataatggtatgagtaccctcctccttctcctccctcacactgcatgtgatttggaagaaaagtgtctgctggcccccagggaatggaaggtgctaatctttgctgtcttcaacatccaagcatgtggccattacacaggtggcagagggcaggggaagtcttagctgccgcactggatccctcacctcagaagtaagtcaactttttttctctaatagatagttggacaaaaggactttgaaaaaattagccagatgtagaatccctgttgttttgcccctacgtctgaataaaagcaatgacttgtgattgtt

SEQ ID NO: 9888 - protein, 677 aa, Homo sapiens
MSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKIRKTGRRSIFVPQTPIMV

SEQ ID NO: 9889 - DNA, 7609 bp, Homo sapiens
  CDS (236)..(7147)
atctaccaccttaaaaccctgatctagaaaaaatatatattcatgataggaagttataactaagaaaatttatttgcctcttaatgctcctgaatgaaagaaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaagggaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgccgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctatcgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccccctcaacccaaccacgtccctcagtgctatcattagaactcccaaatgttatcatatctcgtcgctgaatgaaaatgccgccaaacgtctgtgtcgcaggtattctcagaaactgatccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccgcgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtctccagtgacacaatggattaccgacagtgactaagggcagcatgtttaacccaggtggagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaaaaaaaaaaaaaaaaaaa

SEQ ID NO: 9890 - protein, 2303 aa, Homo sapiens
MTSEEMTASVLIPVTQRKVVSAQSAADESSEKVSDINISKAHTVRRSGETSHTISQLNKLKEEPSGSNLPKILSIAREKIVSDENSNEKCWEKIMPDSAKNLNINCNNILRNHQHGLPQRQFYEMYNSVAEEDLCLETGIPSPLERKVFPGIQLELDRPSMGISPLGNQSVIIETGRAHPDSRRAVFHFHYEVDRRMSDTFCTLSENLILDDCGNCVPLPGGEEKQKKNYVAYTCKLMELAKNCDNKNEQLQCDHCDTLNDKYFCFEGSCEKVDMVYSGDSFCRKDFTDSQAAKTFLSHFEDFPDNCDDVEEDAFKSKKERSTLLVRRFCKNDREVKKSVYTGTRAIVRTLPSGHIGLTAWSYIDQKRNGPLLPCGRVMEPPSTVEIRQDGSQRLSEAQWYPIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTPTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYRQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLIQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFRVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSPVTQWITDSD

SEQ ID NO: 9891 - DNA, 3743 bp, Loligo pealeii
  CDS (158)..(3541)
ttttttttttaaccaaagaatgatttattaataataacgatttaaagaaagaacaaaaaaaaatatccaagaggagtgtgtgtgctccaaaacctttatgtggatttcttctccgaaataaaaatcctcaaagtcctgtgagcgaaataatctcaccatggcgggagtagaaaccgcggtgcgacaaattgaattaaaatggcccaatgtacctgagcagctaattaaaggtgataaatttctgaaatgggaagagggttcttcaagttttactgaaatcctcctcagagttgatcccaagggatatttcttgtactggaaaattgaaggaaaggaagactctcaacttttggatttggcttatctacgagatattcgatgtgcaaaatatgcaaaacctccaaaggacaagaaagtgaaagatgcaggcacaaattttggttcatcaaacataccccttcaagacaaatgtgttacaatttgtcatggctataactacatagacttggactggatacatttggttgcagaaaattcttctgtggcagcgaaatgggcagaagaagtgttcagctatgcctacaatttgttgtccctcaacaaaaaccaattgggcgaatgggaaaaactctatttccgactgacaacggttgaaatggaaaaaaataaaatccccgtaaaaagtattcaaaaatgtctttccaaagacaaagatgacagaactcgagttgcaaaagcaattgagaaaattggttggccttctgggaagaatgatgccattgagattaaagctttcgattttgataccttctttaagttttacctttccctccttgaacgatctgaaattgagggtatcttcaaagagctatcccagaataaaggcaacatcacaactgttatgtttcgtgatttcttgaatgatatgcagagacatccaagtttgcataagacacttttccctctttacaccgattcgcagtgtgacgcattaattaacgaatatgaaagtgctgtcaacaaaaagggaaaaaaaaaaggtcaacttaccaaggaaggcttgctctatttccttatgtgcgaagaaaataatctcacccccatgcatcgattggatttgggtgccaacatgaagctgtccctagcagcttattatattaattcatcccacaacacttatttgaccggtcatcaattgactggcaaatcttcggttgaaatttaccgccaagtccttttaactggatgtcgttgtttggaattggattgttgggatggaaaagatggagaacccatcattactcacggtttcactatgtgtacagaagttcagttcaaggatgtggtgcacgcaattgcggagtgcgcctttaaagtgtctgaatacccagtcatcttatcatttgaaaaccattgttctgtacctcaacagaagttactcgcacaatattgtcatgaggctttcggagaattgcttctcgacaatcctatcgatggtcatcctctcaaacctggtgttccattaccaacaccttatgacctgagaaagaaaattcttatcaagaacaagaaaattcacaaaggtgccggagatgatgatgaattggctggactgacagatgaagagaaaaagaaaattgaaaaggaaaagaaagatgccggaacagcagccaaagaagctgaagcagccgaagaaatgtcagcccttgtgaattacattcagccagttcatttcacgacatttgaacaagcccaaaagaaggacagacattatgaaatgtcttcaatggtagaaacccaggctttgaataaactgaaagacaatcctgaggactttgtagattataacaagaaacaacttaccaggatttaccctaagggtaccagggtcgactccagtaactatgtaccccagatctattggaacgccggttgtcaattggtagccttaaacttccaatgctttgacgttgccatgtgcgtcaatttgggtgtatttgaatataacggatgttcgggttatttactcaaacctgaatttatgagaaaactggacaagagatttgaccctttcacagaatccactgtcgatggtgttgtagcaggaactattgaaattaagatcatttccgctcagttcttatccgataagcagatttcatcttatgttgaagttgagatgtatggtctgccaaccgatacagtgagaaagaagtttaaaacaaaaactgttaataacaacggcatggatccttactataacgagaacgctttcgtattcaagaaggttgtattgcctgatttagccgttgtccgtatcattgtaaatgaagatggtggcaaattcattggacatcgtctcatgccactggatggtatcaaaccaggttaccgacatattccccttcgaaatgagagtaacagacctctcggtttggcttcagtgtttgcacacattgttgccaaggattacgtatcagatgcattcgcagattttgctgatgctctgctcaatccaatcgcttatcaatctgcacaagatgcaagagctgctgccttgtgcgcttttgaagatgatccagacgcagccttaaatgctgctaaaccagtaaaaggaaagagccccaaggctggcaagaaggcatgggcaggagcaggaaagaaggtcagtcagggtaatattgccaaatctgcttttggaggagccaaaaaagctgcagccgctggaaaagcagctacgcctgcaagtccacccccacccccagctgcagctgattctgaatttgttcaaaattcaaagatgaaggaggaatcggctgtcgctctacccaaattggacgccttaaaatcaaacaaagcttatgccaaaattatttcaaaacgagacaaagaagttgattcaatcaagaagaaaaatgataaggctcagtcaaatatgaagacaaagatgaaggcagaagaaaagaaaatgaaagattcacactcgaaagccgagaaaaaagctgaaaagagtggcaaagaacaacatgatcaattggtgaaagagaatcaagataagtttaaccaattacataaagaaaacatagacaagtacttggctacatgtagcgagcacttcaatgccgaatctgagatttgcaagaagtatattgattccctgaacgactgtctgaagggtgtgataacgtcaacccaagaagatctcaagaaaaaattgcagacgatccacgacaaagaagttgaatcgatgaacaaagaattgaacaagaaatcaaaggaagaacagaaaaatttggggaaagaaactaaagacaaagaagaattggcaagaaaaaaacgtgaattaagtaagaaacttattgacggaattgtcgctgagagaaacaagttgaaagctctcaaagaaagacaagaaaaagttttagataaaaatgttgaagagttgaccaaggagtatgagaaggagaaagcaaatgcggagaataaattgaaggaagatattgacgcaaaactgaagaaggtgaaagaagaatggtcatgaataattattttgctcgtctcttctctcttgtgttctaggcaaaaaggaaactaaaacaagaatttgcggctaaacgagacgccctgaaagccgattattcaatcaagaaagtcaacagcagagattacatcacggccttgtaaccgatacttatacaaattagcactaaacaaaaaacttttaaaaaaacaaaaaaaaaaaa

SEQ ID NO: 9892 - protein, 1127 aa, Loligo pealeii
MAGVETAVRQIELKWPNVPEQLIKGDKFLKWEEGSSSFTEILLRVDPKGYFLYWKIEGKEDSQLLDLAYLRDIRCAKYAKPPKDKKVKDAGTNFGSSNIPLQDKCVTICHGYNYIDLDWIHLVAENSSVAAKWAEEVFSYAYNLLSLNKNQLGEWEKLYFRLTTVEMEKNKIPVKSIQKCLSKDKDDRTRVAKAIEKIGWPSGKNDAIEIKAFDFDTFFKFYLSLLERSEIEGIFKELSQNKGNITTVMFRDFLNDMQRHPSLHKTLFPLYTDSQCDALINEYESAVNKKGKKKGQLTKEGLLYFLMCEENNLTPMHRLDLGANMKLSLAAYYINSSHNTYLTGHQLTGKSSVEIYRQVLLTGCRCLELDCWDGKDGEPIITHGFTMCTEVQFKDVVHAIAECAFKVSEYPVILSFENHCSVPQQKLLAQYCHEAFGELLLDNPIDGHPLKPGVPLPTPYDLRKKILIKNKKIHKGAGDDDELAGLTDEEKKKIEKEKKDAGTAAKEAEAAEEMSALVNYIQPVHFTTFEQAQKKDRHYEMSSMVETQALNKLKDNPEDFVDYNKKQLTRIYPKGTRVDSSNYVPQIYWNAGCQLVALNFQCFDVAMCVNLGVFEYNGCSGYLLKPEFMRKLDKRFDPFTESTVDGVVAGTIEIKIISAQFLSDKQISSYVEVEMYGLPTDTVRKKFKTKTVNNNGMDPYYNENAFVFKKVVLPDLAVVRIIVNEDGGKFIGHRLMPLDGIKPGYRHIPLRNESNRPLGLASVFAHIVAKDYVSDAFADFADALLNPIAYQSAQDARAAALCAFEDDPDAALNAAKPVKGKSPKAGKKAWAGAGKKVSQGNIAKSAFGGAKKAAAAGKAATPASPPPPPAAADSEFVQNSKMKEESAVALPKLDALKSNKAYAKIISKRDKEVDSIKKKNDKAQSNMKTKMKAEEKKMKDSHSKAEKKAEKSGKEQHDQLVKENQDKFNQLHKENIDKYLATCSEHFNAESEICKKYIDSLNDCLKGVITSTQEDLKKKLQTIHDKEVESMNKELNKKSKEEQKNLGKETKDKEELARKKRELSKKLIDGIVAERNKLKALKERQEKVLDKNVEELTKEYEKEKANAENKLKEDIDAKLKKVKEEWS

SEQ ID NO: 9893 - DNA, 2354 bp, Trypanosoma cruzi
  CDS (103)..(2280)
aaattaggcatagaagcggaaaagagtgaagcgaaaaaggaaaggaaataggtgaagcgggaaaacaacaacaacaacaacagatttcgaggagggtttacaatgggtctttgtacgagtaagtgtaacgttgaggataagatgtgccgctatgctccagccgctgaaagacttgtagatgatttctttgcgcaggataacgaatttttgggtgatgcaggggcattttttgcatgcatgtggggagcttcgcgtgatatcctactttgcagtggggatgaagcaactgcgttccttcgtcgcgcgtgtttttcaaatccaaaatcagaagaggcactaaatttgtatctttcttcgagtaattttggtcgcgctttgtgggatttgaatcgtgcaaaatttatgatgatatggatgaagtacgacgctgataacagtggggatattagtctccgtgagttgggcaaacttgtaaaggggttgaattttcctgccgatctttccaagcaacttatagctgcggtaaaggctgccggtggaattgtaaattacgcctttttggagaaggaatattttttgctcacgagactgaaagagcttgaatacgtttttacaggtgttgccggcccagttagggagactataacaagagatgagtttaagtcttttcttaggaattatcagggggaggaattgaatggggagcgcgtaaaggagattttggattatgtatgttgtatgaaaaccggcgaagtctatttcaccaattttcttaaatttttggaggataatcgtttctgtagcattgtggatgaagaaaaagtcagcaaggtataccaagatatgaatcagccaatttgtaattattttatcaattcctctcacaatacttacttgaccggcgatcaattgaccagcaattcatcggcagacatgtatcgaaaggctcttttggatggatgtcgttgtgtggagttggattgctgggatggctttgccggtgagccgattgtttaccatggtcacacacggacatcgaagatatcatttctttcctgcatcaaagtgatcaaggagtatgcctttaaggcttctgagtatccagttattttatccattgaggttcatacaagttccgctcaagccgatcgaatggcagagattatgtgtgatacatttggggatatgctctttcaaagtccgtgggctccagctgagcccacgacatttttgttttccccagagaaccttaagagaaaaattcttgtgaagagcaaacgagttgcgacatcgtcggccatctctgacgcggagataacggaaaatgaggaagaggaggaaaacgatgaggaagaggagacagagggagaggagaaggaattgacaacgtcggggccaaatccattgtacagacagtttaaagaggagaaaaagaaggaggagaaaaagaaggagaagaaaaaaaagataaaggttgctttggaaaaattatcacgcgttgtttctattgagtcggccggatttaaaggcacttctgatatgtcatatctagaaaaaagacaaccgtaccagtgtacttcctttgttgaatccaaagcgaaaaaaattgccgtgtccaatgcgatggaatttaaattaattaaccaacactgccttagtcgcatataccctgcaggatcccgtgttggcagcagcaattacaatccccaattgttttggaattgcggctgtcaaatcgtggcactcaattggcaatcgacccacacatatgcatggaggcttaacaagggatttttctctgacaatggaaattgcggttatgttttgaagcctgagagcgtgcgatcaagtgctgcttcgcgcaacggctcccaggtgcgatcactgaatttggagattatttctggattttgtctccccaagccgaaacgttccaacaagggcgaaattgtggaccctttcattacgtgttttattgagggcccagacggtaatagtgaccgaaagacatcgggaacaattcgcaacaatgggttccacccggtatggcggggcaagggcttgggcactgagttctcgtgggatgtgaaggactgggatctttcaacacttgttgtgcaagtttatgacgaagacaaaaaaactcgcgacgactttctagcagagtgcattttaccgttgcgtgtgttaaaagctggtattcgacaaattccattgcatgatatcaacgggaattccatctttggttcatttctcacatgctctcttactttttcttgacgtcatttgcatggagcgtgaatatatatatatatatatatatatttatttatttggggaggatataggggaca

SEQ ID NO: 9894 - protein, 725 aa, Trypanosoma cruzi
MGLCTSKCNVEDKMCRYAPAAERLVDDFFAQDNEFLGDAGAFFACMWGASRDILLCSGDEATAFLRRACFSNPKSEEALNLYLSSSNFGRALWDLNRAKFMMIWMKYDADNSGDISLRELGKLVKGLNFPADLSKQLIAAVKAAGGIVNYAFLEKEYFLLTRLKELEYVFTGVAGPVRETITRDEFKSFLRNYQGEELNGERVKEILDYVCCMKTGEVYFTNFLKFLEDNRFCSIVDEEKVSKVYQDMNQPICNYFINSSHNTYLTGDQLTSNSSADMYRKALLDGCRCVELDCWDGFAGEPIVYHGHTRTSKISFLSCIKVIKEYAFKASEYPVILSIEVHTSSAQADRMAEIMCDTFGDMLFQSPWAPAEPTTFLFSPENLKRKILVKSKRVATSSAISDAEITENEEEEENDEEEETEGEEKELTTSGPNPLYRQFKEEKKKEEKKKEKKKKIKVALEKLSRVVSIESAGFKGTSDMSYLEKRQPYQCTSFVESKAKKIAVSNAMEFKLINQHCLSRIYPAGSRVGSSNYNPQLFWNCGCQIVALNWQSTHTYAWRLNKGFFSDNGNCGYVLKPESVRSSAASRNGSQVRSLNLEIISGFCLPKPKRSNKGEIVDPFITCFIEGPDGNSDRKTSGTIRNNGFHPVWRGKGLGTEFSWDVKDWDLSTLVVQVYDEDKKTRDDFLAECILPLRVLKAGIRQIPLHDINGNSIFGSFLTCSLTFS

SEQ ID NO: 9895 - DNA, 3351 bp, Homarus americanus
  CDS (1)..(3351)
atgaccaagtactttgacttcgtgtggaggaaggaagtggattcgcgcctacaggaaggtgctgtgattgaccggtggactgaggacaaggaaagttacgactatgaacccaactgtaccttcaaggtggatgagtacggcttctttgtcttctggaagagtgacggcagagaaggaaacgtggctgaattgtctcaggtttctgacatccgtagaggaacattacccagggatagcaagctgttggataagttattaaacaaatttggccaagatgtggaggacaagatgctggccatttgttcggggctggattatgtcagcatcaactatatcaacattgtctgcaaaacaaaagatgaggcagatgcatggttagaaggtcttcgaaatatatttcacaacatcagggctaataacatatgtccaatgatgtgcttaaaaaagcattggatgcgccttgggatgatggtggacagtggtggtaagatccctgtaaaacacattgtccgaacctttgcctccggcaagacagaaaagatggtctattcatgcctagaagaaatgggtctgccttctggaaagggtgacagcatagaaaaagatgccttcactttcgagaagttctacaaactttaccatactatctgtcctaggactgatattgatgaactctatacaagcgtcacaaaaggggaacacgtcagtctagcacagttggtcaactttatgaatgagaaacagcgagacccgagcctcaatgaaattttgtatccattatatgatgagaagcggtgcatgcagatcatcaaagcccatgagcctaacgaggagaacattgaaaataagagatttagcaaagacggtttgttggcatacctcatgtctgatgagaacgaccctgtgtttctggatcgtctggacatctaccaagatatggaccaaccactctcccattactacatcaactcctctcacaacacctacctctctggaagacaatttggtggcaagtccacagcagaaatgtacagacagacccttcttgctggctgcaggtgtgtggaacttgactgttgggatggtaagggtgaagacgaggagcctatcatcactcacggaaaggctatgtgcactgatatcctcttcaaagaagccatcattgctattcgagactgcgcctttgttacctctgactatccagttattctgtcctttgaaaatcattgttgcaagaaacagcagtacaagttggccaaatactgtgatgagtattttggagatctgctttcaaaggaggccctcccagacaggcctttggttcctggtcatcaccttccatcacctaatcaattaaagaggaaaattctcattaagaacaaacgcttgaagccagaagtggagaaacaagagttagaattgttctggaagggtcaactatatcttgtggatgatgatgatgcaagggaggatgcttctcaagccaacccacaaccaaaggaacctaagagtaactcgtgcactaccatcaccacccctgtgtcgcagccctcgctagaagatgataagcccctgacggccgaagagcgagccttcctctactaccagtatacaggcgccaccacccacgtccaccctgtcctctcctcctacgtcaactactgccagccggtcaatttccagggttttgatgtggcaaaagagaaaaatgtccaccacaatatgtcctccttctcggaaactatggggttaggctacctcaagactcaggcaattgaatttgtcaattacaacaaacggcaaatgtccaaaatctaccccaagggagctagggtcgactcttccaactatatgcctcatgtgttttggaatgcaggttgccagatggtgtccttaaatttccaaacttcagatcttcccatgcagctgaatcagggcaagtttgagtacaatgggaattgtggatatctcctcaaacctgatttcatgagacgtactgacaagacttttgatccctttgctgagtccccagtggatggtgtgattgcagcacaggtttctgtgtcggtgattgctggtcagttcttatcagacaaaaaggttggaacttatgttgaagtggacatgtatggcttgcctactgacaccatcagaaaagagtttaggacgcgttatgattccctggaaatggccttaatccccagtataatgaagaaccttcctcctttcctaagttgtgtttgcctgacttggctgtgctgcgaattggtgtgttttatgaaaatagaaaaatactgggccaaagaattctgcctttggatggtctgcatgcaggcaggctatcggcacatctctctacgtactgaagggaacttccccatgtcactacctatgttgttttgcaatattgaattgaagatctatgttcctgatggtcttggcgacttgatggatgccctttcggaccctcgagccttcttaagtgcccaagaaaagcgtgaggaacagatgaaggccatgggtattgaggcttcagacattgataccaaggcactcaagggaggaggaggtaaagctggaggtgccaagccagcagcgggtgccaaggctggagcatgtggcaaacctggggcatgtgctggtggaaagaagaagaagaaattcgttgaatatgaacccatcaaccttgaaacacttagatcacaaaagaatttcctgaaagcaaccaagaagcagcagaaggaactggaaagtatgagaaaaaaacacatgaaggagcgtttgtctattcaaaaagcacagtgcagtgccattgagaaactggcaaagggtaaaaaagatgtaatggatgatccaaaaatcaagtcattagtgtcagaacaaatgaaacagtggtctgagatgatggagaagcaccgaaaggaggaatgggaaatgttgaaagaacatcttaagagtcaggaggatatattaaagaagctcatggaagaagaacaagcagggcaaataaagaagatggaagcaaaacatgaacaggacatgaaggatatgaaggctcagcaggctaaggcggctatggaaacagctaaagatgtcaatcaagacaagacccttaaaactaaagctgatcgtgatcgtcgtctcaaggagaaaaatcaaaacaacaccaagagatttattgaagaacgtaaaatttctgctatgaaacaaggaaagcagaaagagaagcttaagaaggttcatgaccaacagatgacagagcttaccaaagatattcaaatggccatacagttctatgagaacactgaggcagagtacaagatgtggaataagatggaattcttctgttga

SEQ ID NO: 9896 - protein, 1116 aa, Homarus americanus
MTKYFDFVWRKEVDSRLQEGAVIDRWTEDKESYDYEPNCTFKVDEYGFFVFWKSDGREGNVAELSQVSDIRRGTLPRDSKLLDKLLNKFGQDVEDKMLAICSGLDYVSINYINIVCKTKDEADAWLEGLRNIFHNIRANNICPMMCLKKHWMRLGMMVDSGGKIPVKHIVRTFASGKTEKMVYSCLEEMGLPSGKGDSIEKDAFTFEKFYKLYHTICPRTDIDELYTSVTKGEHVSLAQLVNFMNEKQRDPSLNEILYPLYDEKRCMQIIKAHEPNEENIENKRFSKDGLLAYLMSDENDPVFLDRLDIYQDMDQPLSHYYINSSHNTYLSGRQFGGKSTAEMYRQTLLAGCRCVELDCWDGKGEDEEPIITHGKAMCTDILFKEAIIAIRDCAFVTSDYPVILSFENHCCKKQQYKLAKYCDEYFGDLLSKEALPDRPLVPGHHLPSPNQLKRKILIKNKRLKPEVEKQELELFWKGQLYLVDDDDAREDASQANPQPKEPKSNSCTTITTPVSQPSLEDDKPLTAEERAFLYYQYTGATTHVHPVLSSYVNYCQPVNFQGFDVAKEKNVHHNMSSFSETMGLGYLKTQAIEFVNYNKRQMSKIYPKGARVDSSNYMPHVFWNAGCQMVSLNFQTSDLPMQLNQGKFEYNGNCGYLLKPDFMRRTDKTFDPFAESPVDGVIAAQVSVSVIAGQFLSDKKVGTYVEVDMYGLPTDTIRKEFRTRYDSLEMALIPSIMKNLPPFLSCVCLTWLCCELVCFMKIEKYWAKEFCLWMVCMQAGYRHISLRTEGNFPMSLPMLFCNIELKIYVPDGLGDLMDALSDPRAFLSAQEKREEQMKAMGIEASDIDTKALKGGGGKAGGAKPAAGAKAGACGKPGACAGGKKKKKFVEYEPINLETLRSQKNFLKATKKQQKELESMRKKHMKERLSIQKAQCSAIEKLAKGKKDVMDDPKIKSLVSEQMKQWSEMMEKHRKEEWEMLKEHLKSQEDILKKLMEEEQAGQIKKMEAKHEQDMKDMKAQQAKAAMETAKDVNQDKTLKTKADRDRRLKEKNQNNTKRFIEERKISAMKQGKQKEKLKKVHDQQMTELTKDIQMAIQFYENTEAEYKMWNKMEFFC

SEQ ID NO: 9897 - DNA, 6705 bp, Homo sapiens
  CDS (4)..(3654)
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 9898 - protein, 1216 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 9899 - DNA, 3797 bp, Mus musculus
  CDS (4)..(3654)
cagatggctggggctcagcccggagtgcacgccttgcaactcaagcccgtgtgcgtgtccgacagcctcaagaagggcaccaaactcgtcaagtgggatgatgactccactattgttactccaactattttgaggactgatcctcagggatttttcttttactggacagaccagaataaggagacggagctgttagatctcagccttgtcaaggatgccaggtgtgggaagcacgccgaagctcccaaggaccccaagttgcgtgaacttctggatgttgggaacatcggacacttggaacagcgcatgataactgtggtgtatggaccagacctggcgaacatttcccacttgaatcttgtggcttttcaagaggaagtagccaaggaatggacaaatgaggttttcagcttggcaacaaacctgctggctcagaacatgtccagggacgcatttctggagaaagcatatactaagctcaagctccaggtcaccccagaagggcgcattcctcttaaaaacatctatcgattgttctcagcagaccggaagcgcgttgaaactgcactagaggcttgtagtcttccatcttcgaggaatgactccattccccaagaggacttcactccagatgtatacagagttttcctgaacaatctctgtccccgacctgaaattgataacatcttttctgaatttggtgccaaaagcaaaccgtacctgacggttgatcagatgatggattttatcaaccttaagcagagagatccccggctcaatgaaatcctttacccacctctgaagcaggagcaggtccaagtgttgattgagaaatatgagcccaacagcagcctcgccaagaaagggcagatgtcagtggatggattcatgcgctacctgagcggagaagaaaatggagtcgtttcacctgagaaactggatttgaacgaagacatgtctcagcccctgtctcactatttcatcaattcctcgcacaacacctacctcacagctggccagttggctgggaactcgtctgtagagatgtatcgccaggtgcttctgtctggatgtcgctgtgtggagctggactgctggaagggaaggaccgctgaggaagagcctgtcattacccatggattcaccatgacaacagaaatatccttcaaggaagtcatagaagccatcgcagagtgtgcgttcaagacgtctcctttccccatcctcctttcctttgagaaccacgtggattccccgaagcaacaagccaagatggccgagtattgccgattaatctttggtgatgccctcctgatggaaccactggaaaaatacccactggaatctggggtacctcttccaagccctatggatttaatgtataaaatcttggtgaaaaacaagaagaagtcgcacaagtcgtcagagggaagtggtaagaagaagctttcagagcaagcttccaacacctacagcgactcctccagtgtgttcgagccttcgtctccaggagctggggaagcagatacggagagtgatgacgatgacgacgacgatgactgtaaaaagtcttccatggatgaggggacagctggcagcgaagccatggccacagaagagatgtctaacctggtgaactatattcagcctgtcaagtttgagtcctttgaaatttcaaaaaaaagaaataaaagctttgaaatgtcttccttcgtggaaaccaaaggacttgaacaacttacaaagtctccggtggaatttgtagaatacaacaagatgcaacttagcaggatatatcccaagggaacacgtgtggattcatccaactacatgcctcaactcttctggaatgctggctgtcagatgatggcgctcaacttccagacagtggatctagctatgcagataaacatgggcatgtatgagtacaatgggaagagcggctataggctgaagccagagttcatgaggaggccggacaagcattttgatccatttactgaaggaatcgtagatgggatagtggccaacactctatctgttaagattatttcaggtcagttcctctctgataagaaagttgggacttatgtggaagtggatatgtttggcttgcctgtggacacaaggaggaaggcatttacaaccaagacatcccaaggaaatgctgtaaaccctgtctgggaagaagaacctattgtattcaaaaaggtagttctaccttctctggcctgtttgaggatagcagcatatgaagagggaggcaaatttattggccaccggatattgcctgtgcaggctattcggccaggctatcactacatctgcctgcggaatgagaggaaccagcccctgacgctgccagctgtctttgtctacatagaagacaaagattatgtcccagacacgtatgcagatgtaatcgaagcactatcaaacccaatccgatatgtcaatctgatggaacagagagctaagcagctggctgcgttgaccctggaggatgaagaggaagtaaagaaggaggctgaccctggagaaacatcttccgaggctccaagcgaaaccaggacaacgccagcagagaatggggtgaatcacaccgcatcccttgcacccaagccgccttcccaggctccacacagccagcctgctccagggtctgtgaaggcacctgccaaaacagaagatctgatccagagcgtgttaacagaagtagaggcgcaaaccatcgaagagctcaagcaacagaaatcgttcgtgaaacttcataagaaacactacaaagaaatgaaagacctggtgaagagacaccacaagaaaaccacggagctcatcaaggagcacacgaccaagtacaacgagattcagattgactacttgagaaggagggcagccttggagaagtccgccaaaaaggacagcaagaagaaatctgaacccagcagccctgaccacggctcatcagccattgagcaagacctcgctgccctggatgcagaaatgactcagaagttgatagacttgaaagacaagcaacaacagcagctgcttaatcttcggcaagagcagtattacagcgagaagtaccaaaagcgagaacacattaaactgcttattcagaagttgacagatgttgcagaagagtgtcagaacaatcagttaaagaagctgaaggaaatctgcgagaaagagaagaaggaattaaagaagaaaatggataagaagaggcaagagaagataacagaagccacgtccaaagacaaaagccagatggaagaggagaagacagagatgatccgatcgtacatccaggaggtggtgcagtacatcaagaggttagaggaagcacaaagtaaaagacaagaaaaactcgtggagaaacacaatgagatccgccagcagatcctcgatgagaagcccaagctgcagacggagctggagcaagaataccaagacaagttcaaaaggctgcccctggagattctggagtttgtacaggaagccatgaaagggaagatcagcgaggacagcaatcacggctctgcccctccctctctggcctcagatgctgcaaaggtgaacctcaagtctccctccagtgaggagatagaaagagagaacccaggaagagagtttgatactcctctgtgatgcccctgtcaggccttccagacatgcacagctgcttgagctccatgggacctctaatgacaaatatcactgactgggccatcttcctgagaaatatcccttagcctgaaatccacaccaaagggagacttccagaaggatcc

SEQ ID NO: 9900 - protein, 1216 aa, Mus musculus
MAGAQPGVHALQLKPVCVSDSLKKGTKLVKWDDDSTIVTPTILRTDPQGFFFYWTDQNKETELLDLSLVKDARCGKHAEAPKDPKLRELLDVGNIGHLEQRMITVVYGPDLANISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPDVYRVFLNNLCPRPEIDNIFSEFGAKSKPYLTVDQMMDFINLKQRDPRLNEILYPPLKQEQVQVLIEKYEPNSSLAKKGQMSVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMMALNFQTVDLAMQINMGMYEYNGKSGYRLKPEFMRRPDKHFDPFTEGIVDGIVANTLSVKIISGQFLSDKKVGTYVEVDMFGLPVDTRRKAFTTKTSQGNAVNPVWEEEPIVFKKVVLPSLACLRIAAYEEGGKFIGHRILPVQAIRPGYHYICLRNERNQPLTLPAVFVYIEDKDYVPDTYADVIEALSNPIRYVNLMEQRAKQLAALTLEDEEEVKKEADPGETSSEAPSETRTTPAENGVNHTASLAPKPPSQAPHSQPAPGSVKAPAKTEDLIQSVLTEVEAQTIEELKQQKSFVKLHKKHYKEMKDLVKRHHKKTTELIKEHTTKYNEIQIDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKRQEKITEATSKDKSQMEEEKTEMIRSYIQEVVQYIKRLEEAQSKRQEKLVEKHNEIRQQILDEKPKLQTELEQEYQDKFKRLPLEILEFVQEAMKGKISEDSNHGSAPPSLASDAAKVNLKSPSSEEIERENPGREFDTPL

SEQ ID NO: 9901 - DNA, 3999 bp, Rattus norvegicus
  CDS (98)..(3649)
cccagcctagcttcccctccagttcccctccttccttctctcctcctgtccactggagaggtttgcccaacctctgcaaagagggacaattgacatcatgtctttgctcaaccctgtcctgttgccccctaaggtgaaggcatatctgagccaaggggagcgcttcatcaagtgggacgatgaaacctcaatagcctcccctgttatccttcgggtggatcccaagggctattacttatactggacacatcaaagtaaggagatggaatttctggatgtcacgagcatccgagacactcgctttgggaagtttgccaagatacccaagagccagaaactccgggaggtattcaacatggactttccagacaaccacttcctgctgaaaacattcacagtggtatccggcccggacatggtgggcctcaccttccacaattttgtctcttacaaggagaacgtaggcaaggattgggctgaggatgtactggctctggccaaacacccaatgacagccaatgcttctcgaagcacattcctagacaagatcctggtgaagcttaaaatgcagctgagccctgaagggaagatccctgtgaagaattttttccagatgtttcctgccgatcgcaaacgtgtagaagctgccctcagtgcctgtcaccttgcaaaaggcaagaatgatgctatcaatcccgaggacttcccagaatctgtgtacaagagcttcctcatgagcctctgtcctcggccagaaattgatgagatcttcacttcttatcatgctaaagccaaaccctacatgaccaaggagcacctgaccaaattcatcaatcagaagcaacgagaccctcgactcaattccttgctgttcccaccagcccggcctgagcaggtgcaggcgctcattgacaagtacgagcccagcggcatcaatgtgcagaggggccaactgtcaccagagggcatggtctggtttctctgtggaccagagaacagtgtcctggcccatgatactctgcggatccaccaagacatgacacagcctctgaatcactacttcatcaactcctcacacaacacttacctgacagctggccagttttcaggcccttcctcggctgagatgtaccgccaggtgctgctatctggctgccgttgtgtagaattagattgttggaaaggaaagccccccgacgaagaacccatcatcacccacggcttcactatgaccacagatatcttgttcaaggaagcagtcgaagccattgcagaaagtgcctttaagacctccccatatcctgtcatcctgtcatttgaaaaccacgtggactcaccccgccaacaggctaagatggccgagtactgccggaccatgtttggagagaccttgctcacagagcccctggaaaactttcctctgaaacctggcatgcctctgcctagccctgaggacctccggggcaagatcctcattaagaataagaagaaccagttttctgggccagcatcccccaacaagaagcctgatggggtgtctgagggcggcttcccatctagtgtccctgtagaagaggacacggggtggactgctgaggaccggactgaggtggaggagggagaggaggaggaggaggtggaagaagaggaagaggaggagtcaggaaacctggatgaagaagaaattaagaagatgcagtctgatgagggcacagcaggcttggaggtgacagcttatgaggaaatgtccagccttgtcaattacatccagcccaccaagtttatctccttcgagttctctgcacagaagaacaggagttaccttgtctcttccttcacggagctcaaggcctacgagctgctctccaaggcctccatgcagtttgtggactataataaacgccagatgagccgcgtgtaccccaagggcacgcgcatggactcttccaactacatgccccagatgttctggaatgccggatgtcagatggttgccctcaatttccagacaatggatctgcccatgcagcagaacatggcactgtttgagttcaacgggcagagtggctacctcctaaagcacgagttcatgcgcaggcaggacaagcagttcaaccccttctcggtggaccgcattgatgtggtggttgccactaccctttccattacggtcatctctgggcagttcctgtcagagcgcagtgtgcgcacctatgtggaagtagaactgtttggcctcccaggggaccccaagaggcgctatcgtaccaagctgtcacctactgctaactccatcaatcctgtctggaaggaggaacccttcatttttgagaagatcttggtgcctgagctggcctccctcaggatagctgtaatggaagaaggcggcaaatttattggacatcgcatcatccccatcaatgccttacattccggataccaccatctgtgcctgcgcagtgagagcaacatgcctctcaccatgcctgctctcttcgtcttcctggagatgaaggactatgtacctgacacgtgggcagatcttactgtggctcttgccaaccccatcaagtacttcagtgcccatgataagaagtctgtgaagctcaaagaagtgacaggaagtctgcctgagaagctcttctctgggattcctgttgccagccagtccaacggggctccagtctccgcaggcaatgggtcaacagcgcctgggaccaaggccaaggaggaagctacgaaggaagtggcagagccacagaccactagcttggaagagctgcgggagctgaagggcgtggtgaagctgcagcggagacatgagaaggagcttcgagagctggagcggcgtggagcccggcgctgggaggagctgctgcagcgtggcgctgcacagctagcggagctccaggacccagcagcaagctgcaagctccgcccgggcaagggctcccgcaagaagaggatcgtgccctgtgaggagaccatcgtggtgcctagggaggtcctcgagggaccggacccccgcgtgcaggatctgaaggacaggctggagcaggagctgcagcagcaaggcgaggagcagtaccgctctgtcctcaagcgtaaggagcagcacgtgaccgagcaaatcgccaagatgatggagctggccagagagaaacaggctgctgaactcaagagcttcaaggagacctcggaaactgacaccaaagagatgaagaaaaaactggaggccaaaaggctggagcggatccaagccatgaccaaagtcaccacagacaaggtggcccaggagaggctcaagagagaaattaacaactcccacatccaggaggtggtgcaggctgtcaagcagatgacagagaccctggagcgtcaccaggagaagctggaagagaagcagacagcctgcctggagcagatccaggcaatggaaaagcagttccaggagaaggcgctggcagagtatgaggccaagatgaagggcctggaggctgaagtaaaggagtcaatgcgggcttgcttcaaggcctgcttccccacggaagcagaagagaagcctgagaggccctgtgaggcctctgaggagtcgtgtccacaggagccacttgtgaacaagacagacactcaggagagccgcctctgaatgccagcatctcactccgacattttagcaaggatatccacgcctttctcctcgggagaaaaggaccttattactctggggctgtgggagcctggggctgcttggctgccgcagccccgcttctcagccacataaggcagaaatgggagaccattggggcaagagccccatggaacccgagtcttttctaagctggcttcttctgtcgtcccacctgtagtgccatatacttattgaaggcaaaggaatatggaccaagagagaggaaattgggtcctggtctccctctgcctttcctaacatacatgcaggggctctcacttggagctccgttcctttcctggatgctt

SEQ ID NO: 9902 - protein, 1183 aa, Rattus norvegicus
MSLLNPVLLPPKVKAYLSQGERFIKWDDETSIASPVILRVDPKGYYLYWTHQSKEMEFLDVTSIRDTRFGKFAKIPKSQKLREVFNMDFPDNHFLLKTFTVVSGPDMVGLTFHNFVSYKENVGKDWAEDVLALAKHPMTANASRSTFLDKILVKLKMQLSPEGKIPVKNFFQMFPADRKRVEAALSACHLAKGKNDAINPEDFPESVYKSFLMSLCPRPEIDEIFTSYHAKAKPYMTKEHLTKFINQKQRDPRLNSLLFPPARPEQVQALIDKYEPSGINVQRGQLSPEGMVWFLCGPENSVLAHDTLRIHQDMTQPLNHYFINSSHNTYLTAGQFSGPSSAEMYRQVLLSGCRCVELDCWKGKPPDEEPIITHGFTMTTDILFKEAVEAIAESAFKTSPYPVILSFENHVDSPRQQAKMAEYCRTMFGETLLTEPLENFPLKPGMPLPSPEDLRGKILIKNKKNQFSGPASPNKKPDGVSEGGFPSSVPVEEDTGWTAEDRTEVEEGEEEEEVEEEEEEESGNLDEEEIKKMQSDEGTAGLEVTAYEEMSSLVNYIQPTKFISFEFSAQKNRSYLVSSFTELKAYELLSKASMQFVDYNKRQMSRVYPKGTRMDSSNYMPQMFWNAGCQMVALNFQTMDLPMQQNMALFEFNGQSGYLLKHEFMRRQDKQFNPFSVDRIDVVVATTLSITVISGQFLSERSVRTYVEVELFGLPGDPKRRYRTKLSPTANSINPVWKEEPFIFEKILVPELASLRIAVMEEGGKFIGHRIIPINALHSGYHHLCLRSESNMPLTMPALFVFLEMKDYVPDTWADLTVALANPIKYFSAHDKKSVKLKEVTGSLPEKLFSGIPVASQSNGAPVSAGNGSTAPGTKAKEEATKEVAEPQTTSLEELRELKGVVKLQRRHEKELRELERRGARRWEELLQRGAAQLAELQDPAASCKLRPGKGSRKKRIVPCEETIVVPREVLEGPDPRVQDLKDRLEQELQQQGEEQYRSVLKRKEQHVTEQIAKMMELAREKQAAELKSFKETSETDTKEMKKKLEAKRLERIQAMTKVTTDKVAQERLKREINNSHIQEVVQAVKQMTETLERHQEKLEEKQTACLEQIQAMEKQFQEKALAEYEAKMKGLEAEVKESMRACFKACFPTEAEEKPERPCEASEESCPQEPLVNKTDTQESRL

SEQ ID NO: 9903 - DNA, 4258 bp, Homo sapiens
  CDS (148)..(3945)
cggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcgtgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacgtcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgccgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggctatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttgaaaaaaaaaaaaaaaaaa

SEQ ID NO: 9904 - protein, 1265 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLRDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKQQGYPPVEFATDRVEELFEWFQSIREITWKIDTKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQLQLYQEKCNKRLREKRVSNSKFYS

SEQ ID NO: 9905 - DNA, 5751 bp, Drosophila melanogaster
  CDS (278)..(3988)
ctggcttatcttatctgcttctgtggtattttttgggtacaattcggatattgcattgttaatctcggtttattgagtcccagtggccgtgatttgtgcatcgaccagttggaagagagggagcagttgatctgcgaatagttccacgcgctggcacccatagtttgtatgcattgcacttagtctggcgatcggttggcgaggcgagaaacaacctgtggcagccagcggatgagaactggattcgataggaatcgacacgtttggaccggacaggatgagctgctttagtgcgatgagtgccccgctgctgggcgagatggagcagaccattggtatgctggagcgcggcaccatcgtgaccaagttgtatgggaaacagcgtcgtccggatcgccgccacctgatgctcatacgagagacacgacagctgctctgggcaacggtggccacacaaacgccacgcaccgactacgagggcgccatacagctgcgggagattcgcgagatacgggtgggcaagcactcgaaggagtttcgcctgtttgccgacgactgtcagcgcttcgagtccagcaagtgctttgtcatactgcacggcaatcacttcaagctgaagagcttctcggtggtggctctgtcggagatcgaggccgacaattgggtgcggggattgcgttacatggttaaggacacactgggagcaccctatcccttgcaaattgatcgctggctgcgtcgcgagtactatcaaatcgagaatgttaacacgcattccgccaaggccacggaacagtcgccagcccaggtgaccattaaggactttaagctctttttggccggagttagctgtaagatgaccaccggcaagttcatggagcactttaccgaggatgtgcggcgcaagcacgatctcaagtttgatgatttctcgcggctatatcagaagttgctgctgcccaacggatttgccagcgtcttgtccggatcgggagtggccaactttccctattcggaggaccaacaggtggtgcgaccggcggagctgaagcagttcctcgagacggaacagcgcgatgtgagcgccagtgagatcagtagcgcagccattgcctccttcattcgggactttgttcaggacgtggaacgtgatgttcaggagccgtatctcaccttcccggagttcgtcgactttctgttctccaagcaaaacgacctgtggaacagcaagtacgaccaagtgttcatggacatgaacctgccgttgtcctcctactggatcgcatcgtcgcacaatacctacctgacgggcgatcagttctccagtgaatcctcctgcgaggcctacgcccgcgctcttcgcatgggctgccgttgcatcgagttggattgttggaacgggcccgacaatctgccctacatatttcacggccacaccattacctccaagatcaagttcatggatgtcatcaagacgattaaggatcatgcgttcaccagttccgagtatccggtaatattgtccatagagcagaattgctccctggaacagcagcggaatatggcgcaggccttgatcgaggttttcggggatatgctgcttacgcaaccttgtgatcgaaacgagcagcacttgccatcgccataccagttgcgtcgcaagataatcctgaagcacaagaagttgccgcagtttgacgacatcgcgaatgggatttctagcacgggttcactgggccatagatcatcgttgggcggagcgggcggtggagcgcatggggagaacgatggcgagaatgtgcgcaaggtgttcaaggagggactgctctacttcaaggatccggtcgataagtcctggaatctttatcagttcgttctgacccatcaggagctaatctactcctctgagatcaacgagtcacgcaacggaaactccgaggatgatgactttgggctttcttcgtcgtgctccctaaacagcaatatgcagcaaaagcaaaaggatacctcggccaacgatgagctgcacttcggcgagaattggttccatgggaaacttgaaggtggcagaaaggaggctgatgatctactaaagaagtacaaacactttggcgatggtacatttttggttcgggaatcggccacgtttgtgggagactatagcctttcgttctggcgacgtaatcgcccgaatcattgccgcatcaagttaaagcatgaaaatggatcgatcaagtactatctagtggagaattttgtattcgattcactgtactcactgatcgtttattatcgcaagaatatgctgcgtagctcagagttttcgattatactgaaagagccagttccgcagccgaaaaagcacgaggatcaggagtggttccatccgaacaccaccaaggagcaggccgaacagggtctataccggctggaaattggttcgtttctagtgcggccatcggtgcagagcattaacgcttttgtcatttcgttcacaatcaatcgaaagatcaagcactgtcgcattatgcaggagggacgcttgtacggcatcgatacaatgaacttcgagtctctggtctcgctgatcaactattatacccgaaatccactctatcgcaatgttaagctcagccatccggtgtcgcaggagctgctgcgtcaggcgctagcggaggcggcacagggtgatcatagtggcggtcacgatgacaacggtgcctccaactacatgggctccaatctggaggagaatgtcacgtgcaaggcgctctacagctataaggcgaacaagccagacgaactctcttttcccaagcatgccatcataacgaatgtccagagggacaactcgatgtggtggattggagattatggtggcatgatcaagaagcatctgccggcaaactacgttaaggttatcgattcaactaccgaggactacaattcgctgaacgaagagggcacggatggacgcaccgattccattgagattttcggagctgttgcctcgctctttgagtccaacgatccggggattattttcaagctgcagatacaaacgccaacgatgcagaatccgtttgtgattggcttcgacaatcaggagacggcgtacgagtggataaaggcaatccaggaggcagcccttatcgccagtcagctggcatcggagaggcggaaaaaggagcgcactgcccgggtggccaaggagatgtccgatctgattatctacttccgcagcgtgccgttccgcgagcactcgtggatatttcaggaaatgtcgagtttccccgaaacgaaggccgaaaagcagttcttccagcagaacacacaactgtttctctcctaccatcgcaatcagattagccgagtgtatccgaagggtcagcgcctggactcgtcgaattttaatcccatgccattctggaatgttggatcccagatgatcgcactgaactatcagacaggcgataaggccatgcagctgaatcaggccaagtttcggaataatggacaatgtggctatatcttaaagccatcgttcatgaaatctgacagcttcaatccgaacaatccgctgtgcgatggcctaagcgaagttaaagttagcatacgtctgatagccgcacgtcatctattccggggcggcaaatcgaacaatccgcagatcgtggtcgaattgattggcgctagctttgatacgggcgttaagtatcgcaccaaagtcaatgaaaatggtttcaatccggtgtggaatgaatcgtgcgagtttaacgtgcgtaatccacagtttgcgatccttcgcttcgaagtgcaggacgaggatatgttcgccgagacgcacttcatcgcccaggcgtgctatccgctgacctgcattcgccagggctatcgcagcgtcatcctacgaaataagttcagcgaggagctggaattatcgtccctgctgatcaacattaagatagcaaatgttaccgcaccgtaagaggattgctgagttagctggatcaatatcaatgattccaaatcgagtgtttgcgaaaacaattgcgctagatcaaaaggaaagcgaacttaattcgcaaaagcaatttatcaacaacttgtacataagaacatttcatcgaactatgaacctgattctctcacttgtaatttgtctaaaaagcttaggatctgaaacgtatgatttagatttagattactttctatacacatcagcagttatggttagttcatactatacaatgagtattcaaatggtaacaatgaattctgaactcctggaactgaaatcaagtttatgtaatccgtataatttgtacacttttccataacactaagcattcaagtctgttgtcctctaaatgttgtatttgtgcgtgagattgattcaggagaatagaatgatacgaatatgttttaactattcgtcacctcattataagcataagcaaaccagatttgatttgatttcgatttagggaacttgagctatttccattttaccagttttaccatcaaaagttaagtacattaagttgattccaaaattagaaatagaaacaattcataaacagctcaattggcatcaatttaatgggcatttgatattcagtttcaggatcagcttttcataagtattatattacaatcttcttaaagacttttaactgaagaaaatagaccactttcatatgttatctggaaaactattttagacctttctcttagcacaaatactcaaacagcatttcaatcatttagcatttaccttttttattttctcttttaaagcttaaagtaataatacaatttataaaaaaaaaagggcaaaggaaatttaaaccactttgattacatatgtcttccagttgtttaacaattacgatataccacataattgtgtctatgttatttaaccacgattgttgtagctaatgttacaaaaactaaaagtttgcaaacaatattaaaataaaatgtaattattcaattacatttaaatgaacgtgccttaaaattcgaaatgatcgaaattttaaatgtttgaacgttaactattgaagtacacctgttgctaaaataacaaatatttgaaaaataataatatagctcaaagatatctattttttataaaatcaaagttctaacttagcttcttctctaaactgcgaaatctaaatatctaaagcctaagttcaatagacgtattattactaaatgcattatataatttatatatctagatattcataaaatgcactagtcgatttaagaagtggaaattgtgctccctatgcgaatcatttaggattttaatctgaaactatttgcattccatacgaatgccccactgaaacgatcgatatcatttgtcttgcactcgcatttaattatttaacaaacattctgctgtttccattcgcacaatagttctaatttggacattttgcgcgtttgagcgcattagcaaatcatgcttagtatatatgtatgtgtatatgtacccaaaatgtatttcatttgtacgttccgtttttaagtgatttgtatctgtacgtctaatagatattttcaactgtttttgtaattgccttataattcagtaaacacacaccatacgtatacattcataattatttaatgccaaataaatgtttatccggcgttagctgtctatatatatacaaagttgtttctatatgttggatttctgagaattgaggaagccaccgaatgaagtag

SEQ ID NO: 9906 - protein, 1236 aa, Drosophila melanogaster
MSCFSAMSAPLLGEMEQTIGMLERGTIVTKLYGKQRRPDRRHLMLIRETRQLLWATVATQTPRTDYEGAIQLREIREIRVGKHSKEFRLFADDCQRFESSKCFVILHGNHFKLKSFSVVALSEIEADNWVRGLRYMVKDTLGAPYPLQIDRWLRREYYQIENVNTHSAKATEQSPAQVTIKDFKLFLAGVSCKMTTGKFMEHFTEDVRRKHDLKFDDFSRLYQKLLLPNGFASVLSGSGVANFPYSEDQQVVRPAELKQFLETEQRDVSASEISSAAIASFIRDFVQDVERDVQEPYLTFPEFVDFLFSKQNDLWNSKYDQVFMDMNLPLSSYWIASSHNTYLTGDQFSSESSCEAYARALRMGCRCIELDCWNGPDNLPYIFHGHTITSKIKFMDVIKTIKDHAFTSSEYPVILSIEQNCSLEQQRNMAQALIEVFGDMLLTQPCDRNEQHLPSPYQLRRKIILKHKKLPQFDDIANGISSTGSLGHRSSLGGAGGGAHGENDGENVRKVFKEGLLYFKDPVDKSWNLYQFVLTHQELIYSSEINESRNGNSEDDDFGLSSSCSLNSNMQQKQKDTSANDELHFGENWFHGKLEGGRKEADDLLKKYKHFGDGTFLVRESATFVGDYSLSFWRRNRPNHCRIKLKHENGSIKYYLVENFVFDSLYSLIVYYRKNMLRSSEFSIILKEPVPQPKKHEDQEWFHPNTTKEQAEQGLYRLEIGSFLVRPSVQSINAFVISFTINRKIKHCRIMQEGRLYGIDTMNFESLVSLINYYTRNPLYRNVKLSHPVSQELLRQALAEAAQGDHSGGHDDNGASNYMGSNLEENVTCKALYSYKANKPDELSFPKHAIITNVQRDNSMWWIGDYGGMIKKHLPANYVKVIDSTTEDYNSLNEEGTDGRTDSIEIFGAVASLFESNDPGIIFKLQIQTPTMQNPFVIGFDNQETAYEWIKAIQEAALIASQLASERRKKERTARVAKEMSDLIIYFRSVPFREHSWIFQEMSSFPETKAEKQFFQQNTQLFLSYHRNQISRVYPKGQRLDSSNFNPMPFWNVGSQMIALNYQTGDKAMQLNQAKFRNNGQCGYILKPSFMKSDSFNPNNPLCDGLSEVKVSIRLIAARHLFRGGKSNNPQIVVELIGASFDTGVKYRTKVNENGFNPVWNESCEFNVRNPQFAILRFEVQDEDMFAETHFIAQACYPLTCIRQGYRSVILRNKFSEELELSSLLINIKIANVTAP

SEQ ID NO: 9907 - DNA, 4487 bp, Mus musculus
  CDS (135)..(4043)
ctggcgcggctccctccgcccggcagccttgccaggagctgccaccgggtcccgctcgcctccccggccgccgccaccgcctccgcctccgccgctccgggcccgccggcttgcgtcgccgaggtcgctgcagcatggcgggcgtcgcgaccccctgcgccaacggctgcgggcctggcgcaccctccgaagccgaggtgctgcacctctgccgcagcctcgaggtgggcaccgtcatgactttgttctactccaagaagtcgcagcggccagaacggaagaccttccaggtcaagttggagacgcgccagatcacatggagccgcggcgcggacaaaatcgaggggtccattgatatccgagaaatcaaggagatccgtccagggaagacttctcgggactttgaccgctaccaagaagaccctgccttccggccagatcaatcacactgctttgtcatcctctatggaatggaattccgcttgaagaccctgagcctgcaagccacatctgaggatgaagtgaacatgtggatcaagggcttaacttggctaatggaggatacactgcaggcagccacacccctgcaaattgagaggtggctccggaagcagttctactcagtggatcgtaaccgagaggatcgtatatcagccaaggacttgaagaacatgctgtctcaggtcaactaccgagtccccaatatgcgcttcctccgagagcggctgacggaccttgaacagcgcagcggggacatcacctacgggcagtttgctcagctgtaccgcagcctcatgtacagcgcccagaagacgatggaccttcccttcttggaaaccaacgctttgaggactggagagcgtccggagcattgccaggtgtccctttctgagttccagcagttcctccttgaataccagggggagctgtgggctgtcgaccggctccaggtgcaggaattcatgctcagcttccttcgagaccccttgcgagagattgaggagccatacttcttcttggatgagcttgtcaccttcctgttctccaaagagaacagcgtgtggaactcacagctggatgctgtgtgcccggacaccatgaacaacccactctctcactattggatctcctcctcacataatacgtacctgactggggaccagttctccagtgagtcctccctggaagcctatgctcgctgcctgaggatgggctgtcgctgcattgagttggactgctgggatgggccagatgggatgccagtcatttaccatgggcacactctcaccaccaagatcaagttctctgacgtcctgcacaccatcaaggagcatgctttcgtagcctcagagtacccagtcatcctgtccatcgaggaccactgcagcattgcccagcagagaaacatggctcagcacttcagaaaggtgcttggcgacacactccttaccaagcctgtggacattgctgctgatggccttccttctcccaaccagctcaggaggaagatccttattaagcacaagaagctggctgagggcagtgcctatgaggaggtgcctacctctgtgatgtactccgagaatgacatcagtaactccatcaagaatggtatcctctacttggaggaccccgtgaatcatgagtggtatccccactacttcgttctgactagcagcaagatctactactctgaggagaccagcagtgaccagggcaatgaggatgaagaggagccgaaggaggccagcagcagcacagagctgcactcgagtgagaagtggttccacgggaagctcggggctggacgtgacgggcggcacattgctgagcgcctgctcactgagtactgcatagagactggggctcctgatggctccttcctagtgcgagaaagtgagaccttcgtgggtgactacacgctgtctttctggcggaatgggaaagtccagcactgccgcatccactcccggcaggatgctgggactcctaagttcttcttgacagataaccttgtctttgactctctctatgacctcatcacacattatcagcaagtacccctgcgctgcaatgagtttgagatgcgcctttcagagcctgttccacagacgaatgcccatgagagcaaagagtggtaccacgcaagcctgactagagctcaggctgaacatatgctgatgcgagtgccccgggatggggccttcctggtgcggaaacgcaatgagcctaactcatatgccatctctttccgggctgagggaaagatcaagcactgccgagtacagcaggaaggccagacagtgatgctggggaactctgagtttgacagcctggttgacctcatcagctactatgagaagcaccccctgtaccgcaaaatgaagctacgctaccccatcaacgaggaggcactggagaagatcgggacagctgaacccgattatggggcactatacgagggccgcaaccctggtttctatgtggaggcaaaccctatgccaactttcaagtgtgcagtaaaagccctcttcgactacaaggcccagagagaggatgagctgaccttcaccaagagtgccatcatccagaatgtggaaaagcaagatggtggctggtggcgaggggactatggtgggaagaagcagctgtggttcccctcaaactatgtggaagagatgatcaatccagcagtcctagagcctgagagggagcacctggatgagaacagcccactgggggacttgctgcgaggggtcttagatgtgccagcttgtcagatcgccatccgtcctgagggcaaaaacaaccggctcttcgtcttctccatcagcatgccatcagtggctcagtggtccctggatgttgcagctgactcacaggaggagttacaggactgggtgaaaaagatccgtgaagttgcccagactgcagatgccaggctcactgagggaaagatgatggagaggaggaagaagatcgccttggagctctccgagcttgtggtctactgccggcccgttccctttgatgaagagaagattggcacagaacgtgcttgttaccgggacatgtcctcctttccggaaaccaaggctgagaagtatgtgaacaaggccaaaggcaagaagttcctccagtacaaccggctgcagctctcgcgcatctaccctaagggccagaggctagactcctccaattatgaccctctgcccatgtggatctgcggtagccagcttgtagcactcaatttccagaccccagacaagcctatgcagatgaaccaggccctcttcatggctggtgggcattgtggctatgtgctgcagccaagcaccatgagagacgaagcctttgacccctttgataagagcagtctccgaggtctggaaccctgtgtcatttgcattgaggtgctgggggccaggcatctgccgaagaatggccggggtattgtgtgtccttttgtggagattgaggtggctggggctgagtacgacagcaccaagcaaaagacggagtttgtagtggacaacggactgaaccctgtgtggcctgctaagcccttccacttccagatcagtaacccagagtttgcctttctgcgctttgtggtgtatgaggaagacatgtttagtgaccagaacttcttggctcaggctactttcccagtaaaaggcctgaagacaggatatagagcagtgcctttgaagaacaactacagtgaagacctggagttggcctccctgctcatcaagattgacattttccctgctaaggagaacggtgacctcagtcctttcagtggcatatccctaagggaacgggcctcagatgcctccagccagctgttccatgtccgggcccgggaagggtcctttgaagccagataccagcagccatttgaagatttccgcatctcgcaggagcatctagcagaccattttgacagtcgggaacgaagtacttcagatggtccttcctcagccactaaccttattgaggatcccttacatgacaagctgtggaagtgctctctttaaatacccagtggctaagaagatgctggcctctatgatggcaaaaatgcggcaagctgcaagttttggaggacaaagtcattactaccctctggcaaaaataagccacaccagcaacctgggccatagttcccaggctgcctgctgtgttgaaagaggactgctgcacagaaagcagacatttaccaaaccaggaaagcctcttcatgctcacctcaggatgctgtgaatgttcagcaggatgctttgctagttttttgtttggttgtttttgtttttttgttttttttgttttggtgaggccaaatgtgagataatgccttatgagttgttggtcatagagccagagatgtgcacaaaaatacaagccactgtcattcctcttggttgcccatcaaaaaaaaaaaaaaaaaaaaaaaaaaaaaaaaaaaaaaaaaaaaaaaaaaa

SEQ ID NO: 9908 - protein, 1302 aa, Mus musculus
MAGVATPCANGCGPGAPSEAEVLHLCRSLEVGTVMTLFYSKKSQRPERKTFQVKLETRQITWSRGADKIEGSIDIREIKEIRPGKTSRDFDRYQEDPAFRPDQSHCFVILYGMEFRLKTLSLQATSEDEVNMWIKGLTWLMEDTLQAATPLQIERWLRKQFYSVDRNREDRISAKDLKNMLSQVNYRVPNMRFLRERLTDLEQRSGDITYGQFAQLYRSLMYSAQKTMDLPFLETNALRTGERPEHCQVSLSEFQQFLLEYQGELWAVDRLQVQEFMLSFLRDPLREIEEPYFFLDELVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQHFRKVLGDTLLTKPVDIAADGLPSPNQLRRKILIKHKKLAEGSAYEEVPTSVMYSENDISNSIKNGILYLEDPVNHEWYPHYFVLTSSKIYYSEETSSDQGNEDEEEPKEASSSTELHSSEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFTKSAIIQNVEKQDGGWWRGDYGGKKQLWFPSNYVEEMINPAVLEPEREHLDENSPLGDLLRGVLDVPACQIAIRPEGKNNRLFVFSISMPSVAQWSLDVAADSQEELQDWVKKIREVAQTADARLTEGKMMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMAGGHCGYVLQPSTMRDEAFDPFDKSSLRGLEPCVICIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKENGDLSPFSGISLRERASDASSQLFHVRAREGSFEARYQQPFEDFRISQEHLADHFDSRERSTSDGPSSATNLIEDPLHDKLWKCSL

SEQ ID NO: 9909 - DNA, 4862 bp, Xenopus laevis
  CDS (121)..(3945)
gggcacagccacttgctgatttgcattgtcctctcatggctggaggagcggtgacctgcctggaggaacctggacgctgattcttcttccctgacttggtggatgtacagcaggagcagcatggaatctctgcctcttatcaatggattcgctgcaggtgggcaaagcgaggctgagctcacccatctgtgccggagtttggaagtgggcactgtcatgaccctcttctactccaaaaagtcccaaaagccagagaggaggaccttccaggtgaagctggagacaaggcaggttacatggagtagaggggcagataaagtggaaggagcagtggatatccgggaaattaaggaaattcggccaagcaagaactccagagattttgaccggtaccaggaggatccaactgtgcggttggagcaggctcactgctttgttatattgtacggaacagagttcagattaaagaccttaagcctacaagccacctccgaggaagaagtaaacatgtggattaaagggttaaactggctgcttcaggatacactgcaggctcctactcctctgcagattgagaggtggctccggaagcagttctacacactggacaggaacagggaagacaagatttctgtcaaggacttaaagaatatgctgtcccaggttaattacagagttcccaacatgaggttcctgcgtgaccgactaacggaacttgaacaaagaagccgagagattaactatgcccagtttgccatgctctaccgatctcttatgtatgatgcacagaaaacgataccaattcccttcacagagagatttggtgagcgtgaaaggaccaaagtatccttagaggacttccaaaagttcctgctggattatcaaaaggatatgtgggcaactgatcgtcacaaagtgcaggagtttatgttccacttcttgcatgaacctctgagggagattgaagagccatattttactctggaagagtttgtcactttcctgttctctaaggagaatacagtgtgggattcagaactggacacagtgtgtccccaaaatatggacaaccctttgtctcattactggatatcctcttcccacaacacatacctaacaggagatcagttctccagtgaatcatcattggaagcctacgctcgatgcctgcgcatgggctgccgctgcatagaattggattgctgggatgggccagatggaatgccggttatttaccatggacatacgttgaccaccaaaataaagttctcagaagtcttgataaccatcaaagaacacgcttttgtcacttcagaataccctgttatcttatcaattgaagaccactgcagcattgcacaacaaagaaatatggctcagcactttaagaaggtttttggggacatgctcctgacaaagcctgtggatgttaacgcagacggccttccctctcccaaccaactgaaacgaaaaatcctcatcaagcacaagaagctggcagaaggtagcacttatgaagagataccatcctccacagtctactctgagaatgacatcagcaactccatcaagaatggaattttgtacctgcaagatcccatcaaccatgagtggtacccacatttctttgtcctcaccagcagtaagatctattattcagaggagaccaccagcagccaggctaacgacgatgaggaagaacagaaggaggccagtaatagctcagagttgcactctgctgagaagtggttccatgggaagctgggtgcaggaagggatggacggcacattgctgaacggctgctgactgattactgtattgaaactggcgctccagatggctcctttctggtgcgggagagtgagacatttgtgggggattacacactctccttctggagaaacggaaaagtccagcattgtaggattcactcgaggcaagaagctgggagtcccaaattttttctgacggataacctggtgtttgaaagtctgtatgctctgatcactcactaccagcaaatgcccctaagatgcaacgagtttgagatgcgactgacagagcctgttccacagaccaatgcccatgagagcaaggagtggtaccatgccagcctcacccgggggcaagcagaacacatgttgatgagagttccacgagacggagccttcttggtgcgtaagaggagtgaacaaaactcgtatgccatctccttccgagccgagggaaagatcaaacactgccgtgttatacaggaaggtcaaagcgttgtccttggaagctctgagtttgacagcctggtggatcttataagttactacgagaagcatcctttgtatcggaagatgaagctgcgttaccccattaatgaagaaacacttgaaaagattggcacgcctgatccagattatggtgctctatacgagggaaggaaccctggtttctatgtggaggccaatccaatgcctacatttaagtgctctgtcagggccctgtttgattataaggctcaacgtgaggatgaattgactttcaccaagaatacaatcatccagaatgtagagaagcaagagggaggatggtggcgaggagactgtgggggtaaaaaacaaatgtggttccctgccaactatgtggaagagatatttagtcccgctgagcctgaacctgagaggcagaatctagatgagaacagtcctctaggagatctactgggtggagttttggatgtgccatcctgtcacattgctccccgacaggacgtccataacggccgaccctttgtattcaccattactggtcctcagttaaaccgatatccacttgatgttgctgcggacacactggaagacatgcaagactggatacggaaaattcgggaagcagctcaaactgctgatgcacggctcacagaaggcaaaatcatggagcgcagaaagaagattgccctggaactctcagaacttgtcatttactgccggccagtcccctttgatgaagagaagattggcactgaaaaggcctgttaccgtgacatgtcttcattccctgagaccaaagcagaaaagtatgtcaacaagatgaaagggaagaaattcctgcagtacaaccggcggcagctctctcgtatctatcccaaaggacaacgccttgattcatcaaactatgaccccctgacaatgtggatctgtggcagtcaacttgtagcgctcaacttccagacaccagacaaacccatgcaaatgaaccaggctcttttccagtccgggggccgttgcggttatgtttttcagccaaactgcatgagagatgaagtttttgatccgtttgacaaaagcactcttcgtctggagacaataaccgtcagcattgagatcctaggtgcccgccatctgcccaagattggaaggggtattgtttgcccttttgtggaggtagaagtttgtggtactgaatatgacaatgcaaagcagaagacggaatttgtagtggataatggcttgaatcctgtctggccacagaaaacgttctcgtttgtcattgctaaccctgagttcactttcctacggtttgtcgtctatgaagaggacatgtttagtgatcagaacttcttggctcaagcctcatttgtggtccgtggcttaaaaacaggatatagatccatcccactcaaaaataattacagcgaagatctagaactggcatcactgctcattaagatagacatcaagactgagaatggagaacttaatggagcttctgcacccagggaacgaatcagtgaccccatgtctggacgcatttgggatgggccgacagagacgagatatcattccaaccatttggatgatttccgtgcttcgcaggaacagttgtctgaacactttgagagagaaaggagagtcctcaggaaaacgcgtttgagtggggataaccggctgtagattacatgcttcaagtacttctggcaggttctttggaaagatccaacctttgttcctcacgtgggggactgtccatgagttgaagccccatggtgacctctatttgaactctgcacgttagctttaaaacgcgtgcttccacagtgactttgtgtgggaacagtttgttcaaatatcgcaatcgtttccggaaagggaactattaacctacagcacagactctagaaatatatatataatgccttgtatattagtagggcaaatagcaaaggctgggggtatgatctacttttcagcttgaagtgggcagcccattgcttctctatttagtaatcgtctgctatcaaactgtgaaaggagaggatgcaaagacatctcattttgtaatccaaccttcagcaccctaacctgagatttagatgctatgtgactttatagggacattgaacattgaaaagacatttatcttgaattctttatttctatttgcaacatcattccatggatggagcatttgtccttttttttttattttgctgttgtgtaccacaaacaagcacaagaatggatgtcttgggccaaattcccatgtggctctcatcaggtggtttagtgaaatgccgtggtggccttcaattcagtggactgtttatttgttttactgcttggaaaaaaatggctgccatgaagcctatagtgtttggtgattaatggcaccaacctcattgaaacgccaataattcagcaagctggaaagaggaagagtctgttacagtgggcattcgccaagatgcagttccactacatgtctccaatatatttcctatttatgtgcaatatataaagtctgtttccattttctctttttttttttttaaataaactataacccaacattgaaaaaaaaaaaaaaaaaa

SEQ ID NO: 9910 - protein, 1274 aa, Xenopus laevis
MESLPLINGFAAGGQSEAELTHLCRSLEVGTVMTLFYSKKSQKPERRTFQVKLETRQVTWSRGADKVEGAVDIREIKEIRPSKNSRDFDRYQEDPTVRLEQAHCFVILYGTEFRLKTLSLQATSEEEVNMWIKGLNWLLQDTLQAPTPLQIERWLRKQFYTLDRNREDKISVKDLKNMLSQVNYRVPNMRFLRDRLTELEQRSREINYAQFAMLYRSLMYDAQKTIPIPFTERFGERERTKVSLEDFQKFLLDYQKDMWATDRHKVQEFMFHFLHEPLREIEEPYFTLEEFVTFLFSKENTVWDSELDTVCPQNMDNPLSHYWISSSHNTYLTGDQFSSESSLEAYARCLRMGCRCIELDCWDGPDGMPVIYHGHTLTTKIKFSEVLITIKEHAFVTSEYPVILSIEDHCSIAQQRNMAQHFKKVFGDMLLTKPVDVNADGLPSPNQLKRKILIKHKKLAEGSTYEEIPSSTVYSENDISNSIKNGILYLQDPINHEWYPHFFVLTSSKIYYSEETTSSQANDDEEEQKEASNSSELHSAEKWFHGKLGAGRDGRHIAERLLTDYCIETGAPDGSFLVRESETFVGDYTLSFWRNGKVQHCRIHSRQEAGSPKFFLTDNLVFESLYALITHYQQMPLRCNEFEMRLTEPVPQTNAHESKEWYHASLTRGQAEHMLMRVPRDGAFLVRKRSEQNSYAISFRAEGKIKHCRVIQEGQSVVLGSSEFDSLVDLISYYEKHPLYRKMKLRYPINEETLEKIGTPDPDYGALYEGRNPGFYVEANPMPTFKCSVRALFDYKAQREDELTFTKNTIIQNVEKQEGGWWRGDCGGKKQMWFPANYVEEIFSPAEPEPERQNLDENSPLGDLLGGVLDVPSCHIAPRQDVHNGRPFVFTITGPQLNRYPLDVAADTLEDMQDWIRKIREAAQTADARLTEGKIMERRKKIALELSELVIYCRPVPFDEEKIGTEKACYRDMSSFPETKAEKYVNKMKGKKFLQYNRRQLSRIYPKGQRLDSSNYDPLTMWICGSQLVALNFQTPDKPMQMNQALFQSGGRCGYVFQPNCMRDEVFDPFDKSTLRLETITVSIEILGARHLPKIGRGIVCPFVEVEVCGTEYDNAKQKTEFVVDNGLNPVWPQKTFSFVIANPEFTFLRFVVYEEDMFSDQNFLAQASFVVRGLKTGYRSIPLKNNYSEDLELASLLIKIDIKTENGELNGASAPRERISDPMSGRIWDGPTETRYHSNHLDDFRASQEQLSEHFERERRVLRKTRLSGDNRL

SEQ ID NO: 9911 - DNA, 1776 bp, Vigna radiata
  CDS (1)..(1776)
atgtccaagcagacttacagcttttgcttctgcttccgccgccgcttcagtctccccgtgtcggaggcccctccggagataaggacccttttcgaccgttattccgatgagaatggaatcatgacagcctctcacgtccgcagtttcctggttgaggtgcagaaggaggagagtgtcactgaggaggaagcacaggccatcatcgatggccacaagcatctcagcatctttcacaggaggggtctcaatcttgagagtttcttcaactacctcttcagtagcaataataatccacctctctcgccttctctcggggtgcaccaagatatgtcttcaccgttgtctcattacttcatttatactggtcataattcctatctaactgggaaccaactaagcagtgactgcagtgacgtccccatcatcaaggcactgcagaagggtgtaagggtgattgaattagatatatggcctaatgaatcaaaggaggatgtggatgttcttcatggaaggacattgacatctcctgtggccctcatcaaatgtttgaggtctattaagcagtatgcttttgttgcctcagaatatccagttgtaataaccttagaagaccaccttactcccgatcttcaggccaaagtggctgagatgattactcaaacatttggagacatactattttctcctggctctgaaagcttgaaggaatttccttctcctaaatcgcttaaaaggaggattatcatatcaaccaaaccacctaaggagtacattgaggcaaaagaagttcaggaaaagggggagggatcacaaaaggaaaagcctgtagatgatgaagaagcatgggggaaagaagttcctagtttgagaggtggcactatttctgatcacaagaacatcgaggatgaggatgatcttgacaatgaagatgatactgatgaagcagaatattcacgtcaaaatgcatcagacgaatacagacgtttaattgccattcatgctgggaagcctaaaggtggattaacagaatgcctcaaagtggatcccgatacagtgaaacgtctaagtttaagtgagctacaacttgaaaaggctgctgaaactcatggcaaagaaatcataaggtttactcagcggaatatactgagagtgtatccaaaaggcactcgtattgcctcaacaaattataatccattgatcgggtggatgcatggagcccagatggttgcattcaacatgcagggatacggtaggtctctctggttgatgcagggaatgttcaaagcgaatgggggatgtggttatgttaagaaaccagattttctgttaaagactggtcttaataatgaggtctttgatcctaaagctcgtttgccggtgaagaaaactttgaaagtgactatatatatgggggaaggatggtttcatgatttcaagcacacgcactttgatcaatactcaccccctgacttctatgcaagagtggggattgctggagtcccttatgatactgttatgaaaaaaacaaagagcgtggaggataattggtctccatcatggaatgaggaatttaagtttccactttctgttccagaactggctctgcttcgtgtagaagttcatgaatatgacatgtctgagaaagatgactttggtggccaaacttgcttacctgtgtgggaactgagaagtggaattcgtgcagttccattatattcccgcaaaggagaaaagtaccacaatgtgaagcttctaatgcgctttgaattcatttga

SEQ ID NO: 9912 - protein, 591 aa, Vigna radiata
MSKQTYSFCFCFRRRFSLPVSEAPPEIRTLFDRYSDENGIMTASHVRSFLVEVQKEESVTEEEAQAIIDGHKHLSIFHRRGLNLESFFNYLFSSNNNPPLSPSLGVHQDMSSPLSHYFIYTGHNSYLTGNQLSSDCSDVPIIKALQKGVRVIELDIWPNESKEDVDVLHGRTLTSPVALIKCLRSIKQYAFVASEYPVVITLEDHLTPDLQAKVAEMITQTFGDILFSPGSESLKEFPSPKSLKRRIIISTKPPKEYIEAKEVQEKGEGSQKEKPVDDEEAWGKEVPSLRGGTISDHKNIEDEDDLDNEDDTDEAEYSRQNASDEYRRLIAIHAGKPKGGLTECLKVDPDTVKRLSLSELQLEKAAETHGKEIIRFTQRNILRVYPKGTRIASTNYNPLIGWMHGAQMVAFNMQGYGRSLWLMQGMFKANGGCGYVKKPDFLLKTGLNNEVFDPKARLPVKKTLKVTIYMGEGWFHDFKHTHFDQYSPPDFYARVGIAGVPYDTVMKKTKSVEDNWSPSWNEEFKFPLSVPELALLRVEVHEYDMSEKDDFGGQTCLPVWELRSGIRAVPLYSRKGEKYHNVKLLMRFEFI

SEQ ID NO: 9913 - DNA, 2072 bp, Zea mays
  CDS (65)..(1825)
taggcggcaccaaccagaaatcacaaggattcgtttcatccggcagcgcagctctagagcctccatgggcagctacgcgtacaagtactgcatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttcgccttcctcttctcccccgacctcaacccacccatcgcgcaccaggttcaccaggacatgtcagcgccgttctctcactatttcgtattcaccgggcatagttcctacctcactgggaaccagctcaatagtgactccagtgacgtcccaattgtaaaggcgttgcagggaggtgttagagtcattgaactcgatatgtggcccaatccttcaaaggacaatgtcgatattcttcatggagggacattgactgccccagtggaaatgatcaaatgtttgaagtccatcaaagaatacgccttctgtgcctcaaattatcctcttgttattactcttgaggatcacctcacaccagatctccaagctaaagttgctacgatgctcactgaaacatttggagatcttcttttcgtccctaatccagacccgatgaaagagtttccttctccagcatctctaatgaagagaataatcatatcaaccaaacctccacaagaatataaggagtttctcaaagccgagaataatcgcagtggcagcggaaacatagctgagttgccagaccaaggaagcctgagaagaatagattcaaatgccgatgaatctgatggaaaggatgaactggatgagcaagacgaggaagactccgacgaggacgatcccaaatttcagcaggatacagcctgtgagtataggaaactcatcaccatccaagctggcaaaccaaaaggccatttgcgggatgcgctaaaagtggatccagacaaagtcaggcggctttctttgagcgagacacagttagctaaagcgacaatctctcatggtgctgaagtcataaggttcacacagaagaatatactccgtgtgtatccaaagggcacgagggttaattcttcaaactacgatccaatgaacgcctggacccatggtgcgcaaatggttgcattcaacatgcagggccatgataaagcgctccggttgatgcaagggtttttcagagccaatgggggctgtggttatgttaaaaagcctgacttcttgctaagaacaggtccaaatggggaagtatttgaccccaaggctagtttgtcagtgaagaaaaccctcaaggtgaaagtatatatgggagaccggtggcgcatggacttcagtaaaactcatttcgatgcattttcgcctccagatttctatactaaggtagggatcgcaggtgtgaaggcagacagtgtgatgaagaagacaagggtgattgaggaccaatgggtgccgatgtgggatgaggagttcacgttccttctgacggttccggagctggccctcctgagggtagaggtccaggagtacgacatgtcggagaagcacgacttcggggggcagacagtgttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttcttttttttcttccttcttgcgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgatgcagttttacttgtaaaaaaaaaaaaaaaaaaaaaaaaaaaaaa

SEQ ID NO: 9914 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHSSYLTGNQLNSDSSDVPIVKALQGGVRVIELDMWPNPSKDNVDILHGGTLTAPVEMIKCLKSIKEYAFCASNYPLVITLEDHLTPDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLSVKKTLKVKVYMGDRWRMDFSKTHFDAFSPPDFYTKVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 9915 - DNA, 1596 bp, Arabidopsis thaliana
  CDS (1)..(1596)
atggtgaatttaagaaagaagtttgagatgaaacaggcgaatcagccgggtcgcgtcccaaattatttcaggaataaatatcatggatatgatgacgatatgccgaatttgctacctacgttcatcaaattgttggatactgagaaggacgaagacggtgccggcttgaacgctgcagagcaaatcgatagggagttaaaaagccgaaaatgtgatattcttaagttccgcaacttgacgattctcgagcttcctcacttgaacgagtttctgttttctacggagctcaatcccccgatcagtgaccaggttcgtcatcgtgacatgaatgctccactatcgcattacttcattcacactagcctcaaatcctactttacgggaaataatgtctttgggagattatacagcattgagcccatcattgatgcacttaaacaaggtgtgagagtggttgaactagatcttttgccttttggtaaagacggcatatgcgttaggccaaaatggaactttgaaaagcctctagaattgcaagagtgtttggatgctatcaaacagcatgcctttacccccacgaggagttatcccgtgataattacgatcaaggacagcttgaaaccggatcttcaatccaaagttactcagatgatagatcagacatttggtgatatggtataccacgaagacccccaacaaagcttggaggaatttccttcaccagcagaactacaaaataagatattaatatcacgaagaccaccaacaaaattgttatatgctaaagccgttgagaatggggttgagcttgagatacaagaggggtcaacagataagaattaccagagtgttgttggctttcatgcagtggaaccaagaggcatgctacaaaaagcattaacagacgacgtccaacaaccaggatggtacgaaagagatgttataagcttcacccaaaataaattcttgcggacacgtccaaaaaaacgcaacttgttgagcaaccccccttataaacctcagagagcttggatgcacggtgcacaaatgattgcactaagcaggcaggacgacaaagaaaaactttggttgatgcaagggatgtttagagcaaatggagggtgcggttacgtcaagaagccgaatttccttttgaatgcaggttctagtggagttttctatccaacagagaatccagtggtggtgaagacattaaaggtcaaaatctacatgggagatggatggattgtggacttcaagaagcggataggtcgactgtctaagccggacttatacgttaggatcagtattgccggtgtaccccatgatgagaagattatgaacacgacagtgaaaaacaacgaatggaaacctacttggggagaagaattcacatttcccttgacctatcctgaccttgctttgattagttttgaagtttatgactacgaagtatcaactccagattatttttgtggtcagacttgtctaccggtttctgaactaatagaaggaattcgtgctgttccgctctatgatgagcgaggtaaggcatgcagctcgacaatgctgctcacacgttttaagtggtcttag

SEQ ID NO: 9916 - protein, 531 aa, Arabidopsis thaliana
MVNLRKKFEMKQANQPGRVPNYFRNKYHGYDDDMPNLLPTFIKLLDTEKDEDGAGLNAAEQIDRELKSRKCDILKFRNLTILELPHLNEFLFSTELNPPISDQVRHRDMNAPLSHYFIHTSLKSYFTGNNVFGRLYSIEPIIDALKQGVRVVELDLLPFGKDGICVRPKWNFEKPLELQECLDAIKQHAFTPTRSYPVIITIKDSLKPDLQSKVTQMIDQTFGDMVYHEDPQQSLEEFPSPAELQNKILISRRPPTKLLYAKAVENGVELEIQEGSTDKNYQSVVGFHAVEPRGMLQKALTDDVQQPGWYERDVISFTQNKFLRTRPKKRNLLSNPPYKPQRAWMHGAQMIALSRQDDKEKLWLMQGMFRANGGCGYVKKPNFLLNAGSSGVFYPTENPVVVKTLKVKIYMGDGWIVDFKKRIGRLSKPDLYVRISIAGVPHDEKIMNTTVKNNEWKPTWGEEFTFPLTYPDLALISFEVYDYEVSTPDYFCGQTCLPVSELIEGIRAVPLYDERGKACSSTMLLTRFKWS

SEQ ID NO: 9917 - DNA, 2634 bp, Ashbya gossypii
  CDS (1)..(2634)
atggaccttaatcatgcatataaggcaagtaatggggagtctaacaacagccttgattcttctctggatgtaaaaccgatggagaagccggcaacagatgatgcggtccgcacggagaaacgtaagtaccatggtgcggctgtcatgtcccaccaccaaataagtgtgatgtcgcagcctctgaccaagggcgtcagagaacttataaagaaaaccacggcgttcatgtcttgctcgaagagcaagccgcagaaactgatggagctgggcccgatgacgtacgcgcactccgtactgactgcgagcgagaagcctctctgccacatggagttggagagcagcagcgttaatgggtttgcagacaccctgcaagacaacggggtgtcggacgcgacgctggtggagatgtggctgatacgggtcactcggcgcaaacgcgtgcgctattgcttccggataagtaatggtgtgttgacatggaaggacaacaggatgctggagttagatacaatcaaggacattagaatggccgaaatggcaaaaaactacagggaacagtacgatataatggatgcgtttgcgtctcggtggataacgatcatatatcaggtgtcgcctacgaagctgaaggctctgcatctgatagctccgacgcagctcgaatgcgcgaagttttataatgccgtgctgactgttgcacggcagcgtcgggagctgatggagagtatttctgtccccagcagcgaggcgtttgccaacatccactggaaggtgaatgtgtcatccaagaaggcagacgaaagcagggatacgctctctttcgaagatgtgcagcgactctgcaccaagttccacatatattgctcctccaactatttgaagcgagtttttaaaatagcagacgtgaatcgcaatgggctgctgaactttagcgagttttgcacctttgtgcggatgctaaagaagcgccatgaggttacagaaatatggcaaaagattgccgccgaaactcgagcgatagattttgaaaagttttacagtttcctgacagatgtgcagtgcgaggacatggatgcccagctggcacgggacctatttaatgagtattcgcacgaaggttacatggacgaagacctcctgttaaaatttctgactgcccaaccgtacgcaagggagatagaagaagactactcaaggccgctatcggaatatttcatttcgtcttcacacaatacatacttgcttggtaatcaggtaggtagtatggctagtgtagagggctatattcaggcgctgcaacagggctgccgctctgtggagattgatatatgggacagcgatgatggcccggtggtctgccatggaaagttgacctcatcgctaccgctccgcaacgtggttgacgtgatcaacaagtacgcgtttatcacatccccatacccgctaatattatcattagagattcactgccgatcggagggacagataatagtgaaacaacttttcgacgacattctggggccactcatctacgtggctgaccactctgtcggatggcccagcctgcgagatctcaagcacaaaataataatcaaaagcaagaagctcagggtaaatgtggacatggctgcggatatataccactccacttcttccaagggctcatcttatgactcagagtatgacgtgcagtcacagccctcatcaccaatgcccaggaggggcatgcgcgggatccacatctcaaagcgcaaacaccgggtcattgagcagctgctgcagatttctgcaatccacggcattaccttccgcaatttttcgttgccagagtccaagacgccaacacactgcttttccttgagcgagcgcagcttcgataacctggccaacgatgacctgcagcgcctagcgatcgacaagcacaaccggcgccacctgatgcgtgtatacccccatgcattccgctacaaatcgtcgaactacgacccgatcaaatgctggcgcctaggtgtccaaatggtagccaccaattggcagacctacgacctggggcagcagctaaaccaggccatgttccgcgttaccgcgcgcgacgactggccatggccgtcgggctatgttcgcaagcccgagtatctcctccacaccgtcccaaaaaccagctttatccgcgacatctacgaggccgtacacagctcggtcgtggcactatcgcttgagctgctttccgcccagctactgccgaagcccaagctttcctcgcgcgatggcgaggcccatttcgccccctacgtcgtcatagaggttctcggcgacggtctctgtgggccaatccacgtgcagaacgggcttgtcaccgccccaaaccaagtaacttcctgccgctgtcccgaaaacggttttaatcctgtatggaagacgtccttgactgccactctcaacaatactggcttcaatttcatcagatacattgtcaagaacgctgacattacgctagcgacctgctgcattcgcctcgactacatgaagagaggctacagacacataccgttatatagcctggagagctcgcgattcatcttctccacactctttgtaaaaaccgattacagaatcgtgagatctcttttctag

SEQ ID NO: 9918 - protein, 877 aa, Ashbya gossypii
MDLNHAYKASNGESNNSLDSSLDVKPMEKPATDDAVRTEKRKYHGAAVMSHHQISVMSQPLTKGVRELIKKTTAFMSCSKSKPQKLMELGPMTYAHSVLTASEKPLCHMELESSSVNGFADTLQDNGVSDATLVEMWLIRVTRRKRVRYCFRISNGVLTWKDNRMLELDTIKDIRMAEMAKNYREQYDIMDAFASRWITIIYQVSPTKLKALHLIAPTQLECAKFYNAVLTVARQRRELMESISVPSSEAFANIHWKVNVSSKKADESRDTLSFEDVQRLCTKFHIYCSSNYLKRVFKIADVNRNGLLNFSEFCTFVRMLKKRHEVTEIWQKIAAETRAIDFEKFYSFLTDVQCEDMDAQLARDLFNEYSHEGYMDEDLLLKFLTAQPYAREIEEDYSRPLSEYFISSSHNTYLLGNQVGSMASVEGYIQALQQGCRSVEIDIWDSDDGPVVCHGKLTSSLPLRNVVDVINKYAFITSPYPLILSLEIHCRSEGQIIVKQLFDDILGPLIYVADHSVGWPSLRDLKHKIIIKSKKLRVNVDMAADIYHSTSSKGSSYDSEYDVQSQPSSPMPRRGMRGIHISKRKHRVIEQLLQISAIHGITFRNFSLPESKTPTHCFSLSERSFDNLANDDLQRLAIDKHNRRHLMRVYPHAFRYKSSNYDPIKCWRLGVQMVATNWQTYDLGQQLNQAMFRVTARDDWPWPSGYVRKPEYLLHTVPKTSFIRDIYEAVHSSVVALSLELLSAQLLPKPKLSSRDGEAHFAPYVVIEVLGDGLCGPIHVQNGLVTAPNQVTSCRCPENGFNPVWKTSLTATLNNTGFNFIRYIVKNADITLATCCIRLDYMKRGYRHIPLYSLESSRFIFSTLFVKTDYRIVRSLF

SEQ ID NO: 9919 - DNA, 3468 bp, Lytechinus pictus
  CDS (1)..(3447)
atggctaagcaatatgtatttcagtggcaagtctgtgttccagaaccccttaaaaatggggcgatgttcgacagatatgaagatggggattctgggtcagtagaacagagttgcctcttcaaagttgatgaatatggattcttcatctactataagagcgaaggcagagaggggcaggtgttggaattatcccaaatcaatgatgtacggaagggtattgcaccaaaggatgtgggatacttggctaaagttggttccatccctgacccgtttgggagggggaacattgaagatcgcaccattaccatctgcagcggcttggactttgtcaacattaactacatgcacatggttgcaagcgcccctgagatagcacaggtgtggtttgatggattacttacaatcactcacaatgtcaaagctaacaatgtgtgtccaatgcagagtttaaagaaacactggatgaaaatttgctttcaagtcaaccccaatggcagaataccagtacggaatctcacaagaacgtttgcatcgggcaagacagagaagattgtcttcaagtcgctggatgagctaggacttccctcaggcaagatggatgagattgatccggctgacttcccctttgaaaagttctatgaattgtaccacaagatctgtccgaggacggatatagagctactcttcaaagatataggacgaaatgaaacggaaggattgtcggtggaaaaactgattgaatttttgaacgacaaacagagggaccctagactcaatgaaattctcttcccaatgtatgacagggaaagggtactacaaatcattgatacgtatgagaaagatcctcagatgatcaagaaagaacttctatcatctgacgggctttgtcgatatctgatgtccgatgagaacgcacccgtattcctggaccggctggagctctaccaagacatggaacagcccctttcgcattacttcattaattcgtcccacaacacgtacctgaccgggagacagtttggaggcaaatcatcggttgagatgtacagacaggttctgctggctggatgcagatgtgttgagttagactgttgggatggaaggagtgaagaccaggaaccaatcatcacccatggactggctatgtgtactgatatacaatttagggacgtgatccaagcaatccgagacactgcttttgtgacctcagacttccccgtgatactgtccttcgagaaccattgtagtaaaccgcagcaactcaaactagcgagatactgtgaagaggtcctcggcgagttcttactcacagaaaagttagatgaccatccgttggacgcgagtgttcctcttccatcacctaataaattaaagaggaagattcttataaaaaataagaggctgaaacctgaagtagaacagagacaacttgagttgatgcggttaagaccagagctgctcgaagtcaaccaggaagatgaagtagaagaatgcgaatcagggtacagtgatggtgctgtttccccaccaggcaatacggacgcgcacccgaagttcaagtttccatccaaagactccatcggaagtataagcggaagcagcatagcagctgaggatgagatcaaactcaaacacaacatgagtgtcaagatgaatgcaaagaagggggagctgttatcacaagaagatgaagcagcagtggtagcccagtaccggtatactggagccacgaccaacatccacgcctgtctctcaagactcgtcaactatgcacaacctgtcaaattccagggatttgatgttgctgaagagagaaatcttcacttcaacatgtcatcattcaatgagtctgttggcttaggatacatcaaaacacagtgtattgaatttgtcaattacaataaacgtcagatgagtagaatataccctcaaggtaggaggtatgactccagcaactacatgccgcagatcttctggaatgctggctgtcagatggtggcactgaatttccagtcaccagacatcggcatgcagctcaaccagggaaagtttgaatacaatggatgctgtgggtatttactcaagccggatttcatgaggagaccggacaggacatttgatcccttctcagagtccccagtggatggcgtgattgcggcaacatgctcagttcaggtgatatcaggccagttcttgtcagacaagaaggtaggcacgtatgtggaagttgatatgtatggtcttcctacggacacaatcaggagagaacacagaacgagaacagtccctaataatggactcaatcccgtctacaacgaagaaccttttgtatttagaaaagttgtattaccagatcttgcagtactgaggatagcggtatacgaggaagggggtaaactgataggacaaagaatcttgccattggatggactacaagcgggctatagacatatatcactgagaacagaaggtaactttcccttatcactgcccactgtcttctgttgtattcaactcaagacgtacgtaccggatggattaacacagtttgtagatgctctttcagatcctcagttatatctgtcacaagcagagaaaagagcaaagcaacttttatgcatgggaattgaagagaatgagatcagcgaggtccccacggtgaacaacaagaagaggccgaccgtacggcatccgacgacgcctaccaacacggcgccaaacatcggcggattcacgccgggcggaccgacccataaccagagaatgcaacctattactgcagagagtttaaggaaagaaagagcataccagaaactgctgaagaaacagcaaaaagaacaagattcattgagcaagagacattccaaagagagagcaatgttacagaagacgcactactcaacagtgaacaagatggaggcttgtcacgacagggaaaagctgactagagaaaagagtttagaaaaggctatcaaaaagaaaggggaaagcaactgttcagatttgaaaatagaaacagaggttcatgtacaatcattagtaaatgaccacaaagcacgggtaaaggatgtggtatcagaccagagtaaagagtttgccgacatggtgagtcgacagcaagtagaagagaggagtttgaaagagaaccatatccaacagaggtgcgacctgctaaagaaactcatgctcagtactcaggaagaacaaatgcaactattagcgggtagaaatgatagagaaatgaaggagttgaagtcaaatcaagccaaggattccatggagtcaactaaaagtgtcagccatgacaagagtatcaagaacaaagcagagagagataggagagttcgggagcttcaaagtaataacacaaagaaattcctagaagagagaaaaaggctgaaaatgaaacaagacgaggagaaagaagaagttcaacaggaacattagcaaaaaaaaaaaaaaaaaaaa

SEQ ID NO: 9920 - protein, 1148 aa, Lytechinus pictus
MAKQYVFQWQVCVPEPLKNGAMFDRYEDGDSGSVEQSCLFKVDEYGFFIYYKSEGREGQVLELSQINDVRKGIAPKDVGYLAKVGSIPDPFGRGNIEDRTITICSGLDFVNINYMHMVASAPEIAQVWFDGLLTITHNVKANNVCPMQSLKKHWMKICFQVNPNGRIPVRNLTRTFASGKTEKIVFKSLDELGLPSGKMDEIDPADFPFEKFYELYHKICPRTDIELLFKDIGRNETEGLSVEKLIEFLNDKQRDPRLNEILFPMYDRERVLQIIDTYEKDPQMIKKELLSSDGLCRYLMSDENAPVFLDRLELYQDMEQPLSHYFINSSHNTYLTGRQFGGKSSVEMYRQVLLAGCRCVELDCWDGRSEDQEPIITHGLAMCTDIQFRDVIQAIRDTAFVTSDFPVILSFENHCSKPQQLKLARYCEEVLGEFLLTEKLDDHPLDASVPLPSPNKLKRKILIKNKRLKPEVEQRQLELMRLRPELLEVNQEDEVEECESGYSDGAVSPPGNTDAHPKFKFPSKDSIGSISGSSIAAEDEIKLKHNMSVKMNAKKGELLSQEDEAAVVAQYRYTGATTNIHACLSRLVNYAQPVKFQGFDVAEERNLHFNMSSFNESVGLGYIKTQCIEFVNYNKRQMSRIYPQGRRYDSSNYMPQIFWNAGCQMVALNFQSPDIGMQLNQGKFEYNGCCGYLLKPDFMRRPDRTFDPFSESPVDGVIAATCSVQVISGQFLSDKKVGTYVEVDMYGLPTDTIRREHRTRTVPNNGLNPVYNEEPFVFRKVVLPDLAVLRIAVYEEGGKLIGQRILPLDGLQAGYRHISLRTEGNFPLSLPTVFCCIQLKTYVPDGLTQFVDALSDPQLYLSQAEKRAKQLLCMGIEENEISEVPTVNNKKRPTVRHPTTPTNTAPNIGGFTPGGPTHNQRMQPITAESLRKERAYQKLLKKQQKEQDSLSKRHSKERAMLQKTHYSTVNKMEACHDREKLTREKSLEKAIKKKGESNCSDLKIETEVHVQSLVNDHKARVKDVVSDQSKEFADMVSRQQVEERSLKENHIQQRCDLLKKLMLSTQEEQMQLLAGRNDREMKELKSNQAKDSMESTKSVSHDKSIKNKAERDRRVRELQSNNTKKFLEERKRLKMKQDEEKEEVQQEH

SEQ ID NO: 9921 - DNA, 1797 bp, Oryza sativa
  CDS (1)..(1797)
atgggcacgtacaagtgctgcctcatcttcaagcgccgcttccgctggaacgacgcgccgccgcccgacgatgtccgcgccctcttcgccaaccactccgccggcggtggcccccacatggccgccgacggcctccgcgcctacctccaggccaccggccaggacggcgacgtggacatggagcggctggtggagcagatccggcagctgcaggggcgcggcgggcgcatcccgcgggtggggcgggcactcccactcctgacggtggacgacttccaccgattcctcttctcccacgagctgaacccacccatccggcacgggcaggggcaggtgcaccacgacatggccgccccgctctcccactacttcatctacaccggccacaactcctacctcaccggcaaccagctcagcagcgactgcagcgacctccccatcatcagggctctccagaggggcgtccgcgtcatcgagctcgacatgtggcccaactcctccaaggatgacatcagcatcctccatggcaggacgctcaccaccccggtctccctcctcaaatgcctcctctccatcaagcaacacgcctttgaggcctccccttacccggttatcatcacgctcgaagaccacctcacccccgatctccaggacaaagcagccaagatggttcttgaagttttcggcgacatcctctactaccctgacaaagatcacctcaaagagttcccttcgcctcaagacctcaagggccgtgtcctcctctccaccaagccccccagggagtaccttcaagccaaggatggtaatgctgccaccatcaaagaggacgccaaggccgccgccactgacgatgccgcatggggaaaagaagtcccagatattcactctcaaatccactctgccactaaacatgaccaaagagaagatgacgacgacaccgatgaagacgaagatgacgaggaggaggagcagaaaatgcaacagcatctagctccacagtacaaacaccttattaccatcaaagcaggaaagccaaaaggtactctacttgatgccttacagagtgacccagaaaaggttagaaggctcagtttgagcgagcaacaacttgccaaattggcagatcatcatggtaccgaaattgtaaggttcacacagagaaacctactgaggatatacccaaagggcactcgggtcacatcatccaactataatccatttcttggttgggtgcatggtgctcagatggtagcgttcaatatgcagggatatggaagagctctttggttgatgcatggattttataaagctaatggtggctgtggttatgtgaagaaaccagatttcttaatgcaaactgatccagaggtttttgacccaaaaaaatccctatctcccaagaaaaccttgaaggtgaaagtatacatgggggatggttggcggatggacttcacgcagacccactttgatcaatattctcctccagacttttatgcacgggtggggatagcgggagtaccagcggactcggtgatgaagagaacgagggcgatagaggataactgggtgccggtgtgggaggaggatttcaccttcaaactgaccgtgccggagatcgcgttgctgcgggtggaggtgcacgagtacgacatgtcggagaaggacgacttcggcggccagacggtgctgccggtgtcggatctcatcccggggatccgagcggtggcactccacgaccgcaaagggatcaagttgaacaacgtcaagcttctcatgcgcttcgagtttgaatga

SEQ ID NO: 9922 - protein, 598 aa, Oryza sativa
MGTYKCCLIFKRRFRWNDAPPPDDVRALFANHSAGGGPHMAADGLRAYLQATGQDGDVDMERLVEQIRQLQGRGGRIPRVGRALPLLTVDDFHRFLFSHELNPPIRHGQGQVHHDMAAPLSHYFIYTGHNSYLTGNQLSSDCSDLPIIRALQRGVRVIELDMWPNSSKDDISILHGRTLTTPVSLLKCLLSIKQHAFEASPYPVIITLEDHLTPDLQDKAAKMVLEVFGDILYYPDKDHLKEFPSPQDLKGRVLLSTKPPREYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKSLSPKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSDLIPGIRAVALHDRKGIKLNNVKLLMRFEFE

SEQ ID NO: 9923 - DNA, 2430 bp, Physcomitrella patens
  CDS (167)..(2071)
attcgtccactcggcccatctccactgacttccccaattgagatcagatggtcttgtaaggcagagagcgagcgagagagagagagagagagagagagagattgggagttgaggcgaaggggaggtgtcggaggggatttattgtgccgtagctgggtttgcaaaaatgtgttctattccgttcggtcggaagaagtccaagaagggggatttggcgcaggatctattgggggatgtgttctcgacttacagcgagaatgggaagctggacgccgaggggttgctgaagttcttgcagacagagcaaggggatagcaagtcctctctagatgacgccaagcatttagtggagttgattcggaatgagagacataagtcgaaattccctgggttcatcgtcagctcggacctgtcgaagggtgattttaaaaactatgtactgagcccggatttgaatggggttcttgaaagcactgtgcatcaagacatgacgcagccgttatcgcactacttcatattcactggtcacaactcgtacttgacgggtaaccagcttagcagcgacagtagcgacgttcccattgctgctgcactgcaacgtggcgtgcgggtggtggaactggatttgtggcctgacgataaaggcggcatcaaggtcactcacgggaacacactcaccagtccagttgctttcgagaagtgcataaaagccatcaaggccaatgcgttcgtctcctcgaaatatcctgtagttatcactcttgaggatcatctttcaagtcctttacaggcccttgctgcagagactttgacgaacattttgggagaggacttgtactatccaccctcatccgatgggtttaaagaactgccttctccggaatcattgaaagggaaaattctaatatctaccaaaccgccgaaagaataccttgaagccgctgtcgcacagaagtcggcgttgaaagatgaaaagattttgaatgagctcaagaaggcagataagttgcaggagcagtcaactgctcctgttaaaagccccgttgagaaaaagattgcagttccaccatcagagaagacaaaatccatttccgaagagaaggacttgagtgaaaaagttggaaatttacgtgttgattcagagggtgaatcagctgatcctgcccctgcaagttcccccgacggtaagaaagcaacattgacagcggatagtgaaagtgacgatgacgacaataagaagaatcctgagtatgctcggcttatcactatccaccaatcgaagccttcgaaaggaactaccgtggaagacagactgaaagttgaagggacagtggtacggattagtctttcagagactaagctggagaaggtcactgaagagtttcctgaacttgtggtcaagttcacgcagaggaacattctacgtgtgtatcctgctggtaaccgagtaaactcgtccaactatgatcctactgcggcttggattcacggagctcaaatggtggctcaaaatatgcaaggttacggcaaagagctctggcaagcccacggcaagttcaggggaaatggtggctgtggatacatccttaagccaaagtatctattggaagatttgcccaatggtaaaccttttaacccttcagctcctggagatacgaagatgatcttgaaggtaaaggtaatgacaaccatgggatgggacaaagcgttccccaaataccatttcgaccttttctcgcctccagatttcttcactaggctgcttgtgactggagtgcctgccgatgtggcaaagtggaaaacttccgttatagatgacgtttgggaaccccactggaacgaggatcacgagttttaccttaaatgccctgaacttgcactgctccgaattgaagttagagatcacgacgagggaagtcaagatgagttcgaagggcaggcgtgccttccaatgcatgaaattaaagacggctatcgatgcgtgcagatgtatgacaaaaagggcagtgtgttgaagggcgtgaaaatgttgttccattttcaaaaacgttcgttttctccggtccagtaattcatcgttttcaaaaacatttctgtctcaatcctgcaacgagtaattttagagaaggaaggctaacgcactcgagatgtctgaaaggtgaagagttggagggaagaagggtagctcgctgtatcaccgagctctagtgaacttcaggtgtcattctttgagggcagctcatctttctcatgcatgtggaacgctgaggtgttggaaattaaattagtctatgacagagcattgatcacgttcatagagcaatgtccaactagtaagatgtcttggtgatggccttagcaaaattcataatcaattaatattaaaaattgtatataaaaaaaaaaaaaaaaaaaaaaaaaaaaaaaaaa

SEQ ID NO: 9924 - protein, 634 aa, Physcomitrella patens
MCSIPFGRKKSKKGDLAQDLLGDVFSTYSENGKLDAEGLLKFLQTEQGDSKSSLDDAKHLVELIRNERHKSKFPGFIVSSDLSKGDFKNYVLSPDLNGVLESTVHQDMTQPLSHYFIFTGHNSYLTGNQLSSDSSDVPIAAALQRGVRVVELDLWPDDKGGIKVTHGNTLTSPVAFEKCIKAIKANAFVSSKYPVVITLEDHLSSPLQALAAETLTNILGEDLYYPPSSDGFKELPSPESLKGKILISTKPPKEYLEAAVAQKSALKDEKILNELKKADKLQEQSTAPVKSPVEKKIAVPPSEKTKSISEEKDLSEKVGNLRVDSEGESADPAPASSPDGKKATLTADSESDDDDNKKNPEYARLITIHQSKPSKGTTVEDRLKVEGTVVRISLSETKLEKVTEEFPELVVKFTQRNILRVYPAGNRVNSSNYDPTAAWIHGAQMVAQNMQGYGKELWQAHGKFRGNGGCGYILKPKYLLEDLPNGKPFNPSAPGDTKMILKVKVMTTMGWDKAFPKYHFDLFSPPDFFTRLLVTGVPADVAKWKTSVIDDVWEPHWNEDHEFYLKCPELALLRIEVRDHDEGSQDEFEGQACLPMHEIKDGYRCVQMYDKKGSVLKGVKMLFHFQKRSFSPVQ

SEQ ID NO: 9925 - DNA, 2423 bp, Physcomitrella patens
  CDS (208)..(2127)
acgcgggggcgttgttcaacgtttacaattgctgtgcgtgcttctttgatgcattgcacccactcggtgtatacatatggcgctaatttttgtgtagtttcgttgaggaagatctttcatcaggactccctttgagatctaagcacccgcatctgcgggcgttggtgtcgttctcagattacgagttgtctagcaggctagcttaggatggtgtctattgcgcgattgaaagaggcatgttcgcattgcctaccgcccaccgtagcgccctaccatgctgtatgtactccgccagcattagttacaagagtttttgagcaggcgacgataggaagggatgtacgggtaattggtcccgccgatttggcaaaatttatgacagattggcagggcgacagaaatgcgaccgaagagcgcgcgacatccttgatggctgattttaatttcttgaagtcgactgcctctcgcgccttgaggattcctgggttaagtcacagctcgaaatattcccttagctccaggcacagtggctccaaacacggtcaatcggcgccagagactcctacttttgacattgctacctttctaaagtttctcctgcatcctgaatttaacggtcaccgagtacctgtttcgaaaacgccgacagacgacatgaatgcgccactatcagattactatatcttttcgagtcacaatacctacttgatgggaaaccagttgtgtagtccatccagcactgcccccattgtgaaagcactgctggatggatgtcgtgtaatcgagctggattgttggaatggctctaacaaaagaattgatgtccttcatggcgggaccttgacgaaggcagttccatttgaggactgcgttaaggcaataaaagacaatgccttcacgacttcggcttatcctgtcgttgttaccattgaaagtcacttggatctagagcaccagaaggaagccgccagggtgttaaacaagatactcggtaatatcatgtttgtcccccctcccaatgaacttccaccccaatcttttcgatcacctgagcagttgaagcatcgcattatcatttctgataaacctccgggtgacgcacttttaagtcaggctgcaaatgagcctgaatttgcacagcagacgctattgcatgaagtggtgagagaccccagcccagacaacagacatgaacacagacatggacggagggggaagaagaagaagctacgcagacgtcaaagccaaatcgctgaaagcaggatacagaaactgccctcaggaaaacttggtgactctggcaggccagccatagccaatgatcctgcgtttgatgaattattatacattcattgtcaaaaacccacagaaatggctaccgcgcaaaagaaaggtggcccattgattaaaggacaacatgcaataatggctaatctaagcgaatcacaactcgatgaccttattgaggatcacaccgattctctgatagagttctcgaagaccaatttgactagagtgtacccatttggacttcgggttacttcatcaaatgcagaccctatggacgcttgggagcatggagttcaagttgcagctataaatatgcaaggacgagatcgacctgtatggatatccaaagcaatatttatgaggaacggtggttgcggctacgtcaagaagcccgatattcttctacctgaatctaatatggaccataaaagcctaatgaatttgcaaccaaagcttgagctgaaggtgacggttctattggggaccgactggcacaaaaactatgacgtcttcaagaaaccaggctattttatgaaggttgccatacatggcatgcatgacgatgagcagaagttcaaaacacatgtgtgcaaacggtctcgggaacctcactgggaggtagaagaatttgtatttcaaattcgagtgccaaagctagcaatactcaggttggaggtgagggagtatgacagaatcgtccgagatgatatggttggccaatcttgcgtacccgtcactgagcaccggcagggaattcgtgctgtgcaactggcatctaaaaagggagagcctgggagctcgaagctcttgtgccacttcatcacacgtacattatgagttcgcaccaagtaatttactgatttggtagctgatttgatagctgatttcttataattcaagtttgcattgttttgagtgtttatttcatgaatattcagaaggagctcctccatggttgcattattcttcttttgaagcaatccttgaccatggccgcaatattgtaaataaattctttctcctaatcaacgaattccagtagtgacgtaggtagcaggatattgttccttacgtatccaatttataaatcaaatctcatctgttgagtaaaaaaaaaaaaaaaaaaaaaaaaa

SEQ ID NO: 9926 - protein, 639 aa, Physcomitrella patens
MVSIARLKEACSHCLPPTVAPYHAVCTPPALVTRVFEQATIGRDVRVIGPADLAKFMTDWQGDRNATEERATSLMADFNFLKSTASRALRIPGLSHSSKYSLSSRHSGSKHGQSAPETPTFDIATFLKFLLHPEFNGHRVPVSKTPTDDMNAPLSDYYIFSSHNTYLMGNQLCSPSSTAPIVKALLDGCRVIELDCWNGSNKRIDVLHGGTLTKAVPFEDCVKAIKDNAFTTSAYPVVVTIESHLDLEHQKEAARVLNKILGNIMFVPPPNELPPQSFRSPEQLKHRIIISDKPPGDALLSQAANEPEFAQQTLLHEVVRDPSPDNRHEHRHGRRGKKKKLRRRQSQIAESRIQKLPSGKLGDSGRPAIANDPAFDELLYIHCQKPTEMATAQKKGGPLIKGQHAIMANLSESQLDDLIEDHTDSLIEFSKTNLTRVYPFGLRVTSSNADPMDAWEHGVQVAAINMQGRDRPVWISKAIFMRNGGCGYVKKPDILLPESNMDHKSLMNLQPKLELKVTVLLGTDWHKNYDVFKKPGYFMKVAIHGMHDDEQKFKTHVCKRSREPHWEVEEFVFQIRVPKLAILRLEVREYDRIVRDDMVGQSCVPVTEHRQGIRAVQLASKKGEPGSSKLLCHFITRTL

SEQ ID NO: 9927 - DNA, 3438 bp, Aspergillus fumigatus
  CDS (1)..(3438)
atggcttatgctactacttcgtcgcctgcggctctcaatggcgacgctgaatccagtttaaatatcaacaattctctccccaaccctccaaaattacaccatgtcatcaagtctttttcgcccgcaactcagacctcctcgacaacctcttatatatcttcgctcacaactactccctcatctctcttccccgcttccaaccattcaaatgcgtctagcccttcaggcacaccattacagattgctaccgacgcccttcaggggcgtttatctacttttcctcccgtttcgctttcctctttcgagcttggagagtcaatgatggctgtcccaggtaatccggcaacctcaaatgtggactctgtgtcccccaatccgaataaaggcgctggcctgatgcggagaatatcgagaggcgcagccagcaagctcacacgaagaagacaatctgcgactcacagtgataaacgagatcgcagctccggtccggtcattatgcggcgacgcagcgacagtaaaactgcagctcaaaccggacgtgagtgtgcccttgattctagcaacgaagaagatggcaacgacgcggtggattctctgggtgtctggtgtggctcggaagcgcccagtctctcgactgacgccagtatgatggcctcgcgcaacgtgggcgctgttgcgcccaaagtcgattcggcgattcagcgcgggacggtgttgacgaaagtgactaagaagcgcaagaagcaggtgcgcttcttcctcgaccttgatgcaggcaaggtttactgggatctgtcaaacccggcgaaacgcttttacattgacgatatcaaggaggtccgcgtcggagtggatgcgcgcaactatcgcgaggaacaccaagtccctcaggatgttgaaggccgctggttcaccattgtcattgctgatcctgaaaagtccaagggtcggtccgtcaagacgttgcacctcattgctcccaatgaccatatccttgaactttggacaacgactttggagaatatctctcagtatcgaatcaatctcatggctggcttggctggttccggtcagagtgagactgtcttgaaagtacactggcaacgtgaaatgtcaaggctgttccctcagggcttagcgcccggcgaagaagagagtcttgacttcggtgccgttgaaacagtttgtagaagcttgcatatcaattgttcaaagaacatgcttcgagctcagttttccaaggctgatcttggcaacaagggtcgactcaacttttcggaatttcagaactttgtcgctcgtctaaaagaaaggaaagatatcaatgacttgtacaaaacgtgggccacgaatgcccaggaaggtctcactgtcgacgaatttctggcttttctccgcgacgcacagcaagaagatgttgataccgatcgagcctattgggtctcagtttttgaaaaatatgtccgaaagtgcaaaccgcgagcaccaagtcttacagatggtgtggaacgtcaggctttccgaatgagcctggaagccttctctgcctttctctcgtccaactggaatggaatatacgcatctcgcccccctcaatcgcgatttgaccgaccgctcaatgagtatttcatttccagctcccataacacgtacctgttaggccgtcaagttgccggcgcttccagcacagaggcgtatatcagcgctctgtcacagggctgccgatgtgtcgagattgactgctgggacggtgccgatggccgcccgatcgtttcgcatggacggacgatgacaaccagtgttctcttcgctgattgcattactgtcatcaaccgatatgcatttatcacctgcgacttcccgctaatcctctcgctcgaggttcattgcaatcctgaacagcagctggcgatggtcaggatcatgaaagacacattcaaggaacgactcgtcctggagccgctcttgacaaatagttttgtcctcccatcaccagaagaactgaagggccggattctcgtcaaagtcaaaacatgtgacgagaccctcgatggagtgcgacaagatacctcgacctctttcgcgagcgctggtcggaagcgcagctcaagctccccatggatgcgtcctagcgtccctgagaatcctttgtgcacgaaccttcctcctctctccagtcctatgaccattggccaggagagtgtagggccgttcgtttcacaggatagacggtctttcaccaccacaagtatgagtagcgcgacagaagacagcgatggcgcgttggtgtcagtcaagagagaaagaagacgacgtcaaaagagcaagatcacgaagcctctatcagaccttggagtctacacccgtggctacaaatggcatagtttctcgtctcccgagagtcagcggttcaaccatgtttactccttcgcggagcgggcgttcgagagcatctgccgtgacgcggagaataaggcgctgttggaaaggcacaatcaaaaatacctcacgcgagtctatccatccgggtttcgcttgcgttcgtccaatttcgatccgctcaagttctggcgacgcggcgtgcaaatggccgccttgaattggcaaacgtacgacatcggaatgcagctgaaccaagccatgtttgcggctggaactgaccgcactggctacgtcctgaagcccgaatcacttcgtctcccaccttacgagcaagcgagcaagacgtccaccgaacggaagctggttcggttctcagtggaggtcatttctgctcaacaacttcctcgaccacgtaccatgggaccagatgacaatatcaacccatatgtggaaattgagatgttcagcgcagacgatcgcggccagagttttgtcgtcggagaaggaggcatgaatgcttccgcgcggaatggcgtgtcgggcattggctatccgcatcgtcgacgcacaaagatcgagcagagcaacggatacagcccaactttcaatgatcgtttcaagctatcgctcgagaccaagtatccagacttggtgttcgttcgttggactgtttggagctcactggatgggcgcagtgctgggaacaacaacagtgttcaattggccactttcactgcaaaactgagcagtctgtctcagggttaccgttacctgccactgtatgacctgggcggtgatcaatatctgttctccaccctattctgcagaattactaaggaggagccggtgccggttcaacgactcggagccgaggaacttcgagcggagcgtctggggatccttcgtcagattggtcaaacagtgttcaagcgtggttcatcgacagagagatctgacaagggcagcgagacgcctgcaagccaagacgataaggatacgtctccggtattgacgcctactgtttcaacgacgtccacatcatctctgtttctttaa

SEQ ID NO: 9928 - protein, 1145 aa, Aspergillus fumigatus
MAYATTSSPAALNGDAESSLNINNSLPNPPKLHHVIKSFSPATQTSSTTSYISSLTTTPSSLFPASNHSNASSPSGTPLQIATDALQGRLSTFPPVSLSSFELGESMMAVPGNPATSNVDSVSPNPNKGAGLMRRISRGAASKLTRRRQSATHSDKRDRSSGPVIMRRRSDSKTAAQTGRECALDSSNEEDGNDAVDSLGVWCGSEAPSLSTDASMMASRNVGAVAPKVDSAIQRGTVLTKVTKKRKKQVRFFLDLDAGKVYWDLSNPAKRFYIDDIKEVRVGVDARNYREEHQVPQDVEGRWFTIVIADPEKSKGRSVKTLHLIAPNDHILELWTTTLENISQYRINLMAGLAGSGQSETVLKVHWQREMSRLFPQGLAPGEEESLDFGAVETVCRSLHINCSKNMLRAQFSKADLGNKGRLNFSEFQNFVARLKERKDINDLYKTWATNAQEGLTVDEFLAFLRDAQQEDVDTDRAYWVSVFEKYVRKCKPRAPSLTDGVERQAFRMSLEAFSAFLSSNWNGIYASRPPQSRFDRPLNEYFISSSHNTYLLGRQVAGASSTEAYISALSQGCRCVEIDCWDGADGRPIVSHGRTMTTSVLFADCITVINRYAFITCDFPLILSLEVHCNPEQQLAMVRIMKDTFKERLVLEPLLTNSFVLPSPEELKGRILVKVKTCDETLDGVRQDTSTSFASAGRKRSSSSPWMRPSVPENPLCTNLPPLSSPMTIGQESVGPFVSQDRRSFTTTSMSSATEDSDGALVSVKRERRRRQKSKITKPLSDLGVYTRGYKWHSFSSPESQRFNHVYSFAERAFESICRDAENKALLERHNQKYLTRVYPSGFRLRSSNFDPLKFWRRGVQMAALNWQTYDIGMQLNQAMFAAGTDRTGYVLKPESLRLPPYEQASKTSTERKLVRFSVEVISAQQLPRPRTMGPDDNINPYVEIEMFSADDRGQSFVVGEGGMNASARNGVSGIGYPHRRRTKIEQSNGYSPTFNDRFKLSLETKYPDLVFVRWTVWSSLDGRSAGNNNSVQLATFTAKLSSLSQGYRYLPLYDLGGDQYLFSTLFCRITKEEPVPVQRLGAEELRAERLGILRQIGQTVFKRGSSTERSDKGSETPASQDDKDTSPVLTPTVSTTSTSSLFL

SEQ ID NO: 9929 - DNA, 25 bp, Primer
atgactgaaagtgctatagatgacc

SEQ ID NO: 9930 - DNA, 29 bp, Primer
ctataaaatttgtgtatgaataaataaag

SEQ ID NO: 9931 - DNA, 1259 bp, Escherichia coli K12
  CDS (170)..(916)
gcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgcatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgccttatttttggcgtgctaaccattgttcccttcttctggggcatgctggcgttacgggcctggcactatgacgagaatcattacagtggcgcaatatggctgctctatgtcatgatcctggtatggggcgctgactccggcgcatatatgtttggcaaattgtttggtaaacataagctggcaccgaaggtttctccgggtaaaacctggcaaggctttatcggtggactcgctactgcagcggtaatctcatggggttatggcatgtgggcgaatctcgacgtcgctcccgtcaccttactcatttgctctattgtcgcagcgttagcctcagtgctcggcgatctgaccgagagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgca

SEQ ID NO: 9932 - protein, 249 aa, Escherichia coli K12
MLAAWEWGQLSGFTTRSQRVWLAVLCGLLLALMLFLLPEYHRNIHQPLVEISLWASLGWWIVALLLVLFYPGSAAIWRNSKTLRLIFGVLTIVPFFWGMLALRAWHYDENHYSGAIWLLYVMILVWGADSGAYMFGKLFGKHKLAPKVSPGKTWQGFIGGLATAAVISWGYGMWANLDVAPVTLLICSIVAALASVLGDLTESMFKREAGIKDSGHLIPGHGGILDRIDSLTAAVPVFACLLLLVFRTL

SEQ ID NO: 9933 - DNA, 798 bp, Neisseria meningitidis
  CDS (1)..(798)
atgctgaaacaacgggtgataaccgccatgtggctgctgccgctgatgctgggcatgctgttttacgcgccgcaatggttgtgggctgcattttgcggactgattgccctgattgccttgtgggaatatgcccgtatgggcggtttgtgcaaaattaaaaccaaccattacctcgccgcaaccttggttttcggcgtggttgcctatgcgggcggctggatgctgcctaatttggtttggtatgttgttttggcattttggctcgccgttatgcctttatggttgagattcaaatggaggctcaacggcggttggcaggtttatgccgtcggctggcttctggtcatgccgttttggttcgcgctcgtatccctgcgcccgcatcccgatgatgccctgccgctgctcgccgtgatgggtttggtgtgggttgccgatatttgcgcgtatttcagcggcaaggcgttcggcaaacacaaaatcgcaccggcaatcagccccggcaaaagctgggaaggtgcaatcggcggcgcggtttgcgtggccgtgtacatgaccgccgtacgaagtgccggctggctggcattcgatacaggctggttcgataccgtgttaatcggtttggtgttgaccgttgtcagcgtatgcggcgaccttttggaaagctggctcaagcgcgcggcaggcatcaaagacagcagcaacctgctgcccggacacggcggcgtgttcgaccgcaccgacagcctgattgccgttatcagcgtctatgcagcgatgatgtcggttttaaattga

SEQ ID NO: 9934 - protein, 265 aa, Neisseria meningitidis
MLKQRVITAMWLLPLMLGMLFYAPQWLWAAFCGLIALIALWEYARMGGLCKIKTNHYLAATLVFGVVAYAGGWMLPNLVWYVVLAFWLAVMPLWLRFKWRLNGGWQVYAVGWLLVMPFWFALVSLRPHPDDALPLLAVMGLVWVADICAYFSGKAFGKHKIAPAISPGKSWEGAIGGAVCVAVYMTAVRSAGWLAFDTGWFDTVLIGLVLTVVSVCGDLLESWLKRAAGIKDSSNLLPGHGGVFDRTDSLIAVISVYAAMMSVLN

SEQ ID NO: 9935 - DNA, 855 bp, Xylella fastidiosa
  CDS (1)..(855)
atgacccgaacccgtgtcattgccgcgctggtcatggcacccgtcgcaatgtgttcgatcctgtttttaccaacggcctggttagcctcattgacagcaatcatcttcctatggggcttatgggaatggatgaagttgtcccaggtagaggacaccttggtacgcaccgtgctgctgacactgaacctgctgctcatggtgttattggtttgggtttcagctcacacactggtgctgtttcagattgccacgctcattggtatcgcctggtggatcctagcattgttatggctacgcttcctcggattttgtgccgaccctaaccaacgcaccgcaaagatagtcaaactcaccgcaggcacgttagcggtgattccagcgtggtctgcactggtcctactccactcaggtgataagcctggctcaacatttccagagagcttacatgcccacctgtggctgctaacggctcagataatggtatgggccgctgactccggagcgtattttgctggtcgcctctttggtaaacacaaactggcacctcagatcagccccaacaaaactgtagaaggcctcctcggcggcatactcactggattggcagtagcgactggttttggtctattgaatggcgtcaccatgacccagttcccatcactattgctcgtttcattcgtagcaatcttggcttcggtgatcggcgatttgttcgaaagcctgcttaagcgccacgccggcatcaaagattccgggagtatgattccaggccacggcggcgttctcgatcgtatcgatagcacgctcgccgcacttcccgtgttcgcactgggaaaagacatcttcggtttctga

SEQ ID NO: 9936 - protein, 284 aa, Xylella fastidiosa
MTRTRVIAALVMAPVAMCSILFLPTAWLASLTAIIFLWGLWEWMKLSQVEDTLVRTVLLTLNLLLMVLLVWVSAHTLVLFQIATLIGIAWWILALLWLRFLGFCADPNQRTAKIVKLTAGTLAVIPAWSALVLLHSGDKPGSTFPESLHAHLWLLTAQIMVWAADSGAYFAGRLFGKHKLAPQISPNKTVEGLLGGILTGLAVATGFGLLNGVTMTQFPSLLLVSFVAILASVIGDLFESLLKRHAGIKDSGSMIPGHGGVLDRIDSTLAALPVFALGKDIFGF

SEQ ID NO: 9937 - DNA, 936 bp, Pseudomonas aeruginosa
  CDS (1)..(936)
atgaacgaacagacctggatgctcttcggcgggatcggcgcgctgctgctgctcgcctcgctggtcggcttcgtcctcaagtggcgcgccggtcccggcccgaacgcggtgatcgacaacctgaacgcgcggatcaacgcctggtgggcgatggtcctggtgatcggtttcgccttctggcttggccaggcggcggtgatcctgctgttctatggcgtgtcgttctacgccctgcgcgagttcatcaccctcaccccgacccggcgcagcgactacccggcgctggtggcggcgttctacttcgtgctgccgatgcagtacctgctgatctacatcgactggtacagcatgttctcgatcttcatcccggtgtacgtgttcctgctgttgccgatcctcgcctcgctgggcggcgacaccaagcacttcctcgagcgcgcctcgaaagtgcagtggggcctgatgctggcggtgttctgtatctccttcgtgccggcgctgctgaccctcgacatccccggcttcgaggggcgcaacctgctgctgatcgcctacctggtgatcgtcgtgcagctctccgacgtgatgcagtacatctgcggcaagctgttcggcaagcgcaagatcgctcccaacctgtcgccgtcgaagaccgtcgaaggcttcgtcggcggcatcgccctggccaccgccatcggcgcctcgctgtggtggatcaccccgttcaacctctggcaggcggcgttgatcgcgctgctgatcaacctgctgggcttcttcggcggcctggtgatgtcggcgatcaagcgcgaccgtggggtcaaggactgggggcacatgatcgaaggtcacggtggcatgctcgaccgcctggactcggtgtgcttcgccgcgccgatcttcttccacgtggtgcgctactggtggacgccctga

SEQ ID NO: 9938 - protein, 311 aa, Pseudomonas aeruginosa
MNEQTWMLFGGIGALLLLASLVGFVLKWRAGPGPNAVIDNLNARINAWWAMVLVIGFAFWLGQAAVILLFYGVSFYALREFITLTPTRRSDYPALVAAFYFVLPMQYLLIYIDWYSMFSIFIPVYVFLLLPILASLGGDTKHFLERASKVQWGLMLAVFCISFVPALLTLDIPGFEGRNLLLIAYLVIVVQLSDVMQYICGKLFGKRKIAPNLSPSKTVEGFVGGIALATAIGASLWWITPFNLWQAALIALLINLLGFFGGLVMSAIKRDRGVKDWGHMIEGHGGMLDRLDSVCFAAPIFFHVVRYWWTP

SEQ ID NO: 9939 - DNA, 1293 bp, Arabidopsis thaliana (mouse-ear cress)
  CDS (1)..(1293)
atgacaaatacgaacacactcttcctcagacatgatgatgattcagagattttgatttttcaagaaaactctgtttttcctctttttgtttttgcctcttggggcatttggagagcaatggcgacttttgctgaacttgttttatcgacttctcgctgtacatgcccttgccgttcattcactagaaaacccctaattcgtccccctttatctggtctgcgtctccccggtgataccaaaccattgtttcgttccggacttggtcggatttctgttagccggcgtttcctcacggccgttgctcgagctgaatcagaccagcttggtgatgatgaccactcaaagggaattgatagaatccataacttgcagaatgtggaagataagcagaagaaagcaagccagcttaagaaaagagtgatctttggtattggcattggtttacctgttggatgtgttgtgttagctggaggatgggttttcactgtagctttagcatcttctgtttttatcggttcccgcgaatatttcgagcttgttagaagtagaggcatagctaaaggaatgactcctcctccacgatatgtatctcgagtttgctcggttatatgtgcccttatgcccatacttacactgtactttggtaacattgatatattggtgacatctgcagcatttgttgttgcaatagcattgttagtacaaagaggatccccacgttttgctcagctgagtagtacaatgtttggtctgttttactgtggttatctcccttctttctgggttaagcttcgctgtggtttagctgctcctgcgcttaacactggtatcggaaggacatggccaattcttcttggtggtcaagctcattggacagttggacttgtggcaacattgatttctttcagcggtgtaattgcgacagacacatttgcttttctcggtggaaagacttttggtaggacacctcttactagtattagtcccaagaagacatgggaaggaactattgtaggacttgttggttgtatagccattaccatattactctctaaatatctcagttggccacaatctctgttcagctcagtagcttttgggtttcttaacttctttgggtcagtctttggtgatcttactgaatcaatgatcaagcgtgatgctggcgtcaaagactctggttcacttatcccaggacacggtggaatattagatagagttgatagttacattttcaccggcgcattagcttattcattcatcaaaacatccctaaaactttacggagtttga

SEQ ID NO: 9940 - protein, 430 aa, Arabidopsis thaliana (mouse-ear cress)
MTNTNTLFLRHDDDSEILIFQENSVFPLFVFASWGIWRAMATFAELVLSTSRCTCPCRSFTRKPLIRPPLSGLRLPGDTKPLFRSGLGRISVSRRFLTAVARAESDQLGDDDHSKGIDRIHNLQNVEDKQKKASQLKKRVIFGIGIGLPVGCVVLAGGWVFTVALASSVFIGSREYFELVRSRGIAKGMTPPPRYVSRVCSVICALMPILTLYFGNIDILVTSAAFVVAIALLVQRGSPRFAQLSSTMFGLFYCGYLPSFWVKLRCGLAAPALNTGIGRTWPILLGGQAHWTVGLVATLISFSGVIATDTFAFLGGKTFGRTPLTSISPKKTWEGTIVGLVGCIAITILLSKYLSWPQSLFSSVAFGFLNFFGSVFGDLTESMIKRDAGVKDSGSLIPGHGGILDRVDSYIFTGALAYSFIKTSLKLYGV

SEQ ID NO: 9941 - DNA, 828 bp, Caulobacter crescentus
  CDS (1)..(828)
atgacgtcgccgtcgccggctaagcgcttcaactggggcaatcttcgaacgcgcgtggtctcggcgaccgtgctcgttcccaccgtcgtggccgccgtatggctcggcggttactggttcatggccctgtctctggtctgcgtcgggcttttggctcgcgagtggggacggatcagcgcgccaaaggcgccgaacgccgtcggcgccgtggttggcgtcttctgcgggatcgccgtcgtcgcggcgttcctgcagcagtttctggtcgcctgggccgttgtactggtgggctctttcctggctggcctgatcgcgcgcggcgccgtggagcggcgcgccgacgccgcctatggcgtggtctatatcgcgccggcggtgatcgcgatggtctgggtgcgatcgctggacgacgggctttggtggaccctgctgctgtttgtcgtgacgtggttcgccgacatcttcgcctatgtcacgggcagcattctcaaggggccgaagctttggccgcgcatctcgcccaacaagacgtgggcgggcttcgtcggcggtcttgcagctgcaaccatcggcgcggtcgttgtcgcctctctggccaagcttgatctgatctggcaggcggcggcgctgatcggtctgttgggcggtctggcgacgatggcgggcgatctctgggagtcgatgctcaaacgtcggttcggcgttaaggacagtggcgatctcattcccgggcatggcggcctgctggatcgggtggatggtctgatgttcgcggccattgtgatcgcggccgtacggctggtcgatcagatcggatgggggcattga

SEQ ID NO: 9942 - protein, 275 aa, Caulobacter crescentus
MTSPSPAKRFNWGNLRTRVVSATVLVPTVVAAVWLGGYWFMALSLVCVGLLAREWGRISAPKAPNAVGAVVGVFCGIAVVAAFLQQFLVAWAVVLVGSFLAGLIARGAVERRADAAYGVVYIAPAVIAMVWVRSLDDGLWWTLLLFVVTWFADIFAYVTGSILKGPKLWPRISPNKTWAGFVGGLAAATIGAVVVASLAKLDLIWQAAALIGLLGGLATMAGDLWESMLKRRFGVKDSGDLIPGHGGLLDRVDGLMFAAIVIAAVRLVDQIGWGH

SEQ ID NO: 9943 - DNA, 930 bp, Yersinia pestis
  CDS (1)..(930)
atgcctgattccctgcagacgttgtattactgcctcggtgggattttcagcgttttattgctggcgaccattattattttcgtattaaaaaaatgccgccctcagcgtgactggctggaattacagcagcgcattaatagctggtgggtgattatttgcctgttctcgctggcgatgttgtcgccaaaatggctggcactcactttctttggtttcattagcttcctgtcattaaaggagtatttgacgcttgcccccacgcgacgttcagacagtgtgccgttgttgtggatgtatgctgccattccactgcaatatgtctggatcgggatgtcgtggtacggaatgtttattatcttcattcccatttatgtctttttattcctgccagctcgcatggttctcgtcggcgatactaaagggttcttacattcagcgtccatcatgcattggggcatgatggccacggtatttgccttaagccacgtcgcttatctgctgacgttacccggtgtggatgctaaagcaggggcgctgctggttattttcctggttgtggcgactgagctgaacgatatttcgcaatatctgtgggggaaatcgctaggcaaaatcaaagtcacgccgaaagtcagcccaaataaaacgcttgccgggttattgggtggcgtgttgacgactatgctgctggcggccatttttggccccttgttgacaccgatggactggctccattctctgggcgcaggcgtcattattggcctgagtggattctgcggcgatgtggtgatgtcggctattaaacgtgattttggcgttaaagactccgggaaattactgccagggcacggcggtattctcgaccgtctggactccctgatttataccgcgccgctgttcttccacttctatcactacttctacgtttaa

SEQ ID NO: 9944 - protein, 309 aa, Yersinia pestis
MPDSLQTLYYCLGGIFSVLLLATIIIFVLKKCRPQRDWLELQQRINSWWVIICLFSLAMLSPKWLALTFFGFISFLSLKEYLTLAPTRRSDSVPLLWMYAAIPLQYVWIGMSWYGMFIIFIPIYVFLFLPARMVLVGDTKGFLHSASIMHWGMMATVFALSHVAYLLTLPGVDAKAGALLVIFLVVATELNDISQYLWGKSLGKIKVTPKVSPNKTLAGLLGGVLTTMLLAAIFGPLLTPMDWLHSLGAGVIIGLSGFCGDVVMSAIKRDFGVKDSGKLLPGHGGILDRLDSLIYTAPLFFHFYHYFYV

SEQ ID NO: 9945 - DNA, 834 bp, Agrobacterium tumefaciens
  CDS (1)..(834)
atgagccgtgaactcaaactgcggatcgtgtccgcaatcgtcatggccgcggtcattctggccgcgacctggtatggtggcattctgttccgcatcgttgcggggcttctggcgatcctcatctattatgagtggtcgacgattacccggatgtcggagaccaactcgaccggcaatgcctggggctggtttgcggttgccgtcatcgccggcaatacgatcttcggcgagtcctcgctcgatctgccgcttttatccggcttcacgctgactgcggcgctgtttccggttttgcgcggcaagaactggtggctggtgggcggcattttttacgcgggactgagcggcatatcgctagcggctatccgcggtgacgaactggccgggttcgcttccatcctgttcattttcgccgtcgtctggtcgacggatatcctggcctatttcgttggacgcgccattggcgggccgaaacttgcgccttcgatttcgcccggcaagacctggtccggcgccgttggtggtgctgtggcggcggtgatcggcggcgctgcggtctccatggcctatcacggcaggatcagcctgctgcttgttgggctcgcactcgtcctttcggtattcagccagatcggcgatctctttgaatccttcgtgaaacgtcgtttccaggtcaaggattccagccatctcattcctggccatggcggcttcatggaccgtgttgacggtcttgttttcgcctgctttacggtattcctcatagctttcgtgcatgcggcggcaaccggagacgtgcccggatcgggcggcggtctgctgccgggtttctag

SEQ ID NO: 9946 - protein, 277 aa, Agrobacterium tumefaciens
MSRELKLRIVSAIVMAAVILAATWYGGILFRIVAGLLAILIYYEWSTITRMSETNSTGNAWGWFAVAVIAGNTIFGESSLDLPLLSGFTLTAALFPVLRGKNWWLVGGIFYAGLSGISLAAIRGDELAGFASILFIFAVVWSTDILAYFVGRAIGGPKLAPSISPGKTWSGAVGGAVAAVIGGAAVSMAYHGRISLLLVGLALVLSVFSQIGDLFESFVKRRFQVKDSSHLIPGHGGFMDRVDGLVFACFTVFLIAFVHAAATGDVPGSGGGLLPGF

SEQ ID NO: 9947 - DNA, 885 bp, Nostoc sp. PCC 7120
  CDS (1)..(885)
atgccttggtctcggattattagtggaattgttgcgatcgcccttgctttagttgctgtcctgttggggggttggtattttaccatcatgctggcgatcgttgttttcttaggacaacaggaatattttgatttagttcgcactagaggcattttgccagccgcgaaaactactttattccttagtcaagttttactagttacttgtactttggacagcaatttagttgatgctgtcatgcccattgcaggtacatttatttgcttttatttactatttcaaccgaaaatggccacaatcgccgatgtttcggcatcgattatgggactattttatgtagggtacttgccgagttattgggtgcggttacggtcaattggtagcacgtccatcagtaatttacctttaggaggctactggccaggaagtttgacagatattctcgaagaaagaaattttgcctctctaccccaagggttcaaaattacagtgctgacatttctgtgcatctgggcagcagacatcggtgcatatactatcggtaaattctttggcaaaacccgcctgtctgatatcagcccgaaaaaaacagttgaaggtgctgtttttggtatcagtgctagtctagccgtagccctggctggtgctttctatcttcacttaccccaatttcttttgactggcacaattttaggcttactaattggcttggctagtctattaggcgacctcaccgagtcaatgctgaagcgcgatgctggtgtgaaggactccggacaattgatccccggtcatggtggcatcttagatcgcacagatagttatatctttacagctcctttggtttactatttcgtcacgctcattttgccattacttagttaa

SEQ ID NO: 9948 - protein, 294 aa, Nostoc sp. PCC 7120
MPWSRIISGIVAIALALVAVLLGGWYFTIMLAIVVFLGQQEYFDLVRTRGILPAAKTTLFLSQVLLVTCTLDSNLVDAVMPIAGTFICFYLLFQPKMATIADVSASIMGLFYVGYLPSYWVRLRSIGSTSISNLPLGGYWPGSLTDILEERNFASLPQGFKITVLTFLCIWAADIGAYTIGKFFGKTRLSDISPKKTVEGAVFGISASLAVALAGAFYLHLPQFLLTGTILGLLIGLASLLGDLTESMLKRDAGVKDSGQLIPGHGGILDRTDSYIFTAPLVYYFVTLILPLLS

SEQ ID NO: 9949 - DNA, 858 bp, Salmonella enterica subsp. enterica serovar Typhi
  CDS (1)..(858)
atgctgaagtatcgcctgatttctgcttttgtgttaatacccgcggtcatcgctgcgctttttttattgccgccggtggggttcgccattattacgctggttgtctgtatgctggccgcgtgggaatggggacagttaagcggtttcgccgcgcgttcacagcgggtttggctggcggtgctgtgtggtctgttattggcgctgatgctatttttgttgcctgagtatcatcacaacattcgtcaaccgctggttgagatgtcgctttgggcatcgttaggatggtgggttgtcgcgctactgctggtgctattttatcccggttcggcggcaatctggcgcaactcaaaaacattgcgtctcattttcggtttgttaactattgtgccatttttctggggcatgctggcgctgcgcgcctggcactatgacgagaatcattacagtggcgcaatatggctactctatgtcatgatcctggtctggggagcggactctggcgcgtatatgtttggtaaattatttggcaaacataagctggcgccgaaggtttccccgggtaaaacctggcaagggtttatcggcgggcttgctacggctgccgtgatctcatggggctacggtatgtgggcgaatctgaatgttgcgcctgttatcttgctgatttgctctgtggtggcggctctggcttctgtactgggcgacctcaccgagagtatgtttaagcgcgaagcaggaattaaggatagcggccacttgattccaggccatggcggcattctggaccgaattgacagtctgacggctgccgtaccggtctttgcttgcctgttgttactggtgttcaggacgctctaa

SEQ ID NO: 9950 - protein, 285 aa, Salmonella enterica subsp. enterica serovar Typhi
MLKYRLISAFVLIPAVIAALFLLPPVGFAIITLVVCMLAAWEWGQLSGFAARSQRVWLAVLCGLLLALMLFLLPEYHHNIRQPLVEMSLWASLGWWVVALLLVLFYPGSAAIWRNSKTLRLIFGLLTIVPFFWGMLALRAWHYDENHYSGAIWLLYVMILVWGADSGAYMFGKLFGKHKLAPKVSPGKTWQGFIGGLATAAVISWGYGMWANLNVAPVILLICSVVAALASVLGDLTESMFKREAGIKDSGHLIPGHGGILDRIDSLTAAVPVFACLLLLVFRTL

SEQ ID NO: 9951 - DNA, 849 bp, Yersinia pestis
  CDS (1)..(849)
atgctgaagtatcgtctcataactgctttgattttgattccggttgtcattggtgcactgttcctgcttccgccggttggtttcgctattgttactctcgtcgtctgcatgcttgcagcctgggaatggggtcaattagcgggttttgccagtcgtactcagcgtatctggttagcgatactgtgcggattcctgcttgttgccatgctgcttagtctccctgaatatcagcattcacctcatcacctcttggtgagtacaccactatggctctctatgggctggtgggttgctgcattgatgctggtgcttacttacccgcgctctgctgtatcttggcgtaactcgcgcctcctgcgcatcatcttcggtattctgactattatcccatttttttggggaatgtttgctttacgccagtatggctacgagcagaaccataataccggcgcttggtggctgttatatgtcatgttattagtgtggggggcagattctggcgcctacatgtttggtaaattgttcggtaaacacaaattagcgcctaaagtctcaccaggtaaaacatgggaaggattaattggcggtttactgacgtcagctctgatatcattgctgtttggtcgatacgcaccgttggatatcgtccccgaaaaactgttaatctgttccgtggttgctgcattggcctcggtactcggtgatctgactgaaagtatgtttaaacgtgaagcgggaatcaaagacagtggtcatttgattcctggtcatggtgggatactggatcgtatcgatagcctgaccgcagctgtgccggtatttgcctgcttaatgctgttagtgttttaa

SEQ ID NO: 9952 - protein, 282 aa, Yersinia pestis
MLKYRLITALILIPVVIGALFLLPPVGFAIVTLVVCMLAAWEWGQLAGFASRTQRIWLAILCGFLLVAMLLSLPEYQHSPHHLLVSTPLWLSMGWWVAALMLVLTYPRSAVSWRNSRLLRIIFGILTIIPFFWGMFALRQYGYEQNHNTGAWWLLYVMLLVWGADSGAYMFGKLFGKHKLAPKVSPGKTWEGLIGGLLTSALISLLFGRYAPLDIVPEKLLICSVVAALASVLGDLTESMFKREAGIKDSGHLIPGHGGILDRIDSLTAAVPVFACLMLLVF

SEQ ID NO: 9953 - DNA, 855 bp, Deinococcus radiodurans
  CDS (1)..(855)
atgccctgcggggaggccgccgtggagaccctgagcacccgcgtgctgaccagcgtgatcggttttctgatcgtaagtgccctggtctggatcggctggtgggccatgctgcccgcgctgatcgccgtgtcgtttttcggcctcagcgagtatttccgcatgctcgaccgcaacgatctcgacgtgcggcgcctgagcctgggcgtcttcggcaccgcgctgattgtggcaagtctgccgatgttcagcgaatacgccccctggcccggcggctcgtggcgcgaggtcgtgctgaccatcgccgtgggcacgttgctggtgctggaagtcattcgccccggcgagcgcccccttgaaagggttgtgtactcgctgttcgggctgctttacatcccctggctgctgggctatttcatgctgctgcgctactcgcccgacggacaacagggcctgctgtactttgccctgccgttgctggcaactttcgccgccgacatcgggggctttttcgccgggcactttttcgggcgccgcaaactcgcccccgaggtcagccccggcaagacggtggaaggggccatcggcgggctggccttcggcttcgtggtcgtgctggtcgtcagtcagctcgcgggcatctggaccccgctgcaagcgttcctgtactcggtgctggtcgccagcgcctcgcaactcggcgacctgtccgaaagcctcatcaagcgggccctgcggactaaagacagcgggaacagtctgccggggcacggtggatttctagaccgcctcgacagcctgatgttcgctgtgcccgcaacctattttttcctgaatatcagcgcgttcacgaattga

SEQ ID NO: 9954 - protein, 284 aa, Deinococcus radiodurans
MPCGEAAVETLSTRVLTSVIGFLIVSALVWIGWWAMLPALIAVSFFGLSEYFRMLDRNDLDVRRLSLGVFGTALIVASLPMFSEYAPWPGGSWREVVLTIAVGTLLVLEVIRPGERPLERVVYSLFGLLYIPWLLGYFMLLRYSPDGQQGLLYFALPLLATFAADIGGFFAGHFFGRRKLAPEVSPGKTVEGAIGGLAFGFVVVLVVSQLAGIWTPLQAFLYSVLVASASQLGDLSESLIKRALRTKDSGNSLPGHGGFLDRLDSLMFAVPATYFFLNISAFTN

SEQ ID NO: 9955 - DNA, 738 bp, Clostridium acetobutylicum
  CDS (1)..(738)
atgagtttaaacaaaagatatttgggtgcagttattctagctcctctcctaataattttatttttaggaggtatatatcttaaaatatttgtttttgctttatcgatgattggattatatgaatattataaggtatctagggaagctaaccttaaacctatttctattgttggatacttgctttgtatagcttactatgttttaataaactataaacttaattacaagtttgtactttttatgatagtaataggtatatttattatgctttgtgtccctacattggatactaaatataattatatagatatttcagttacaatattaggatttatatatgtagcagttttctttagttttattgccctaacaaatgatttgaagtatggaaattatttgttgtggattatattcatagcatcttggctttgtgatacattagcttattattcaggaagaatttttggaaaaacaaaattatgtcctaaagtaagtcctaaaaagacaattgagggttcgattggtggagttctaggaagtgtaattggatgtactgtttatggttttataatttctaaatatggagttaatatagctatttatcactacataataataggaattttatgcggcgttttttctcaattcggagatcttgcagcatcatcaataaacgaacatgctcaagttaaagattatagtaatttaatacctggtcattggaggtattttggatag

SEQ ID NO: 9956 - protein, 245 aa, Clostridium acetobutylicum
MSLNKRYLGAVILAPLLIILFLGGIYLKIFVFALSMIGLYEYYKVSREANLKPISIVGYLLCIAYYVLINYKLNYKFVLFMIVIGIFIMLCVPTLDTKYNYIDISVTILGFIYVAVFFSFIALTNDLKYGNYLLWIIFIASWLCDTLAYYSGRIFGKTKLCPKVSPKKTIEGSIGGVLGSVIGCTVYGFIISKYGVNIAIYHYIIIGILCGVFSQFGDLAASSINEHAQVKDYSNLIPGHWRYFG

SEQ ID NO: 9957 - DNA, 927 bp, Chlamydophila pneumoniae, Chlamydia pneumoniae
  CDS (1)..(927)
atgcttaattcaaataagtttaaatcgaagaccggtgcatacggtgatttatttcagcgtgttgttgttcattcgttagtacttacatttttggttcttcttctctatagttccctatttcccttaacttcttttgctctagggtttattaccgcgacttgtggcgctgtaggaacttatgagtactcctcaatggcgaaagccaagatgcactatccattaagcacgtttagtgcgatcggatcttttttatttttagcattaagttttctttccattcgttggggacacagtctcccaggattcttcgatgctcttccttggaccttgcttattgtttgggtcgtgtggagtatctttagagttcgaaaatctacaatcggcgctttacagctatcaggagtcactctcttttctattttgtatgtagggattccgatacgtttattcttacatgtcctttatagctttattcatacccaagaaccctatcttggaatttggtgggcttcttttcttattgccacaactaaaggtgcggatatcttcggttatttcttcggtaaagcctttgggaataagaaaatcgccccacaaattagccctaacaaaactgttgtaggttttgttgcagggtgtttgggagccacgctcattagttttattttctttctacagattcccacgaggtttgcgagttacttcccgatgcctgcgattttaattcctttaggtcttgctttaggaatcacaggattttttggagatattattgaatccatatttaagcgtgatgctcatttgaaaaatagcaacaagctcaaggctgtgggtggtatgctggataccttagactcactgctcctgtccacgccgattgcttacttatttttgctcataacccaatctaaagagtttattggatga

SEQ ID NO: 9958 - protein, 308 aa, Chlamydophila pneumoniae, Chlamydia pneumoniae
MLNSNKFKSKTGAYGDLFQRVVVHSLVLTFLVLLLYSSLFPLTSFALGFITATCGAVGTYEYSSMAKAKMHYPLSTFSAIGSFLFLALSFLSIRWGHSLPGFFDALPWTLLIVWVVWSIFRVRKSTIGALQLSGVTLFSILYVGIPIRLFLHVLYSFIHTQEPYLGIWWASFLIATTKGADIFGYFFGKAFGNKKIAPQISPNKTVVGFVAGCLGATLISFIFFLQIPTRFASYFPMPAILIPLGLALGITGFFGDIIESIFKRDAHLKNSNKLKAVGGMLDTLDSLLLSTPIAYLFLLITQSKEFIG

SEQ ID NO: 9959 - DNA, 921 bp, Mycobacterium tuberculosis
  CDS (1)..(921)
atgacaaccaacgatgccggcaccggaaaccccgccgagcagccggcgcgtggtgctaaacagcagccggcgaccgaaacgtcccgcgccggccgtgatttgcgcgcagcgatcgtggtgggcctttccataggcctagtcctcatcgcggtgctggtgttcgttccgcgcgtttgggttgccatcgtggccgtcgccaccttggtcgctacccatgaggtggtgcggaggttgcgggaagcgggctatctcatcccggttatcccgttgctgattggcgggcaggccgcggtgtggctgacctggccgttcggcgcggtcggcgcattggcgggctttggtggcatggtcgttgtctgcatgatttggcgactgttcatgcaggacagcgtgacgcgcccgacgaccggcggtgcaccgtcgccgggaaactacttgtccgacgtctcggccacggtcttcctggccgtgtgggtcccattgttctgctctttcggcgcaatgctggtctacccggaaaatggctcgggatgggtgttctgcatgatgatcgcggtcatcgcttccgatgtcggcggctacgccgtgggggtgctgtttggcaagcatccgatggttccgacgatcagcccgaagaagtcgtgggagggctttgccggttcgctggtgtgcgggatcaccgcaacgatcatcaccgcgactttcctggtcggcaaaacgccgtggattggtgcactgctcggcgtgcttttcgtgctcaccaccgcgctgggcgacctggtggagtcgcaggtcaaacgtgacctcggcatcaaagacatgggccgcctgctacccggccacggcggtctgatggaccggctcgacggcatactgccttccgcggtggcggcctggatagtcctcacactgctgccctga

SEQ ID NO: 9960 - protein, 306 aa, Mycobacterium tuberculosis
MTTNDAGTGNPAEQPARGAKQQPATETSRAGRDLRAAIVVGLSIGLVLIAVLVFVPRVWVAIVAVATLVATHEVVRRLREAGYLIPVIPLLIGGQAAVWLTWPFGAVGALAGFGGMVVVCMIWRLFMQDSVTRPTTGGAPSPGNYLSDVSATVFLAVWVPLFCSFGAMLVYPENGSGWVFCMMIAVIASDVGGYAVGVLFGKHPMVPTISPKKSWEGFAGSLVCGITATIITATFLVGKTPWIGALLGVLFVLTTALGDLVESQVKRDLGIKDMGRLLPGHGGLMDRLDGILPSAVAAWIVLTLLP

SEQ ID NO: 9961 - DNA, 864 bp, Treponema pallidum subsp. pallidum (syphilis spirochete)
  CDS (1)..(864)
atgagcgcggaaataaagaggctgttaatcttttttttcggcgttccaactattcttatgttggtatatgcggcaccgcatgcacacttcctagcgttccatttggttatcttcggatcagttatgggtgcggtatgggaaatgcatgcgatggtgtcgcgcaggatgtgcacgtacccactggttttgttgatccctttcagtcttgtgcttccgcttttaggatatgcagcgctgtggcagcctgcacggggcgctgaatctgtcctttttattggagcactgggcacgctgctcatgagtgtttttttcaccgaattggtgtattcgttttctgcttcttttgaaaacgcccttgagcgtatggcctcggcactgttgcttgttttgtatccaggtatctttagcctttttttttcgctcattacgcggtggcgtcatgcagagatcgcattggtaattttttttctcatggtttttacgtgcgactcttgtgcatggttctgtgggacgctctggggagtcaacaacagagggataattcctgcaagtcctaaaaagagtattgcaggttttattggaggttttgccggttcggtaggtgcagggtgttttggctcacttgtatttggttcgcgtgtgacgctctctttggggatgctcatgggtgttggagccttggtaggactgactgccattgtaggcgatctagtcgagtcggtgatgaaacgttcggctcaggtaaaggattcaggattttttacccccgggcggggcggaattatggataacctggattcgcttgcgccgtcactggggactttttacattgcatgtgagtgttttgggatcgctgcagtatga

SEQ ID NO: 9962 - protein, 287 aa, Treponema pallidum subsp. pallidum (syphilis spirochete)
MSAEIKRLLIFFFGVPTILMLVYAAPHAHFLAFHLVIFGSVMGAVWEMHAMVSRRMCTYPLVLLIPFSLVLPLLGYAALWQPARGAESVLFIGALGTLLMSVFFTELVYSFSASFENALERMASALLLVLYPGIFSLFFSLITRWRHAEIALVIFFLMVFTCDSCAWFCGTLWGVNNRGIIPASPKKSIAGFIGGFAGSVGAGCFGSLVFGSRVTLSLGMLMGVGALVGLTAIVGDLVESVMKRSAQVKDSGFFTPGRGGIMDNLDSLAPSLGTFYIACECFGIAAV

SEQ ID NO: 9963 - DNA, 918 bp, Chlamydia muridarum, Chlamydia trachomatis MoPn
  CDS (1)..(918)
atgttcgactcggataaaaactccattcttcaaagtgatttttgtcagcgcttagttgtccattcgcttcttctggtcttccttgttatccttctctgtacatctctatatcctagttcagccttcatcgtggggcttctttcatcaacctgcgcagcgattgggacatacgaaatgtcttccatggtcagaatgaaattccccttttctttcactcgatatagctccataggctctgctatttttgtcgccctaacttgcctaacagctcgttgtaaaatgctacttccagagcatgtggaccttatcccatggttctttctatttttttggactgttcacctcgtgttcaaaagtcgccactataaactgggcccgataggatctactggccttgctttattctgtatgctttatgtatccgttcctatccgactgtttctgcacatcctttatgggtttgtccataccgacactccatttatagggatttggtgggccatttttcttattgctactacgaagagctctgatatttttggatacttttttggaaaagcttttggaaaaaaacgcattgctccagtcatcagcccaaacaagactgtagtaggtttcgtagctggttgcatagcttctattctagttagtttgatcttctactctcatcttcctaaatcctttgcaaatcagattgcaatgccttggatcctagttgccttagggatcatattaggaattagtggcttctttggagatattatcgaatccacattcaaacgcgatgcgcaaattaaaaacagtagcgatctagaatctattggaggaatgttggatgtcctagactccttgcttctttctacacctatcgtttacgctatccttcttatcactcaaaatgggacatttttaggatga

SEQ ID NO: 9964 - protein, 305 aa, Chlamydia muridarum, Chlamydia trachomatis MoPn
MFDSDKNSILQSDFCQRLVVHSLLLVFLVILLCTSLYPSSAFIVGLLSSTCAAIGTYEMSSMVRMKFPFSFTRYSSIGSAIFVALTCLTARCKMLLPEHVDLIPWFFLFFWTVHLVFKSRHYKLGPIGSTGLALFCMLYVSVPIRLFLHILYGFVHTDTPFIGIWWAIFLIATTKSSDIFGYFFGKAFGKKRIAPVISPNKTVVGFVAGCIASILVSLIFYSHLPKSFANQIAMPWILVALGIILGISGFFGDIIESTFKRDAQIKNSSDLESIGGMLDVLDSLLLSTPIVYAILLITQNGTFLG

SEQ ID NO: 9965 - DNA, 843 bp, Vibrio cholerae
  CDS (1)..(843)
atgaagcagcgaatcattacagcgcttattctggcgcctttggtgatccttggcatcctttatctgccttttgcttggtttatgttggcactcgcagtagtgaccttactcggattctgggaatggactcagttcgttaaccaaccatcacgcatgttagccatgattcccgccttattggttggtggtatcagtgtcgctttgatcgactttcaatttccggctatcagcaatatgaatacggcgcattttattgtgctgggtatcggtagcctttggtggctcgtctcaagtggactggcgatcacttatccgcgctcgcgtccattatgggagcactccagcactgttcgccacctgtttggcctatttacgctgctgcctttcttttggagtgtgttgttcttacgcgccgatacttacctttccgatcctctttatggtgcgaaattagttctcttcgtctgttttctggtctgggccgcagacagcggtgcctattttgtgggaaaaagcttaggtaaacacaaaatggcgcccgcagtcagcccgaataaaacgatagaaggtttggtcggtggcatcgtcaccgccatgctggttggttattgggtagcagagtgctttggtattcaatttagctctatgcctgtcatgctgctgatcatcttattgactgtggtaatttcggttttaggggatttggtcgagagcatgtttaaacgtgtttctgggatcaaagacagcagcaatatcattcctgggcacggcggcattctggatcggattgatagcctaacggccgctttccctgtgttcgctcttctctatttcttgttctag

SEQ ID NO: 9966 - protein, 280 aa, Vibrio cholerae
MKQRIITALILAPLVILGILYLPFAWFMLALAVVTLLGFWEWTQFVNQPSRMLAMIPALLVGGISVALIDFQFPAISNMNTAHFIVLGIGSLWWLVSSGLAITYPRSRPLWEHSSTVRHLFGLFTLLPFFWSVLFLRADTYLSDPLYGAKLVLFVCFLVWAADSGAYFVGKSLGKHKMAPAVSPNKTIEGLVGGIVTAMLVGYWVAECFGIQFSSMPVMLLIILLTVVISVLGDLVESMFKRVSGIKDSSNIIPGHGGILDRIDSLTAAFPVFALLYFLF

SEQ ID NO: 9967 - DNA, 1137 bp, Ureaplasma urealyticum
  CDS (1)..(1137)
atgattagtgtcaataaaatcaatgaaaaaacaaaaaacactttttttaaacggttttattcatcgatttttatttttttatacttattaatttattttgttttagcattattagcagatcgtaattataattgaacacctttaattaataatttatatattcaacaagggattgcaattgttttattaatatgattattaccattaatatgtattggttcgtatgaaatgaataaagtcatttttgataataataagataacattaatcatcttaacaattgtttttaatatttgcatttatactacaacgatttcttattttatatatcaatatgagtttttaaatattaaataccttttaactataaattaccattacgtcatcaaactatttggcgcatgtttaggatgctcgtattttgttacattagttattttatttttctttttagcatttctaaaaaaaattaatttcaaaaattgtttatacacaattttaatttttagttttttaagtggtttttttataggattactttattttacttttattagaagttgaattacttcattattgctaatgatgattgtttttttaagtgatacatttgcatatgttggtggtgttttatttggtaaaacaaaattagcaccaaaaataagtcctaacaaaacagttgaaggattaatttttggtttagtaattgcaacaattgttattatgttaataatttttggtttgtcatatgtgccaattaaacctaaaaacggcatagtgttaaaatcacaaaatgttttatataatatttttggtttagatttttctagttcaaatgaaaaaaatcttacattgcataaacaagcattatgatgaatttgcacaatagttgcttttttgtttttgagtttaataagcactagtggggacttagtatttagtgcgattaaacgtaattatcataccaaagattatagtaatttaattcctggccatggtggattattagatcgtatagattcacattcatttgtaatatcaatcatgttcatttttacacttcttattacaggcagtttacaagatgaaaatttatttcctaacattcaaaaattttttattcaattaattgtataa

SEQ ID NO: 9968 - protein, 378 aa, Ureaplasma urealyticum
MISVNKINEKTKNTFFKRFYSSIFIFLYLLIYFVLALLADRNYNWTPLINNLYIQQGIAIVLLIWLLPLICIGSYEMNKVIFDNNKITLIILTIVFNICIYTTTISYFIYQYEFLNIKYLLTINYHYVIKLFGACLGCSYFVTLVILFFFLAFLKKINFKNCLYTILIFSFLSGFFIGLLYFTFIRSWITSLLLMMIVFLSDTFAYVGGVLFGKTKLAPKISPNKTVEGLIFGLVIATIVIMLIIFGLSYVPIKPKNGIVLKSQNVLYNIFGLDFSSSNEKNLTLHKQALWWICTIVAFLFLSLISTSGDLVFSAIKRNYHTKDYSNLIPGHGGLLDRIDSHSFVISIMFIFTLLITGSLQDENLFPNIQKFFIQLIV

SEQ ID NO: 9969 - DNA, 693 bp, Rickettsia conorii
  CDS (1)..(693)
atgattactcaaaaaggaaaagaacatttggtaaaagataaacaaaaatcaaacatatatttaagaatcctgtccggtatagttttagttccgttatttgtcatagctatattatggtgtaagcctttattctatattctaatgatattagtaggtacgggaatgttaagtgaatggtataatatgacctactcttctattcctgatctattaatcgggctaattattattccgattcctataagcctattaatatttttaagtatggaagataccaatagatggcttattatgctttatttttgcataatgtggtcggtagatactttcgctatgattggcggcaaaacttttaaaggagcaaaacttgctccaaaacttagtcctaaaaaaacctggagcggtttagtgacgggagtattatcagcaggtttagttgcggtattagttagttttataccaaactttcatattgaaaattactatttttcaaataaaatttatttgtttataattagttgtatattagcattaatagctcaattaagtgatttatttatttcatattttaagcgaaaatttaatattaaagatagcggtcatataatacccggtcatggaggagtgctagacagatttgatagtattattttaaccactctgatattatttcttatgaagatatatttatga

SEQ ID NO: 9970 - protein, 230 aa, Rickettsia conorii
MITQKGKEHLVKDKQKSNIYLRILSGIVLVPLFVIAILWCKPLFYILMILVGTGMLSEWYNMTYSSIPDLLIGLIIIPIPISLLIFLSMEDTNRWLIMLYFCIMWSVDTFAMIGGKTFKGAKLAPKLSPKKTWSGLVTGVLSAGLVAVLVSFIPNFHIENYYFSNKIYLFIISCILALIAQLSDLFISYFKRKFNIKDSGHIIPGHGGVLDRFDSIILTTLILFLMKIYL

SEQ ID NO: 9971 - DNA, 918 bp, Chlamydia trachomatis
  CDS (1)..(918)
atgttcgattcggatcataattccatttttcaaagcgatttgtgtcagcgtctggtcgtccactcgattcttcttactttccttgtcattcttctctgtacatctttatatcccagctcagcctttattgtagggcttctttcctccgcttgcgcagctctaggaacatatgagatgggggctatggttagaatcaagtttccattttctttcacacgctatagtgcattaggatccgctattttcattgctctgacctgtcttacagctcgttgtaaaatgtgttttccagagcatatagacctacttccttggttctttctcttcttttggacgattcgcttagtatttaaaagtcgccattataaacttggtcccataggctcaactgggctcgcgttgttttgtatgctttatgtatcagtccctatccgcttgttcctccacattttgtatgggtttgtgcataccgatactccatttgtaggaatttggtgggcgatttttcttatcgctacaacaaaaagctctgatatttttggttacttctttggaaaagcttttgggaaaaaacgcattgcaccagtcattagcccgaacaaaacagtagtaggcttcattgctggttgctgtggatctatcttggttagccttcttttctactcccatcttcctaaagcctttgctgatcagattgcggtgccttggatcctcattgctttaggtactgtgttgggcgttagtggattctttggagacattatcgaatctacgttcaaacgggatgcacagatcaagaacagcagtgatctggagtctatcggaggaatgctagatgtgctagactccttgcttctttcgactcctatcgtttacgctatcctccttatcactcaaaataggacatttttaggatga

SEQ ID NO: 9972 - protein, 305 aa, Chlamydia trachomatis
MFDSDHNSIFQSDLCQRLVVHSILLTFLVILLCTSLYPSSAFIVGLLSSACAALGTYEMGAMVRIKFPFSFTRYSALGSAIFIALTCLTARCKMCFPEHIDLLPWFFLFFWTIRLVFKSRHYKLGPIGSTGLALFCMLYVSVPIRLFLHILYGFVHTDTPFVGIWWAIFLIATTKSSDIFGYFFGKAFGKKRIAPVISPNKTVVGFIAGCCGSILVSLLFYSHLPKAFADQIAVPWILIALGTVLGVSGFFGDIIESTFKRDAQIKNSSDLESIGGMLDVLDSLLLSTPIVYAILLITQNRTFLG

SEQ ID NO: 9973 - DNA, 816 bp, Pseudomonas aeruginosa
  CDS (1)..(816)
atgctgaaacaacggatcatcacggcgctggtgcttttgcccatcgcgctgggtggttttttccttctcgaaggggcgttcttcgccctgttcatcggcgcggtggtgagcctgggggcctgggaatgggcgcgcctggccggctatgaacaacagttcggccgcgttgcctacgcggcgacggtcgccgtgctgatggtcgctctctaccatctgccgcagcttgccggagccgtgctgctgctggcgctggtctggtggacgctggccaccgtgctggtgctcacctacccggaaagcgtcggctactggggcggccgctggcgccgcctgggcatgggcctgctgatcctgttgccggcctggcaggggctggtcctgctcaagcagtggccgctggccaatggcctgatcatcgccgtgatggtgctggtctggggcgcggatatcggcgcctacttctccggcaaggccttcggcaagcgcaagctggcgccgcgggtcagccccggcaagagctgggaaggcgtttacggcggcctggcggccagcctggcgatcaccctggcggtcggcctctaccgcggctggtccctcggcgcgctgctcctggccctgctcggtgcggcgctggtggtgttcgtctcgatcgtcggcgacctcaccgaaagcatgttcaagcgccagtccggaatcaaggacagcagcaacctgctgcccggccacggtggcgtgctggatcgcatcgacagcctgacggcagccatcccggtgttcgcggccctgctctgggccgccggctggggtgcgccatga

SEQ ID NO: 9974 - protein, 271 aa, Pseudomonas aeruginosa
MLKQRIITALVLLPIALGGFFLLEGAFFALFIGAVVSLGAWEWARLAGYEQQFGRVAYAATVAVLMVALYHLPQLAGAVLLLALVWWTLATVLVLTYPESVGYWGGRWRRLGMGLLILLPAWQGLVLLKQWPLANGLIIAVMVLVWGADIGAYFSGKAFGKRKLAPRVSPGKSWEGVYGGLAASLAITLAVGLYRGWSLGALLLALLGAALVVFVSIVGDLTESMFKRQSGIKDSSNLLPGHGGVLDRIDSLTAAIPVFAALLWAAGWGAP

SEQ ID NO: 9975 - DNA, 795 bp, Bacillus halodurans
  CDS (1)..(795)
atgaaacaaagggttgttacagccattatttttggactagtttttctaacattcgtcgttgtaggcggacttccgtttacgatgtttatcattgtcgtcgcaacgatcgcaatgagcgaattgttaaaaatgaaaaagattgcgcctttctcaccgatgggggcgttcagccttttgccaatgtggatgctgctcctgccgaacgattggtttaaagtagttattcctgacttcacgaaggttgaaattttcatcttttttatattatttcttttgttacttaccgtattaacgaaaaatacatttacatttgatgaggcagggttcgtgatcctctcttcagcgtacataggatatggatttcattttttactattaagtcgcgaaatccccgaaatcgggcttcctctcgtctttttcgtcttatttgttatctgggcgaccgattcaggcgcttattttgcaggacgggcgttcggcaagcataagctttggccacacattagcccgaataagacgatcgaagggtccatcggaggaatcatattagcggttatcatcggtagccttttttactggattatgccgctattttcctcttatggagtcgctcttgcggtgatcgtagtcgcttctgtcttcgggcagcttggtgatcttgtggaatccgccttaaagcgtcactatgccgtaaaagattcagggactgtcttgccaggtcatggtggaatattagaccggtttgacagcttgatttatgtcatgcccatcttgcatttattgcatttgctttaa

SEQ ID NO: 9976 - protein, 264 aa, Bacillus halodurans
MKQRVVTAIIFGLVFLTFVVVGGLPFTMFIIVVATIAMSELLKMKKIAPFSPMGAFSLLPMWMLLLPNDWFKVVIPDFTKVEIFIFFILFLLLLTVLTKNTFTFDEAGFVILSSAYIGYGFHFLLLSREIPEIGLPLVFFVLFVIWATDSGAYFAGRAFGKHKLWPHISPNKTIEGSIGGIILAVIIGSLFYWIMPLFSSYGVALAVIVVASVFGQLGDLVESALKRHYAVKDSGTVLPGHGGILDRFDSLIYVMPILHLLHLL

SEQ ID NO: 9977 - DNA, 867 bp, Haemophilus influenzae
  CDS (1)..(867)
atgcttaaacaacgagttttatctgctattgtgttaattgctgcagttttatgtgcgctatttttattcacacctttttattttgccctcgctttaggggcagtagcgattttaggcatttgggaatggactcaatttgctcgcctaaaacaacctttgatacgtttttttgtgactacctttttaggcgtatttatcttcttatggctctatactgagggcaactatttagatgcagggcgtgtgtttgaacaacatcttcagcttttattgataaatgctgttagctggtggggtttagctttgttacttgtgatcagttaccctaaatcagctaaattttggtctaaaaatccacttttacaacttttatttgccttttctacgttgattccatttgtcgcaggtgtattacgtttacgtttagaacactatacccatgatccttatcacggcttatttttattactttacgtatttatacttgtttgggcggctgattctggtgcttattttagcggacgcgcctttggcaaacgtaaacttgcccctaaagtatcgccaggtaaaagttgggaaggggtcattggtggcttaattacagcattagtgcttgcttttatctttattcatttctctaacaatactttagtaggcgatcgaaatattactggatttatcattctttctgtagccacagttgcaatttcagtattgggcgatttaactgaaagtatgtttaaacgtgagtcaggagttaaagacagcagtcaattaattccaggtcacggcggcgtattagatcgcattgacagcttgactgccgcggtaccttttttcagctatttctatttctttgtcttataa

SEQ ID NO: 9978 - protein, 288 aa, Haemophilus influenzae
MLKQRVLSAIVLIAAVLCALFLFTPFYFALALGAVAILGIWEWTQFARLKQPLIRFFVTTFLGVFIFLWLYTEGNYLDAGRVFEQHLQLLLINAVSWWGLALLLVISYPKSAKFWSKNPLLQLLFAFSTLIPFVAGVLRLRLEHYTHDPYHGLFLLLYVFILVWAADSGAYFSGRAFGKRKLAPKVSPGKSWEGVIGGLITALVLAFIFIHFSNNTLVGDRNITGFIILSVATVAISVLGDLTESMFKRESGVKDSSQLIPGHGGVLDRIDSLTAAVPFFSYFYFFVL

SEQ ID NO: 9979 - DNA, 801 bp, Helicobacter pylori
  CDS (1)..(801)
atgaaagaagagttatttaaagaaaaatctcgttacattacagggtttgttttaatcattgtggcagacttgattttatatgcggacaatttgttgttgttttgggcggttttaggggggatttatgcggtagggttttctgaagcgttaagattattccaagttaaagcgagctttagcctgtatctcattttagtgttgtcatgggtggcggcgtattttaacgggcgtcctatagaatgcgctcttattagcgccatggtcatggctagtgttatcgcttatcaaaaagcgcaccatagcgaagccattttaccctttttgtatccgggcgttgggttttttgcgctttttggggtttataaggattttggtgcagtagcgatcatttggcttttagtcgtggtggttgcaagcgatgtgggggcgttttttggaggcaagcttttaggcaaaacccctttcacgcccacttcgccgaataaaaccttagagggcgcgttgattggcgtggttttggcgagcgttttaggatcgtttgtgggcatggggaaattgagcggaggcttttttatggcgctcttttttagttttttaatcgctcttgtggcggtgtttggggatttgtatgaaagctatttgaaaagaaaggtcggtatcaaagatagcggtaagattttacccgggcatgggggcgttttagaccggttggattccatgctttttggggctttaggcttgcatgcgctgttgtattttttagaaatttggaaagaaacggcggtgtttttaggggattga

SEQ ID NO: 9980 - protein, 266 aa, Helicobacter pylori
MKEELFKEKSRYITGFVLIIVADLILYADNLLLFWAVLGGIYAVGFSEALRLFQVKASFSLYLILVLSWVAAYFNGRPIECALISAMVMASVIAYQKAHHSEAILPFLYPGVGFFALFGVYKDFGAVAIIWLLVVVVASDVGAFFGGKLLGKTPFTPTSPNKTLEGALIGVVLASVLGSFVGMGKLSGGFFMALFFSFLIALVAVFGDLYESYLKRKVGIKDSGKILPGHGGVLDRLDSMLFGALGLHALLYFLEIWKETAVFLGD

SEQ ID NO: 9981 - DNA, 810 bp, Bacillus subtilis
  CDS (1)..(810)
atggtggacatgaaacaaagaattttgacaggtgttctggcagcaattgtatttttatttttggttattgtcgggaaattgccgttcaccatattaatttatgctatgggcagtgtggcgctttttgaacttttacggatgaaaaagctgaagctggtttcactgccgggtttgatcggtcttttattattgtggatgttcttattaccaagccagtattcgttttttgaagcggacgggatttccaaaatggaaatcgctttatttgcggtactgctattgctgacttacacagtgttggtcaagaacacctttacttttgatgaagtcgggtttattacgcttgcagcaatttacatcggaatgtgttttcattattttatcgaaatcagaaatcttgaccaatacggattaacatacattttttatgcgtgtgttgtcatttggtccaccgattccggtgcctattttgtcggtaaatcgcttgggaagcggaaactgtggcctgaaatcagtccgaataaaacagtggaagggtttgcaggcggaattgtcatcgcacttgtattggcgacgatttttcagcttgttgcacaacttccgatcccgtatatctatctgctgttgatcacgctgtttttgtctgtttttggacaactgggagatttagtggaatccgccttgaaaagacattacgatgtaaaggattctgggaatattcttcccgggcatggcggtatattagaccgttttgacagtttcttgtttgtcatgcctttcttgtactttctgcttgcccttttttcataa

SEQ ID NO: 9982 - protein, 269 aa, Bacillus subtilis
MVDMKQRILTGVLAAIVFLFLVIVGKLPFTILIYAMGSVALFELLRMKKLKLVSLPGLIGLLLLWMFLLPSQYSFFEADGISKMEIALFAVLLLLTYTVLVKNTFTFDEVGFITLAAIYIGMCFHYFIEIRNLDQYGLTYIFYACVVIWSTDSGAYFVGKSLGKRKLWPEISPNKTVEGFAGGIVIALVLATIFQLVAQLPIPYIYLLLITLFLSVFGQLGDLVESALKRHYDVKDSGNILPGHGGILDRFDSFLFVMPFLYFLLALFS

SEQ ID NO: 9983 - DNA, 687 bp, Rickettsia prowazekii
  CDS (1)..(687)
atgattactcaaaaagaaaaagaacatttggcaaaagataaacaaaatatctatttaagaataatatctggtatagctttagtttcgttatttgttatagctatattatgtcttaagactttattttatattctaatgatattagttggtcttggaatgttaagtgaatggtataatatgacatatccttcgattaattatttattaattggactcattattattccgatccctataagtctattaatatttttaagtatggaagagagtaatagattggttattatgctttatttttgcatactatggtcagtagatacttttgcaatgattggcggcaaaacttttaaagggataaagctcgctccaaaaatcagtcctaaaaaaacctggactggtctaattactggtacagtatcagcaggtttagtttcagtattagtaagtttaataccaaattatcatattgaacattactatttttcaaacaaaatatatttatttatcattagttgtatactagcattaatagctcaatcaagtgatttatttatttcatattttaaacgaaaatttaatattaaagatagtggtcatataatacctggtcatggaggggtactagatagatttgatagtattattttaacagctccagtattcttttgtataaatatttatttatga

SEQ ID NO: 9984 - protein, 228 aa, Rickettsia prowazekii
MITQKEKEHLAKDKQNIYLRIISGIALVSLFVIAILCLKTLFYILMILVGLGMLSEWYNMTYPSINYLLIGLIIIPIPISLLIFLSMEESNRLVIMLYFCILWSVDTFAMIGGKTFKGIKLAPKISPKKTWTGLITGTVSAGLVSVLVSLIPNYHIEHYYFSNKIYLFIISCILALIAQSSDLFISYFKRKFNIKDSGHIIPGHGGVLDRFDSIILTAPVFFCINIYL

SEQ ID NO: 9985 - DNA, 939 bp, Mycobacterium leprae
  CDS (1)..(939)
atggcttccaccgatcccggcacaggcaccccgcttgacgagtcggtgcctgggatcaagagggctatgcggcaatcgactaagaataccccccgggcgggacgtaatctgcccgccgcgatcgcggtgggcttaagtattggtggtgttctcgtcgcaacgctggtgtttgctccgcgaatctgggttgtcttgtgcgctggcgccattttcgttgctagccatgaggtggtgcggcggctacgggaagctggatatgtgattccggctatcccgctgctcatcggtgggcagttcaccgtctggttaacttggccgtatcgcaccgttggtgcattggctggcttcggtgcgacggtggtggtctgcatgatttggcggcttgtcatgcacgacaacagcaagcagcacgaatctcgggaagctttggcaggtccgccggtgtcaaattacctgcgggacgcgtcggccaccgtttttttggccgcgtgggtcccgttgtttgcctcgttcgcagcattgctggtttatccgaaggatggtgcgggccgggtattctgcctgatgattgcggtggtagcttccgatgtgggtggttacacagtaggggtacttttcggcaaacatccactggttccaaggattagcccgaataagtcctgggagggattcgccggttcgctggtctgcgggaccaccgcaaccatcctgactgctaccttcctggctggcaaaacaccgtgggttggggctttgctcagttttgtactggtgctcacctgcacgctgggggatttggtggagtcccaagttaagcgcgacctcggcatcaaagatatgggccggctgctacccggccacggtggcctgatggaccggcttgatggtgtgctgccgtcggcggttgtagcttggaccatgcttacgttgctgccctga

SEQ ID NO: 9986 - protein, 312 aa, Mycobacterium leprae
MASTDPGTGTPLDESVPGIKRAMRQSTKNTPRAGRNLPAAIAVGLSIGGVLVATLVFAPRIWVVLCAGAIFVASHEVVRRLREAGYVIPAIPLLIGGQFTVWLTWPYRTVGALAGFGATVVVCMIWRLVMHDNSKQHESREALAGPPVSNYLRDASATVFLAAWVPLFASFAALLVYPKDGAGRVFCLMIAVVASDVGGYTVGVLFGKHPLVPRISPNKSWEGFAGSLVCGTTATILTATFLAGKTPWVGALLSFVLVLTCTLGDLVESQVKRDLGIKDMGRLLPGHGGLMDRLDGVLPSAVVAWTMLTLLP

SEQ ID NO: 9987 - DNA, 803 bp, Streptococcus pneumoniae
atgacccaggatttacagaaaagaaccttgtttgcagggattgccctggctattttcctaccaattttaatgattgggggcctcttgcttcagatagcaatcggaatcatagccatgctagccatgcatgaacttttgaagatgagaggtctagagaccatgacgatggagggcctcttgaccctctttgcaacctttgcattgaccattcccttggagaattacctgacttttttgccagttgatgggaatgtggttgcctatagtgttttgatttcaatcatgttaggaacgaccgtttttagcaagtcttatacgattgaggatgcggttttccctcttgctatgagcttctacgtgggctttggatttaatgctttactagatgctcgtgttgcaggtttggacaaggctctcttagccttgtgtatcgtctgggcgacagacagtggtgcctatcttgttgggatgaactatgggaaacgaaagttagcaccaagggtatcgcctaataaaacccttgagggtgccttgggtggtattttaggagcaattttagtaaccattatccttatgatagttgacagtacagttgctcttccatatggaatttacaagatgtcagtctttgctattttctttagcattgctggacaatttggtgatttactagaaagttcgatcaaacgtcattttggtgttaaggattctgggaaatttatccctggacatggtggtgttttggatcgtttcgatagtatgttgcttgtatttccaatcatgcacttatttggactctttaa

SEQ ID NO: 9988 - protein, 267 aa, Streptococcus pneumoniae
MTQDLQKRTLFAGIALAIFLPILMIGGLLLQIAIGIIAMLAMHELLKMRGLETMTMEGLLTLFATFALTIPLENYLTFLPVDGNVVAYSVLISIMLGTTVFSKSYTIEDAVFPLAMSFYVGFGFNALLDARVAGLDKALLALCIVWATDSGAYLVGMNYGKRKLAPRVSPNKTLEGALGGILGAILVTIILMIVDSTVALPYGIYKMSVFAIFFSIAGQFGDLLESSIKRHFGVKDSGKFIPGHGGVLDRFDSMLLVFPIMHLFGLF

SEQ ID NO: 9989 - DNA, 726 bp, Campylobacter jejuni
  CDS (1)..(726)
atgtttaatacaactagaattatttcagctcttgtgatgataggggctattattattatcgcgttgattgatcaattttttatcaattttatcgtttttgcggttttattgtatctatcttttagtgaagcaaaaaaactttttgctttagaaaatatctctattatccctttggctatagcttttattttgggaagtttatcgcataaagctttgctttttgggattttagttttgttattagtcgttggatatttggtttataaaaaggcttccttaaaaccagctcttatttatatttatcctagtttgcctattttagcactttggcaagtgtatttagatcagggtatgtttgcacttttttggcttatcattatcgttgcagcttgtgatagtggggcgtattttatcggaaaacttatgggtaaaactcctttttctccaacaagtccaaacaaaaccttagaaggtgttataggtggcttgatttgtgcgagtgttattggaactattttgggagtttttgtttatagtttttggctttctttgctttgttcgttttttgtagcgatttttgcagtgattggagatttgcttgagagttattttaaaagagaagcaggtgtaaaagatagtggagatcttatccctggtcatgggggcgtgcttgataggatcgatgcggtgatcattgctgcttttgtgatggttgctcttttatga

SEQ ID NO: 9990 - protein, 241 aa, Campylobacter jejuni
MFNTTRIISALVMIGAIIIIALIDQFFINFIVFAVLLYLSFSEAKKLFALENISIIPLAIAFILGSLSHKALLFGILVLLLVVGYLVYKKASLKPALIYIYPSLPILALWQVYLDQGMFALFWLIIIVAACDSGAYFIGKLMGKTPFSPTSPNKTLEGVIGGLICASVIGTILGVFVYSFWLSLLCSFFVAIFAVIGDLLESYFKREAGVKDSGDLIPGHGGVLDRIDAVIIAAFVMVALL

SEQ ID NO: 9991 - DNA, 933 bp, Vibrio cholerae
  CDS (1)..(933)
atgctcaacattcctcaacactcactgcacttgatgttggtgattttgaccattttagtggtaggtacactctgttatttgtggctgtctcgccgctatcctgaacgcgattatctcgaattaaagctgcgtattcgttcatggtggtggatggttgcgattgtgtttgtcgtattgcagcttccactcaactacacgctcttttttgtaggtttcctcagtttcatggcactgaaagagtttctctcgattgtgcccacacgaatgaccgatcgccgagtgattttctgggcttatttgtccattccatttcagtactactggctctccatcggctggtacggcatgttcattatctttattccagtctatgtattcctatacctgcctatggtgatggtgctgattggagatactaaaggttttattcgctcggcaggcattattcactgggcaatgatgttgaccgtattttgtatcagccatatggcctacctattggtgttaccaagcttaaacccagatgcaggttcactgggtatgttgctgtttttattggtaatgactcagttcaatgatgttgcacaatacgtgtggggaaaaagttttggtaaacataagatcgttccgaaagtcagcccgaataaaacttggcaaggctttatcggcggcacattgaccgtggttaccgtttcatactttgcagcgccttatttaacgccactgaccgcagcgcaagggttggtcggcggagtcatcattgccttgagtggatttattggcgatttggtgatttcttcagtcaagcgcgatttgcgtatcaaagacaccagccagtttattccgggccacgggggcattctggacagggtcgatagcttgatgtttactgctccgctgtttttccactacctctattatctctattactga

SEQ ID NO: 9992 - protein, 310 aa, Vibrio cholerae
MLNIPQHSLHLMLVILTILVVGTLCYLWLSRRYPERDYLELKLRIRSWWWMVAIVFVVLQLPLNYTLFFVGFLSFMALKEFLSIVPTRMTDRRVIFWAYLSIPFQYYWLSIGWYGMFIIFIPVYVFLYLPMVMVLIGDTKGFIRSAGIIHWAMMLTVFCISHMAYLLVLPSLNPDAGSLGMLLFLLVMTQFNDVAQYVWGKSFGKHKIVPKVSPNKTWQGFIGGTLTVVTVSYFAAPYLTPLTAAQGLVGGVIIALSGFIGDLVISSVKRDLRIKDTSQFIPGHGGILDRVDSLMFTAPLFFHYLYYLYY

SEQ ID NO: 9993 - DNA, 783 bp, Staphylococcus aureus
  CDS (1)..(783)
atgaaagttagaacgctgacagctattattgccttaatcgtattcttgcctatcttgttaaaaggcggccttgtgttaatgatatttgctaatatattagcattgattgcattaaaagaattgttgaatatgaatatgattaaatttgtttcagttcctggtttaattagtgcagttggtcttatcatcattatgttgccacaacatgcagggccatgggtacaagtaattcaattaaaaagtttaattgcaatgagctttattgtattaagttatactgtcttatctaaaaacagatttagttttatggatgctgcattttgcttaatgtctgtggcttatgtaggcattggttttatgttcttttatgaaacgagatcagaaggattacattacatattatatgcctttttaattgtttggcttacagatacaggggcttacttgtttggtaaaatgatgggtaaacataagctttggccagtaataagtccgaataaaacaatcgaaggattcataggtggcttgttctgtagtttgatagtaccacttgcaatgttatattttgtagatttcaatatgaatgtatggatattacttggagtgacattgattttaagtttatttggtcaattaggtgatttagtggaatcaggatttaagcgtcatttcggcgttaaagactcaggtcgaatactacctggacacggtggtattttagaccgatttgacagctttatgtttgtgttaccattattaaatattttattaatacaatcttaa

SEQ ID NO: 9994 - protein, 260 aa, Staphylococcus aureus
MKVRTLTAIIALIVFLPILLKGGLVLMIFANILALIALKELLNMNMIKFVSVPGLISAVGLIIIMLPQHAGPWVQVIQLKSLIAMSFIVLSYTVLSKNRFSFMDAAFCLMSVAYVGIGFMFFYETRSEGLHYILYAFLIVWLTDTGAYLFGKMMGKHKLWPVISPNKTIEGFIGGLFCSLIVPLAMLYFVDFNMNVWILLGVTLILSLFGQLGDLVESGFKRHFGVKDSGRILPGHGGILDRFDSFMFVLPLLNILLIQS

SEQ ID NO: 9995 - DNA, 882 bp, Synechocystis sp
  CDS (1)..(882)
atgcccacccagcgaattattagtgcagtcatcggtattgccttggcgttttccctactaattttggggggctggtactttagcgcggcgatcgccctagtaatttatttaggattgcgggaatatttccaaatggtgcgggctaagggcattgccccagccgctaagaccaccatggtgctgtcattaatgttgctgctgtcggccacggttaccccccatttaactgatgcattttttcctttaaccggggcattaatttgcttttatctgctgtttcaacccaaaatggccaccattgccgacatttctacttcgttactgggcctgttttatgggggctatttgcccagctattgggtgcgactgcggttgggggatggagccgttaaccctatgggtttgcacttgcccctgaatggtttttggccggagtcctgggcccatccggaaaattttcccacgggcttactggtcactatccttgcctttgcttgcatctgggcggcggacattggcgcttacattatggggaaatggttaggacgtacccgtctgtcggacattagcccgaaaaaaaccgtggaaggttccctctggggagtaggaggcagtttgctggtgggggtattgggagcttggtatttgcaatggccctactgggaaattaccggcgctttactgggcctattaattggcatagttagcctgctgggggacttgacggaatcaatgatgaaacgggatgcgggagttaaggattctgggcaattaattcctggccacggaggaattttagaccgcaccgacagctacgttttcaccgctcccctggtctattactttgtcgttttactgttgcctgtgttgaataatttgtga

SEQ ID NO: 9996 - protein, 293 aa, Synechocystis sp
MPTQRIISAVIGIALAFSLLILGGWYFSAAIALVIYLGLREYFQMVRAKGIAPAAKTTMVLSLMLLLSATVTPHLTDAFFPLTGALICFYLLFQPKMATIADISTSLLGLFYGGYLPSYWVRLRLGDGAVNPMGLHLPLNGFWPESWAHPENFPTGLLVTILAFACIWAADIGAYIMGKWLGRTRLSDISPKKTVEGSLWGVGGSLLVGVLGAWYLQWPYWEITGALLGLLIGIVSLLGDLTESMMKRDAGVKDSGQLIPGHGGILDRTDSYVFTAPLVYYFVVLLLPVLNNL

SEQ ID NO: 9997 - DNA, 1317 bp, Arabidopsis thaliana (mouse-ear cress)
  CDS (1)..(1317)
atgaatactaataaccagagagataaccattatcccaacattcctaattcaccaagggattacaattatactcctagctctccaacagctcgcattcgacaccgcaggcgatcaagcgaggtgaacagaagcaatgtaagcagagtaagcaatttgttacttggtgataagaacaagtacagatcaatgtggataaggacatgctcatctctctggatgctcggtggagttgtgtttataatctacatgggtcatctctacatttgggctatggttgtggttatacagatattcatggccaaagagctcttctttcttcgcagaagagctcatgaagaacgtcgcttacccggtttctggctcttgaattggcacttcttcttcacggctatgttgtttgtctatggacgcatcattcaacagcagctagtcaacacggtttcttcagatagattcatatacaagcttgtgagtggtcttatcaagtaccagatggttatttgctacttcttgtacatcgcaggtctcatatggtttatccttacattgaagaataagatgtataagtatcagtttgggcaatacgcttggacacatatgatccttatcgttgtctttactcaatcttctttcaccgtcgccaatatttttgaagggatcttctggtttcttctaccagcagcactgattgctatgaacgatgtagcagcttacttcttcggtttctatttcgggaaaactccgctcatcaagttgtctccaaagaaaacatgggaaggtttcatcggagcatcagttgcaactataatctctgcatttatttttgctaatgtcttaggccagttccaatggcttacatgtccaaggaaggatttttcaactggttggcttcattgtgatccaggccctctcttcaggccagagtattacccatttccctcttggattactccattttctccatggaaagggatctcgaccctgcctgtccaatggcatgctttttctctcggtctattcgcatccattatggcgccttttggtggcttcttcgcaagcggtttcaaaagagctttcaagatcaaggatttcggagacagcataccaggacatggaggatttactgacagaatggattgccaaatggttatggcggttttcgcatacatctacatccaatctttcattgttaatcgggactacagtgtcgagatgatcctagaccagatatcgaggagcctgggacacgaggagcagaaaatgctttatgaaaagctcggagacattcttcaacataagttgcaagggaggttttaa

SEQ ID NO: 9998 - protein, 438 aa, Arabidopsis thaliana (mouse-ear cress)
MNTNNQRDNHYPNIPNSPRDYNYTPSSPTARIRHRRRSSEVNRSNVSRVSNLLLGDKNKYRSMWIRTCSSLWMLGGVVFIIYMGHLYIWAMVVVIQIFMAKELFFLRRRAHEERRLPGFWLLNWHFFFTAMLFVYGRIIQQQLVNTVSSDRFIYKLVSGLIKYQMVICYFLYIAGLIWFILTLKNKMYKYQFGQYAWTHMILIVVFTQSSFTVANIFEGIFWFLLPAALIAMNDVAAYFFGFYFGKTPLIKLSPKKTWEGFIGASVATIISAFIFANVLGQFQWLTCPRKDFSTGWLHCDPGPLFRPEYYPFPSWITPFSPWKGISTLPVQWHAFSLGLFASIMAPFGGFFASGFKRAFKIKDFGDSIPGHGGFTDRMDCQMVMAVFAYIYIQSFIVNRDYSVEMILDQISRSLGHEEQKMLYEKLGDILQHKLQGRF

SEQ ID NO: 9999 - DNA, 2014 bp, Solanum tuberosum (potato)
  CDS (104)..(1378)
tcaaagtttcactcgaggagttcttcgcaaataggtggttttagggattcatgtgctttttgtaagttaaactgctagggggtaaggatttgataaagaaagtatgcacaacgatagcaattctggtgccccaggaacaccttcaggacggatacgtcgtcgcagaggatcaaatgaggttcctccagaagttgtcaaagcaaatggaaaccatttgcttgttaatgatcggtcgaagtacaaatcaatgcttatccgtgcatattcatccgtgtggatgattggaggctttgctttcattatttacatgggtcatctttatatttgggccatggttgttgtcattcaaatctttatggcaaaagagttgttcaatctacttagaagagcacatgaagaccggcatcttcctggtttcaggctattgaattggcactttttcttcacagcaatgctgttcgtatatggccgcatgctaagccaaaggcttgtcaacacggttactttagacaaattcctatacaagcttgtcggcagatttgttaagtatcacatggtcacgtgttatttcttctatatcgcaggtttcatgtggttcattctaacactgaagaagaagatgtacaagtatcaatttagccagtacgcatggacgcatatgattctaattgtggtgttcacacaatcagctttcactgttgccaatatttttgagggaattttctggttcctgcttccagcttcgctcatcgtgatcaatgatatagctgcctattttttcggatttttctttggacgaactcctttgatcaaattgtcccctaagaaaacttgggaaggcttcattggagcatctattacaaccattatctctgcctttctgcttgcgaatatgtttggtcgttttcagtggctgacatgccctagaaaggacctatcaactggttggcttgattgtgatcctggcccactgtttaaaccagaatattttactttgccagaatggtttcctgcatggtttctttcgagagagattgctgttttacctgtacaatggcatgctttattgcttggcttgtttgcttctattatagctccttttggaggtttttttgctagtggctttaagagagccttcaagatcaaggattttggtgatagtatacctggacatggcggtatgacagatagaatggattgtcagatggtgatggctgtttttgcatatatctatcatcagtcctttattgtgccacagaacttgtcaattgagatgatcttggatcagataatactgaaccttacattcgaggagcagctagctgtgtacaagaaacttgggcagatcatccaggagaggacgtttggagaatcttgagtgtgattgatgtagccttcagataagattctcttgtatatgttctctccttttgtttttccctcagaacttagcatttcccactggccttgacttcactagctgtacagcgcttctccctcttcctttttcgtttagatgttctgatagttctgtgaatctctaccttccccaaataatagggcacgatgaagcatcatttgtcaaaattcttgtgcctattggttaaacaagttgatccgtacctaattggtctgatttcagtgagggctgacaaggctaaacttgctggttgaagagagcactgaatcatttgaaaggggaagtgacattttaagtcatctgttgagaatgttttaaatatagctttgacaggagaaagacgatgcatgttagacacggagtttgtagtcctggtaaaatttccctgattactggcaagagtttggtgtaattggcagaatttacatggtgtcagcgtgtatttgatatttgcttgtggaattgctactaatttatgtaaaacagttgcacatttctcaagctggactttgttccatgtgttgtaagcagtgtgttcttgatattatctttgcattgcataaccagtgcactgtttaaaaaaaaaaaaaaaaa

SEQ ID NO: 10000 - protein, 424 aa, Solanum tuberosum (potato)
MHNDSNSGAPGTPSGRIRRRRGSNEVPPEVVKANGNHLLVNDRSKYKSMLIRAYSSVWMIGGFAFIIYMGHLYIWAMVVVIQIFMAKELFNLLRRAHEDRHLPGFRLLNWHFFFTAMLFVYGRMLSQRLVNTVTLDKFLYKLVGRFVKYHMVTCYFFYIAGFMWFILTLKKKMYKYQFSQYAWTHMILIVVFTQSAFTVANIFEGIFWFLLPASLIVINDIAAYFFGFFFGRTPLIKLSPKKTWEGFIGASITTIISAFLLANMFGRFQWLTCPRKDLSTGWLDCDPGPLFKPEYFTLPEWFPAWFLSREIAVLPVQWHALLLGLFASIIAPFGGFFASGFKRAFKIKDFGDSIPGHGGMTDRMDCQMVMAVFAYIYHQSFIVPQNLSIEMILDQIILNLTFEEQLAVYKKLGQIIQERTFGES

SEQ ID NO: 10001 - DNA, 1231 bp, Arabidopsis thaliana (mouse-ear cress)
  CDS (1)..(1200)
atggcgccttttgttgaagtctgtaggtataagccattaccgctttcattgagctctctctgtacatgcccttgccgttcctctccaaggaaatatctaattcttcctcaattctctgaaaagtacccgaaaccattgttgtctcattctcgctttactccgatttctgttaaccggagagttatcacggccgttgctcgagctgaatcaaatcaaattggtgacgatgccaactcaaaggaggaacacaacatagatcaagaattgcaaaatgttgaagaagattcgagtttagatgatcagaagcaaaaatctagaagccagtttaagaaaagagtaactttcggtctaggaattggattgtctgtaggaggtattgtattagctggaggatgggtattcacagtagcagtagcagctgcggttcttctaagtgcccgggaatatttcgagctggtgagaagtaaaggaattgctcaaggaatgacacctcctccacgatatctttctagagtctgctccattatctgtgctcttatgcccatacttacattgtattttggtcatatagatatctcgataacttcagcggcgtttgttgttgcaatggcattgttgttacagagaggaaacccgcgtttttctcagctgagtagtacgatgtttggcctgttttactgtggatatcttccttgtttctgggttaagctacgttgtggtcttactgctccagttctaaacaccggaattgggagaagctggcctactatcctcggcggccaagcacattggacagttggacttgttgctatattgatttctttctgtggtataattgcctcagacacgtttgcttttcttggtggcaaggcatttggtagaactcctcttattagcattagtccaaagaagacatgggaaggagcttttgcaggacttgttggttgtatttccattaccattttactctccaaatcgttgtcctggcctcaatctcttgtcagcaccatagcttttggagttcttaacttcttcggatcggtctttggtgacttaactgagtcaatgatcaaacgtgatgcgggtgtcaaagactccggctcactcatccctggacacggtggcatattggacagagttgatagttacattttcactggtgcattagcctactcgttcgtaagacttcatggagtttgattgtattgctgtatcccaagaaaacatatag

SEQ ID NO: 10002 - protein, 399 aa, Arabidopsis thaliana (mouse-ear cress)
MAPFVEVCRYKPLPLSLSSLCTCPCRSSPRKYLILPQFSEKYPKPLLSHSRFTPISVNRRVITAVARAESNQIGDDANSKEEHNIDQELQNVEEDSSLDDQKQKSRSQFKKRVTFGLGIGLSVGGIVLAGGWVFTVAVAAAVLLSAREYFELVRSKGIAQGMTPPPRYLSRVCSIICALMPILTLYFGHIDISITSAAFVVAMALLLQRGNPRFSQLSSTMFGLFYCGYLPCFWVKLRCGLTAPVLNTGIGRSWPTILGGQAHWTVGLVAILISFCGIIASDTFAFLGGKAFGRTPLISISPKKTWEGAFAGLVGCISITILLSKSLSWPQSLVSTIAFGVLNFFGSVFGDLTESMIKRDAGVKDSGSLIPGHGGILDRVDSYIFTGALAYSFVRLHGV

SEQ ID NO: 10003 - DNA, 978 bp, Corynebacterium glutamicum
  CDS (65)..(958)
agaattttttcgaaaatgctggcaccatcaacagtgacattgttagaaacttcaaggagaacccatgaatgaaccggagcaacatcaccggtccatgaggatgcccaaacccaaaaataatgcgggtcgagatctcaaagctgccattgctgtggggatcggactgggggtcctggttcttttggggattgtcctaagcccatggggttggtacatcctcgttgcaggttttatggctgcagcaacatgggaagttggtagcagacttaaagaaggcggctatcatttgccactgccgattatgatcatcggcggtcaggcaatcatctggctgtcatggccatttggcacgatgggcattttggcgtcttttgtggccactgtgttggtgctgatgtatttccgaattttctacaatggcacggaaaaagaagcccgcaactatttgagggacacctctgtgggcatcttcgtgctcacctggattccattgttcggaagcttcgctgcgatgctgtcgctgatgcaaaacaattccatcccgggtacatatttcattttgacgttcatgctgtgtgtgatcgcatcggatgtgggcgggtatatcgcgggtgtgttctttggatcgcacccaatggcgccgttggtgagtccgaagaagtcttgggaaggctttgccggctccattgtcttaggatcggtcactggtgcactcagtgttcacttcctgctcgatcaccactggtggatgggtgtgatcttgggttgtgccctagttgtgtgcgccacgttgggtgacttggttgagtcgcagttcaaacgcgatttgggcatcaaggatatgtcgaaccttcttccaggccacggcggattgatggaccgtttggatggcatgctcccggccgcgatggtgacgtggttgatcctgagtgtgatcagcagctcgtatccgtcgtaaagcttgggccagctttaagt

SEQ ID NO: 10004 - protein, 297 aa, Corynebacterium glutamicum
MNEPEQHHRSMRMPKPKNNAGRDLKAAIAVGIGLGVLVLLGIVLSPWGWYILVAGFMAAATWEVGSRLKEGGYHLPLPIMIIGGQAIIWLSWPFGTMGILASFVATVLVLMYFRIFYNGTEKEARNYLRDTSVGIFVLTWIPLFGSFAAMLSLMQNNSIPGTYFILTFMLCVIASDVGGYIAGVFFGSHPMAPLVSPKKSWEGFAGSIVLGSVTGALSVHFLLDHHWWMGVILGCALVVCATLGDLVESQFKRDLGIKDMSNLLPGHGGLMDRLDGMLPAAMVTWLILSVISSSYPS

SEQ ID NO: 10005 - DNA, 765 bp, Wolinella succinogenes
  CDS (1)..(765)
atgctagatagactcaaaagcatcgaaccagcgcgcctctacaccgcaggaatcctcatcgccatcatcttattggtggtctttatcaatagttacttcgtcatgtgggctttctttggcatctgctatcttttagccttttatgaagcctccaagctttatggaagccaaagtatcgggatctacgccgctgccatcttcatttgggcgctctcagccatctatcctgcccctttggagacactctttttggtgctcgtgattctcgcctcttatcaagccttcaccaaaaaaggctcatggaacgatctaatgcccctgctctatcccaccgtgcctttcctctttctcttggcgctctataaggattatggcatcggagcgattgtctggctcatctttgtggtcgccctcaccgatactgccgccttttttgggggcaagatgtttggcactcgacgctttagtgaaacttcacccaataagacccaagagggagtctttattggagtggcggttgcaacgctcataggcacgcttgcggggctctctacggtgagctttgagaaagcctttgccatcactgtcctcaccagccttgcctccgtttttggtgacctctatgagagttacctcaagcgcgaagcgggagtgaaagatagcggacgcctcttccctgggcatggaggaatccttgatcgcgccgatggattcatgtttggcggaattatcatgctcgtttgccttagaggattggcgggttga

SEQ ID NO: 10006 - protein, 254 aa, Wolinella succinogenes
MLDRLKSIEPARLYTAGILIAIILLVVFINSYFVMWAFFGICYLLAFYEASKLYGSQSIGIYAAAIFIWALSAIYPAPLETLFLVLVILASYQAFTKKGSWNDLMPLLYPTVPFLFLLALYKDYGIGAIVWLIFVVALTDTAAFFGGKMFGTRRFSETSPNKTQEGVFIGVAVATLIGTLAGLSTVSFEKAFAITVLTSLASVFGDLYESYLKREAGVKDSGRLFPGHGGILDRADGFMFGGIIMLVCLRGLAG

SEQ ID NO: 10007 - DNA, 855 bp, Porphyromonas gingivalis
  CDS (1)..(855)
atgaaagcagttttgattcgcagcctcagtggtctggtctatatggccctgatcatccttcccgtcgtactaagggaaccggctttgttcttagcggtttttgccgttttcatcgtgttgggactgcgggaattcgcctcgctggtcaatctgaatcgcacacgtccccttcgggcattcatggacggacttttcggtgccttcctctttgcggccatcttcctatacggcagtgaccgaatggatgtcacgatatttatcccgtatatcttctatgtcctctacactatggtgcgcagtctatattcggatcgccataaggccggatcggacaatagccgcactttcatggggcatctgtatatagcggcaacgcttggtttgggtagtcttctgctcgtgcccgaaagtatcggcagggagttggcagtaggagaagtggcagacttcacgcctcactacttcctcttcgtttttgtgctgatatggctgaatgatacaggagcttttattgcaggttccctctttggcaagcatacactcttcaaggtcatatcacccaagaaaacatgggagggctttatcggagggctgctgttcactgtggcaggtgcattgctggcaggccactattccggttcggccaagcatccgatggagctggtcttctttgctctactggtaacggccatggccacttggggcgatctgtatgagtccaatctcaaacgcaatgcaggagtgaaggattccggccatatcattcccggacatggaggtatactggaccggctggacagtgctctcttcgtattcccggccgtctatcttttcattctgatcttcggattgtaa

SEQ ID NO: 10008 - protein, 284 aa, Porphyromonas gingivalis
MKAVLIRSLSGLVYMALIILPVVLREPALFLAVFAVFIVLGLREFASLVNLNRTRPLRAFMDGLFGAFLFAAIFLYGSDRMDVTIFIPYIFYVLYTMVRSLYSDRHKAGSDNSRTFMGHLYIAATLGLGSLLLVPESIGRELAVGEVADFTPHYFLFVFVLIWLNDTGAFIAGSLFGKHTLFKVISPKKTWEGFIGGLLFTVAGALLAGHYSGSAKHPMELVFFALLVTAMATWGDLYESNLKRNAGVKDSGHIIPGHGGILDRLDSALFVFPAVYLFILIFGL

SEQ ID NO: 10009 - DNA, 945 bp, Photorhabdus luminescens
  CDS (1)..(945)
atgactatgcttaataataaactaatcctgttgttggggggaatgttcgtgccgttaattattgccagtattgttggtgcaatactctcctccaaatattcaatggataacagtaatgcgacaatcgataatctgaatgcccgcatccgtggctggtgggggatgtgtattatttgtgtgttgtcggtgattattgggccaattggttcagtgttattatttgcgagtatgtcatttttcgctttacgggaatttttcactttgacaccaacacgacgaagtgaccatgaggcgatgttctggtgtttctttattttcatgccattgcaatacattgccgttggtattgagtggtatggcgtgttttctattttcattcctgtttatgtgttcctgtttttacctgctcgtattgcattagcaggggatacaacgaactttctggaacggacagctaaaatacagtggggaatgttagttgctgtattctgtattagccatgcccccgctttattgatgttagatattcctggttatgaaggggagaatgtcgaattattgttgtttttaatgattgtggtgcagatgtcagatgtcttgcaatatgtgtttggtaaattatttggtaaacatcctattgtgcctaaattgagtccgaataaaacagttgaaggttttgttggtggcattttggtttcagtgttattaggaatgtcactttattgggtaacgccattttctccgtgggaggcaggtttgatgtcattagcgattacgctgatgggctttattggtggcttgtgtatgtcggcgataaaacgtgatagtggcattaaagatttcggtgaaatgattgaaggtcatggtggcatgttagataggatcgattcgttatgttttgccgccccagtctttttccatctgacacgttatttttatacataa

SEQ ID NO: 10010 - protein, 314 aa, Photorhabdus luminescens
MTMLNNKLILLLGGMFVPLIIASIVGAILSSKYSMDNSNATIDNLNARIRGWWGMCIICVLSVIIGPIGSVLLFASMSFFALREFFTLTPTRRSDHEAMFWCFFIFMPLQYIAVGIEWYGVFSIFIPVYVFLFLPARIALAGDTTNFLERTAKIQWGMLVAVFCISHAPALLMLDIPGYEGENVELLLFLMIVVQMSDVLQYVFGKLFGKHPIVPKLSPNKTVEGFVGGILVSVLLGMSLYWVTPFSPWEAGLMSLAITLMGFIGGLCMSAIKRDSGIKDFGEMIEGHGGMLDRIDSLCFAAPVFFHLTRYFYT

SEQ ID NO: 10011 - DNA, 849 bp, Photorhabdus luminescens
  CDS (1)..(849)
atgctgaagtaccgccttataacggctgtgatattaatccctcttgtgattgccgctctgtttttgctgccaccagtagcgtttgggctggtgattattgctgtttcagcacttgctgcgtgggaatgggggcaattcgctggcttatttaaccaaaagaaacgggctattttggcagttctgtttgctattggtttattggccttacaatatactctgccagatttcactgatttgattggacaacctcaaatcacttttatcctatgggggggaatgatttggtggattgttgcgacgcttctggttgttacctatccttcttccgctgtaatttggaagagatccattttattgcgccttttgtttggtgtcctgacattagtgccgttttactgtggaatgatggtgttacggactcagggatatgatgataattcatattatggtgcatggtggttactgtatgtcatgttgctagtgtggggagcggattccggcgcttatctcttcggacgtactttaggtaaacgtaaaatggcaccgaaagtttctccaggaaaaacgctggaaggattaatcggggggttaatgacagcggccattatttcatggttgtttgggaaatatgctccagtacctgcaatgcctgaaaaactcatgttgtgctctgctattgttgttatcgcttctgtatttggtgatttgacagagagtatgttcaaacgtgaatcgggtattaaggatagcagccagctaattccgggacatggcggtgttatggatcgtattgatagcctgacggctgcgatccctgtttttactggcctaatgttgctggtattttga

SEQ ID NO: 10012 - protein, 282 aa, Photorhabdus luminescens
MLKYRLITAVILIPLVIAALFLLPPVAFGLVIIAVSALAAWEWGQFAGLFNQKKRAILAVLFAIGLLALQYTLPDFTDLIGQPQITFILWGGMIWWIVATLLVVTYPSSAVIWKRSILLRLLFGVLTLVPFYCGMMVLRTQGYDDNSYYGAWWLLYVMLLVWGADSGAYLFGRTLGKRKMAPKVSPGKTLEGLIGGLMTAAIISWLFGKYAPVPAMPEKLMLCSAIVVIASVFGDLTESMFKRESGIKDSSQLIPGHGGVMDRIDSLTAAIPVFTGLMLLVF

SEQ ID NO: 10013 - DNA, 1131 bp, Mycoplasma gallisepticum
  CDS (433)..(1131)
attaagcctataatgcggataggaacacaattaaaagataaacaaccaactaagaatggtagattagtatcaactattgtcatagttggtgtttatcttttattgtttatttttaattctttatcagatttttttaacaattggtcaccactaagaccgattgtaaatcaagatcagttggttgacaccctagttaatgccagcgttcggaccctatttagtgcgatcgtgttattgatcatctcgaccgtttttttcttgggtttaaaagagattgctaatttgtttttccaacaaaacaaatgaacttttgttctacttaactcagcttattttttagttagcaatctagttaatatcgttctaatccaatttagtattgttaaacctgaactaaccttaattgtttatcacgataaattctctaacaatatgatattcttgattattgttgggataatcttattacttaatttaataattaatccgatctttttaaagcttaatcagcgtttaaataagatcaacctacttcacttatttagcttatcaattatctttagcttagggttttatgggattaattacgtactattaaataaaggttggacaacgttcttatatttaattgggatcattgtgatgatcgattcgtttgcttatatttatggtaaacggtttggtaagatcaagatggttccagagatcagcccaaataagacttgggctggagcaatctatgggattattaccacgatctttttaatggttgttgttagtattctttatgcgatcccaattattatcgggatggtaacaaaaagtaatcaaccccttgaagtaattgacccacataatttattagtcaatatttattacatcaccttttatcaagaaacaaataatttcattatcttctggtgggtattttgtgggtttgcaatcttagttttagccacaattgcaatcttaggtgatctgtatttttcttatgttaaaagacaatatcagatcaaggattattcaaatgttttaagaggacatggtgggatcttagatcgttttgatggtttttgttttgtttttattgcctttattgtttatcagatcattattagttcagtaagataa

SEQ ID NO: 10014 - protein, 232 aa, Mycoplasma gallisepticum
MIFLIIVGIILLLNLIINPIFLKLNQRLNKINLLHLFSLSIIFSLGFYGINYVLLNKGWTTFLYLIGIIVMIDSFAYIYGKRFGKIKMVPEISPNKTWAGAIYGIITTIFLMVVVSILYAIPIIIGMVTKSNQPLEVIDPHNLLVNIYYITFYQETNNFIIFWWVFCGFAILVLATIAILGDLYFSYVKRQYQIKDYSNVLRGHGGILDRFDGFCFVFIAFIVYQIIISSVR

SEQ ID NO: 10015 - DNA, 804 bp, Gloeobacter violaceus
  CDS (1)..(804)
atgtcggcccgcatcctcagcgcgagtgttctcatccccgtggtcctgctggccatctacctcgggggctggtttttcaccctggcgctcgcggtactggtggtgctggggcagatcgagttttttgagattgtccgccgcaagggctaccggcccaccgagaacctctgcctgggtctgagcctgacgctgcttgccattcagcagctctatccgcaactggccaatggtgcctttgtgctggccggggggctggtgtgcgtgtcgctgctgtttcgccgccagcccccggccacgatctccgatatggccaccagtcttctggggcttttctacaccggctatttgcccagtttcttggtgcagcttcgagccctcgatggattgggctatctgctgctgcttacctttgcctgcatctgggcctcggatatcggcgcgtttttcttcggcaaggctttcggccgcacaccgctcacacccatcagccccaaaaagaccgtcgaaggagcaatcttcggcacgacggcgagcattctggtcggtctggccggggccgccctgctgggctggtcgctctggcccctcaccggcgtcgtctttgggttgctcgtgggcgtgagcgggctgttgggcgacctgaccgagtcgctgatgaagcgcgatgtcggcctcaaggacgcgggcaacttgatccccggccacggcggcattctcgaccgcgccgacagctacatcttcaccgccccggtcgctttttacttcatcgatttcatcgtcctgggccgcctgccgttgccttga

SEQ ID NO: 10016 - protein, 267 aa, Gloeobacter violaceus
MSARILSASVLIPVVLLAIYLGGWFFTLALAVLVVLGQIEFFEIVRRKGYRPTENLCLGLSLTLLAIQQLYPQLANGAFVLAGGLVCVSLLFRRQPPATISDMATSLLGLFYTGYLPSFLVQLRALDGLGYLLLLTFACIWASDIGAFFFGKAFGRTPLTPISPKKTVEGAIFGTTASILVGLAGAALLGWSLWPLTGVVFGLLVGVSGLLGDLTESLMKRDVGLKDAGNLIPGHGGILDRADSYIFTAPVAFYFIDFIVLGRLPLP

SEQ ID NO: 10017 - DNA, 807 bp, Chromobacterium violaceum
  CDS (1)..(807)
atgctgataacgcgaattctgaccgcgctcgtattgctgccgctgatgctggcggcgcttttcctgtttcccgccgcggcctgggcggggttttcctggttgatcgtcgtgctggccctgtgggagtacactcgcatggtcgggatgtcgctgccgcgtcaggcatgctaccttgcgctgtcctcgctgttcgccgccgcggcctggttcggccactggcggatgcagggcgccgagcatggcgccgtgctggcgctgtggctgctgctggtgccggcctggctggccaagcgctggaaaatgccgtccggcctgactgcctggctgctgggctgggcgctgatgctgccggcttggttcgcctttcttgagtggcgcccgaacgcctccgcgcgcgacgcgctggcgctgttggccgtgatgggcctggtgtgggtggccgacgtggcggcctatttctccggcaaggccttcgggcggcgcaagctggcgccggccatcagtcccggcaagagctgggagggcgtgtacggcgccgtcgtctgcgtggcggtctatgtcgcgctggtcgatcatttcggctggctggacatcaagctgccgttgtggggcctgttgctgctggcgctgccgttgaccgcggtcagcgtgtgcggcgacctgctggagtcctggttcaagcgctccgccggcatcaaggacagcagccgtctgctgccgggccatggcggcgtgtatgaccgaatcgacagcctgatcgccgtattggcggtcagcaacgccctgcgcgcgctgggcggcatgtaa

SEQ ID NO: 10018 - protein, 268 aa, Chromobacterium violaceum
MLITRILTALVLLPLMLAALFLFPAAAWAGFSWLIVVLALWEYTRMVGMSLPRQACYLALSSLFAAAAWFGHWRMQGAEHGAVLALWLLLVPAWLAKRWKMPSGLTAWLLGWALMLPAWFAFLEWRPNASARDALALLAVMGLVWVADVAAYFSGKAFGRRKLAPAISPGKSWEGVYGAVVCVAVYVALVDHFGWLDIKLPLWGLLLLALPLTAVSVCGDLLESWFKRSAGIKDSSRLLPGHGGVYDRIDSLIAVLAVSNALRALGGM

SEQ ID NO: 10019 - DNA, 858 bp, Prochlorococcus marinus subsp
  CDS (1)..(858)
atgagattgcgaagtggcttattaattggattgtttgggttagttgttgttttattaggcggatggtatttcacaatagcaattgcattacttacctacattgcacttctcgaattttttagaatggcagaattcacaggaattaaaccagccaccaaaactaccttattttcttgcttcataattacaattgctacatatctagaagttattggattccttgatagagagatatacaattcaatattaccaatatgttcagtaggaatatgcacgtggttattgctgcagccaaagtcaggcaccatttcagatattgcagcatcaattttcggattattttatttaggttttttacctagttattggattaaattaagagcaatacaatcgactataaataattcttccaatggaatattatcctttgaaaatatctcaaattcgacaggtctttatttaacattaatttcatgtttattaattgtggcaagtgatataggttcttattttattggaaagtcatttggggaaagggctctttccccattatctccaagtaaaactatcgaaggtctgatcggaggaataatatgctcaatttcagtagcaaccttttttgcgtttttacttagttggcagaatccattcttaattgggattttatatggaatattagtttctcttatggcattagtaggagatttaattgaatcaatgatgaaaagagatgcgaaaattaaagattctggaacttttttacctggtcatggtggaatacttgatagaattgatagttacatttttaccccttcagttatctattatataattataattttgaggttttttaattaa

SEQ ID NO: 10020 - protein, 285 aa, Prochlorococcus marinus subsp
MRLRSGLLIGLFGLVVVLLGGWYFTIAIALLTYIALLEFFRMAEFTGIKPATKTTLFSCFIITIATYLEVIGFLDREIYNSILPICSVGICTWLLLQPKSGTISDIAASIFGLFYLGFLPSYWIKLRAIQSTINNSSNGILSFENISNSTGLYLTLISCLLIVASDIGSYFIGKSFGERALSPLSPSKTIEGLIGGIICSISVATFFAFLLSWQNPFLIGILYGILVSLMALVGDLIESMMKRDAKIKDSGTFLPGHGGILDRIDSYIFTPSVIYYIIIILRFFN

SEQ ID NO: 10021 - DNA, 915 bp, Prochlorococcus marinus
  CDS (1)..(915)
atgatagcagaggcctttcgatggagattggttgcagccggatcttccagccagcggattatcagtggcctggctgctggagctttcggtttggtggtggttgctttagggggttggtggttcacggttggtttgggtgtaatcgtgcaccttgctttgcttgagtttttccgcatggcgaagttcaccggaatcaggccggcgacgaaaacgactcttgtggcctgtcagttgttgctgatcagtacacagtggggagtggttggcgggttgccatctgatcttgctgcagcagtgctgcctctttctggcgccgccatttgcggttggttgttgcttcagccgatcaccggatccattgccgacatcgccgcctcgatctttgggttgttttacttggggtttttacccagtcattggttgcgattgcgtaatttgagtgctatcgatcttgctcctgggctgggtcagcttcctggctggtgtgcaggctggttgacttctgggatggcgatcactttggtggcttgcctgatgatcgtcgctagtgatattggctcttatgaattgggacgtcgttttggacgtctacctttatcttctatttcgcctggcaagactgtggaaggtgctgtcggaggcctgttttgcgcaatgactataggggcagttgccggtgaacttttggcttggccattggggtttttgctgggcgtggtgcttggagttttggttgcattatttgcgctggttggagacctgatcgagtcgatgatgaaacgagatgcgggtcttaaggattctggtgatgcgctgcctggtcatggcggcatccttgatcgcattgatagctatctcttcactcctgcagtggtgtattacgcagtaacgctgatcctgcctgtcatgagttaa

SEQ ID NO: 10022 - protein, 304 aa, Prochlorococcus marinus
MIAEAFRWRLVAAGSSSQRIISGLAAGAFGLVVVALGGWWFTVGLGVIVHLALLEFFRMAKFTGIRPATKTTLVACQLLLISTQWGVVGGLPSDLAAAVLPLSGAAICGWLLLQPITGSIADIAASIFGLFYLGFLPSHWLRLRNLSAIDLAPGLGQLPGWCAGWLTSGMAITLVACLMIVASDIGSYELGRRFGRLPLSSISPGKTVEGAVGGLFCAMTIGAVAGELLAWPLGFLLGVVLGVLVALFALVGDLIESMMKRDAGLKDSGDALPGHGGILDRIDSYLFTPAVVYYAVTLILPVMS

SEQ ID NO: 10023 - DNA, 897 bp, Synechococcus sp
  CDS (1)..(897)
atgtcttcctccaacccgtcattgcgagccgccaacagcctgcgcaagcgactgcgcagcggcatcgccatcggcggcttcggcgcggtggtggttctgctggggggctggtggctcaccctcggcgtcggcgtgatcgtgcatctgggtctgctggagttcttccgcatggctcagttcaaaggaatccgcccggccaccaaaacaacgctcgtggcctgtcagttgctgctgctcaccacccagtgggcagcggttcagagcggctggcccgaggcgctgtcgggggcggtgctgcccctggccggtgccgccatctgtgcctggttgctgctgcagccgctcaccggatcgattgctgacatcgccgcctcaatcttcggactgttttatttggggtttctgcccagtcactggctggccctgcgcaacctctccgatccggccctggctcctggaacagcctggctgtgcagcagtggtctggccatcaccctctcggcctgcctgatgatcgtggcgagcgacatcggttcatgggcattcggcaagcgctacggcaggacgcctttgtccccgatctcgccgtccaaaacagtggagggtgccctcgggggattcggatgcgccatggccgtcggcctgctctgcgcgcgggtgatgggatggccgctcggtggattgccaggggtggccgtcggcgcactggtggccctgattgccctggtgggagatctgactgaatcgatgatgaaacgcgatgccggactgaaggactccggtgacgtgctgccaggccatggaggaatccttgatcgcattgacagctacctgttcaccccggccgtgctgtacgcgctgctgaccctggcgaagccgctgatcagcaccggctag

SEQ ID NO: 10024 - protein, 298 aa, Synechococcus sp
MSSSNPSLRAANSLRKRLRSGIAIGGFGAVVVLLGGWWLTLGVGVIVHLGLLEFFRMAQFKGIRPATKTTLVACQLLLLTTQWAAVQSGWPEALSGAVLPLAGAAICAWLLLQPLTGSIADIAASIFGLFYLGFLPSHWLALRNLSDPALAPGTAWLCSSGLAITLSACLMIVASDIGSWAFGKRYGRTPLSPISPSKTVEGALGGFGCAMAVGLLCARVMGWPLGGLPGVAVGALVALIALVGDLTESMMKRDAGLKDSGDVLPGHGGILDRIDSYLFTPAVLYALLTLAKPLISTG

SEQ ID NO: 10025 - DNA, 963 bp, Rhodopirellula baltica
  CDS (1)..(963)
atgaccaacgttgcaatctctgtgtttggattgttgctcgtgggcaccatctatcgcttggcaacgctgcgggattggaccagtgatctggctcgcaaacgattgggcagcctgctttcatggtggattgttgccacatgggttctcctgtgtgcagtcggtggaacgatcatcgcctccttgttgtttgcgacggtgagcacgctcgcactccgcgaatatgcgagattggcttttcatcacgacgacgaaagcggccaacccgctattgaaccccacttcgaagaccggacaaacgctctgcccgccatgccgatcatggtggtaggttacgtctgcatcgcattgctgtacgcggggctcgctgcgggtgcggaccacacgctcctcgtttgcctcccactggcgtgcgtcatcatcgcgggcagtgtgctgatggcgacggcttccacgaaacacttcacaagcaacgttgggggcattgtttacggagtcaccctgaccggctgtcttcctgctgcatcaattttgttgcttccatccaacccgaccccgtcactcgcacttccgggttggttcttgttgttgattggcgtaacggaagtcaacgacatcaccgcggcatggttcggcagggcgttaggacgacacaaactcgccccgaccctttcgcccaacaagaccgtcgaaggattcatcggtggcgccctcaccacaatcacgctagccactcttatcggcccgaacataaccgacatgtcgcacgcaacgagcagcgtttttggtttagcaatcgcgattgcggggactcttggcgatctcaacatgtccgcgatcaaacgttccgcaggggtgaaggacagcggcaatgtcttgcccgggcaaggcggcattcttgatcgcatcgattccctcacattcaccgccccggtcgcactgctgctgatgaaggtcctctcatga

SEQ ID NO: 10026 - protein, 320 aa, Rhodopirellula baltica
MTNVAISVFGLLLVGTIYRLATLRDWTSDLARKRLGSLLSWWIVATWVLLCAVGGTIIASLLFATVSTLALREYARLAFHHDDESGQPAIEPHFEDRTNALPAMPIMVVGYVCIALLYAGLAAGADHTLLVCLPLACVIIAGSVLMATASTKHFTSNVGGIVYGVTLTGCLPAASILLLPSNPTPSLALPGWFLLLIGVTEVNDITAAWFGRALGRHKLAPTLSPNKTVEGFIGGALTTITLATLIGPNITDMSHATSSVFGLAIAIAGTLGDLNMSAIKRSAGVKDSGNVLPGQGGILDRIDSLTFTAPVALLLMKVLS

SEQ ID NO: 10027 - DNA, 1047 bp, Rhodopirellula baltica
  CDS (1)..(1047)
atgacggacaattttgaatctgacttttcgcaaggatcccattcattgttgatcgaccggcttcgcagcgcagcggtgttgattgcgatcgcattgggatgcttgttcgttgacgcgaaattcagcaccgccggaacggaaggtttgcttcttgttccgttgttgctttttttcgcactgggaacgacctgggatgtcacctcgttgttgatgtcgtctggtcgagatgtttggcgagccgggtgcatgatcgccgttggtgcgatcagtcttggccccgccattccggcgctggtcaatgcggcgtcgcagctcagcggtggtgcgataggtgcctacccaagggattgccccatcggacaattgggttgggtgatcaccatggcgattgcttcggtgtttgcgttgctcattcgcgaaatgcggtcttacgttgcggtagttcctgagcagttggatgcctcgaccgcgaaggtggactccgttgtgttaccggcttccagcagtattgaccgaaccatgcgggcggcgtttgtctccctgtacgtcgggttgccaatgagtttgcttttcgcaattcggggtttgggaagcgacatcagcacgtcttggggattggctgcgttgctgacgatgatcgcgacgaccaagtctgccgatgcgggggcgtacttcgccggcaaaacgtttggtcgtcacaagctgatcccgcgactgagtccaggaaagacttgggagggagcggttggcggtgtcgtgatgtcgacattggtggcgatggcttgtttgcggtggttgtttccagcgttggtttccgacgcgattccgttgagttcgctgccgtcgaccagttgggcgttcatctttggcccggcccttgcaatcaccggaatggtcggtgatttggcggaatcgatgttcaaacgagactgtggggcaaaagattccggaaattggcttcccggtttggggggagtctgggatgtgacggattcgttgattgctgcgattttgccggcttttctttgtttagcggccgcggcatga

SEQ ID NO: 10028 - protein, 348 aa, Rhodopirellula baltica
MTDNFESDFSQGSHSLLIDRLRSAAVLIAIALGCLFVDAKFSTAGTEGLLLVPLLLFFALGTTWDVTSLLMSSGRDVWRAGCMIAVGAISLGPAIPALVNAASQLSGGAIGAYPRDCPIGQLGWVITMAIASVFALLIREMRSYVAVVPEQLDASTAKVDSVVLPASSSIDRTMRAAFVSLYVGLPMSLLFAIRGLGSDISTSWGLAALLTMIATTKSADAGAYFAGKTFGRHKLIPRLSPGKTWEGAVGGVVMSTLVAMACLRWLFPALVSDAIPLSSLPSTSWAFIFGPALAITGMVGDLAESMFKRDCGAKDSGNWLPGLGGVWDVTDSLIAAILPAFLCLAAAA

SEQ ID NO: 10029 - DNA, 891 bp, Prochlorococcus marinus
  CDS (1)..(891)
atgacccaagctttttatagtaaaagaattgttagcggtatgtttgccggcacttttggtcttttagttgttggtattggagggttttggtttacatttgcacttggtttaataattcatttggcacttattgagtattttcgaataacagagtttgcaggtattagacctgctaccaaaactactcttctggcatgtcaaatacttttgtttacaacttattttgaaattcaaggaacttttcctccagagattgcaagtgcagtattagctattgcaggagcagctatttgtggatggttacttttacaaccagtcccaggatctatttcagatattgcagcatcaatttttggacttttttatttaggctttcttcctagttattggataagattacgaggactttctgactatgatttaaatgcctcaataaaactaatgtcaattaatcatccaaatatttttacattagggatgacagttacgctcattacttgttttatgattgtagcatctgatattgggtcttattactttggtaggattttaggtaagcatcctttatctttaatatcgccactaaaaacaattgaaggagctatttgtggtttgctttgttctgttttaataggtattatttcagctatatttattaaatttgatttttggggcttattatttggggcaattcttggtgcattagttggcttgctttcaatagttggtgatttgattgaatcgatgatgaaaagagatgcaggattaaaggactctggaaatgctttgcctggccacggaggcattttagaccgtatagacagttatttatttactccttccattatttactatttaattaaatttattttaccttctttgcttggttaa

SEQ ID NO: 10030 - protein, 296 aa, Prochlorococcus marinus
MTQAFYSKRIVSGMFAGTFGLLVVGIGGFWFTFALGLIIHLALIEYFRITEFAGIRPATKTTLLACQILLFTTYFEIQGTFPPEIASAVLAIAGAAICGWLLLQPVPGSISDIAASIFGLFYLGFLPSYWIRLRGLSDYDLNASIKLMSINHPNIFTLGMTVTLITCFMIVASDIGSYYFGRILGKHPLSLISPLKTIEGAICGLLCSVLIGIISAIFIKFDFWGLLFGAILGALVGLLSIVGDLIESMMKRDAGLKDSGNALPGHGGILDRIDSYLFTPSIIYYLIKFILPSLLG

SEQ ID NO: 10031 - DNA, 855 bp, Helicobacter hepaticus
  CDS (1)..(855)
atggataccaatgagaaagaatctataacatctcaacaaaacacaaaagagcagataaaagcgaagtttcttgctgataaggcacgttttatcactgctggtgtgcttatagttgcacttattttaattttaagcattgattcaaccttacttacttgtatcgtgcttgctattatttgcctcattggtgtgcaagaatcccttaaactctatgctctcccacctgcattacattattatattgctacagcttttatttgggtgcttgcatactttaatgaacgcataatagaatctgcactttttactcttgtgatttacgcttcctatcttgcttatagcaaaaaaatctcgcctaaaaccctgcttccatttatttatcctgtgttgccgtttttaagcatttacgcactctataaagacgccggaggagctggagtatgggtgattgtatggcttattgtcattgtagccctcactgacacaggagcatatcttggaggaaaagcttttggtaaaacgcctttttgtcctacgagccccaaaaaaaccattgagggtgttatttgtggggtaatttgtggggtaatttgtggctctattgtgggaattggcacttgtggaaacttcttatactcacttggtattacttttgtagtcgcaatttcttctgtctttggcgatttatttgagagttatctcaaacgcgaagcaggtgtgaaagatagtggctctgtgttgcctggacacggtggtgtgcttgataggcttgatgctgtgctttttggtgcaatagtaatgcactttttacttttctttttgcccggttacaaagacttggcaattatgctctaa

SEQ ID NO: 10032 - protein, 284 aa, Helicobacter hepaticus
MDTNEKESITSQQNTKEQIKAKFLADKARFITAGVLIVALILILSIDSTLLTCIVLAIICLIGVQESLKLYALPPALHYYIATAFIWVLAYFNERIIESALFTLVIYASYLAYSKKISPKTLLPFIYPVLPFLSIYALYKDAGGAGVWVIVWLIVIVALTDTGAYLGGKAFGKTPFCPTSPKKTIEGVICGVICGVICGSIVGIGTCGNFLYSLGITFVVAISSVFGDLFESYLKREAGVKDSGSVLPGHGGVLDRLDAVLFGAIVMHFLLFFLPGYKDLAIML

SEQ ID NO: 10033 - DNA, 870 bp, Haemophilus ducreyi
  CDS (1)..(870)
atgcttaaagaacgcatactttctgctatagcaatgattatcgccgtattagcaggcatttttttactttctccactcccattcacattaattttagcagcagttattaccgctgcaatctgggaatgggcccaatttgcaggctttaagcggtcactttctcgcgcaattatcacctttgtgacaatatgcttatttattctgctgatttttgctaatactcattatatccgcgccggtcgttttttaacggatcaaacgattcctttattattcatttcttgttgttggtggctaatcgcatttggcttagtgatcagttatccaaaatcagctagcctttggtctaaatctattacagcaaaatttatttttggcttctgcacgttaatcccattttttattgcaatacttgcattacgattcaacaactacgccttcaatcaatttcaaggcgcgtatttattactttatgtatgcctattagtatggtgtgctgattctggtgcttatttcttcggcagagcatttggaaagcgaaaattagccgctaaagtatcacccagtaagtcttgggagggcgcattgggaggcttaatcacttcttgcgtgatggctttattattcataaaactaacgccaaataatatttttggtcgcgaatttgaaacactcccctttattatagtctcggttgctacagtcgccgtttcaagtttaggtgatttagcagaaagtatgttcaaacggcaagctaacataaaagacagtagtaatttaattcccggccatggcggtattttagatcgcattgatagtttaactgcagccattccattttttgctaccttattcttttttgtattatag

SEQ ID NO: 10034 - protein, 289 aa, Haemophilus ducreyi
MLKERILSAIAMIIAVLAGIFLLSPLPFTLILAAVITAAIWEWAQFAGFKRSLSRAIITFVTICLFILLIFANTHYIRAGRFLTDQTIPLLFISCCWWLIAFGLVISYPKSASLWSKSITAKFIFGFCTLIPFFIAILALRFNNYAFNQFQGAYLLLYVCLLVWCADSGAYFFGRAFGKRKLAAKVSPSKSWEGALGGLITSCVMALLFIKLTPNNIFGREFETLPFIIVSVATVAVSSLGDLAESMFKRQANIKDSSNLIPGHGGILDRIDSLTAAIPFFATLFFFVL

SEQ ID NO: 10035 - DNA, 867 bp, Candidatus Blochmannia floridanus
  CDS (1)..(867)
atgttgcgtgatcgtgtaattagtacatgtatattagtccctattttaatttccatattgtttttattttctgtaacacaattttcatgtttattatttgcagtatgtgctattagtgcatgggaatggggtaaattaatgcatttttctgaaaatatttattatttgtggatttttgttatatgtagcatattgtgtattacattaataatgattcttattcacaattatttatattttaattgtttttttattctgttaagttgttttagttttgttataatatggtgggtgtttatgttgttattagtattattttatccttattcttcttgtgtttggaatagttctaatgtactacgtttttgttttgggttattaatcatttttccatttttttttggagttttaacattgtataaatttggttattctaataatgatgttaatgggaaatggtggttgttatatgttttggtattagtatggataaatgatgttagtgcgtatattattggtcaaatgtttggaacacataaattattaaaatatgtatctcctaaaaaaacttgggaaggttttataggtggtatattagtttctactattatagcatggataattagtaaatatatgatagatgttagaaatttttatataatatttgtctgttttgtatgtgctattttattttctgtaataggtgatttaaccgaaagtatgtttaaacgagaatctggagttaaagatactggaaatttaattcctggtcatggaggtattttggatcgtatggatagtttattttctgctattccggtttttactgttttattatttttattgatgtatattgatattatttaa

SEQ ID NO: 10036 - protein, 288 aa, Candidatus Blochmannia floridanus
MLRDRVISTCILVPILISILFLFSVTQFSCLLFAVCAISAWEWGKLMHFSENIYYLWIFVICSILCITLIMILIHNYLYFNCFFILLSCFSFVIIWWVFMLLLVLFYPYSSCVWNSSNVLRFCFGLLIIFPFFFGVLTLYKFGYSNNDVNGKWWLLYVLVLVWINDVSAYIIGQMFGTHKLLKYVSPKKTWEGFIGGILVSTIIAWIISKYMIDVRNFYIIFVCFVCAILFSVIGDLTESMFKRESGVKDTGNLIPGHGGILDRMDSLFSAIPVFTVLLFLLMYIDII

SEQ ID NO: 10037 - DNA, 858 bp, Bordetella pertussis
  CDS (1)..(858)
atgctgggccagcgcatcatcaccgccgccgtattgcttgccgtcctggccctgacgctggcgctggccaacccgtggtggttcgtcgccttgctggcgctgggcgcggcctgcgccgcctgggagtggctgcgcctgacggtgcgccagcccctctcgggtgcgctgtgcgtcggcctggcggcggcgctgctggcggcgatgctggccatggcgcaggcctggatccagggaggcgtgtccggcctgcggctcgaggtctgggtcggctactggctcaccccggcggtcgtggccgtctggctgctgggcgcgggcacggcggtcgcgcgcggccgcgccgacgcgccggcggccagcctgggctggacgctgttcgccattcccgccgtgctggccgcctggtcggtgttggcgctgatgtatctgtcgcgcggcggcgcctatgtggtgtcgctgctggcgctggtgtgggtggccgatatcgccgcctatttcgccggccgcgccttcggcaagcgcaagctggcgccgcgggtcagcccgggcaagacggtggccggcgcggtggccggcgtgctgggcgcggtcgcgtggatcgccctgagcagccaatgggatggaacttatggccaggcgctggtcgaacgctggtcctggtggctggcgttgccggcggccgccttgctgggcgtcgtctccatcgtcggcgacctgttcgagtccttgctcaagcgccgcgccggccgcaaggattccagcgcgctgctacccggccacggaggcgtctatgaccgcatcgacgccatcctgccggtggcgccgctggcgttgctcatgtctggagtgttgttttga

SEQ ID NO: 10038 - protein, 285 aa, Bordetella pertussis
MLGQRIITAAVLLAVLALTLALANPWWFVALLALGAACAAWEWLRLTVRQPLSGALCVGLAAALLAAMLAMAQAWIQGGVSGLRLEVWVGYWLTPAVVAVWLLGAGTAVARGRADAPAASLGWTLFAIPAVLAAWSVLALMYLSRGGAYVVSLLALVWVADIAAYFAGRAFGKRKLAPRVSPGKTVAGAVAGVLGAVAWIALSSQWDGTYGQALVERWSWWLALPAAALLGVVSIVGDLFESLLKRRAGRKDSSALLPGHGGVYDRIDAILPVAPLALLMSGVLF

SEQ ID NO: 10039 - DNA, 921 bp, Chlamydophila caviae
  CDS (1)..(921)
atgttgaaactgaataagttcaaaactcctttctatggagatctttttcaacgagttgttgtacattcgttggttctcactttcttagtacttcttctttacagttctttatttcctgtcacatcttttgctttaggatttatcacagcgctttgtagtgctgtaggaacctatgaatatggaacgatggccagagtgaagatgcactatgctttccgtttatatagtgctatgggatcctttatctttgttttaaccagtttcattgcgattcgatggcgtcatgtccttccggaatttatttctaccctcccctggagcttcttatttatttgggtaacgatcaatgtttttagatctaggaaaaataaatgtggtcctttggaaagctcaggaattaccttattttccatgctttatgtgggcattcctgtgcggttatttctacacattctttatggatttatccacacggatgaaccctttttaggtgtgtggtgggcatgttttctcattgccacaacaaaaggagcagatatcttcggatatttctttgggaaagcactgggacaaaagaaaatcactcctgaaatcagtccacataaaacgattgttggttttgttgcaggatgtttaggagctacattaatcagtgtcgccttctttttacaaattcccgcaagattcgctaactatatcactatgccaagtattttaattgccttaggagtgattctgggaattagtggattttttggagatattatcgaatctattttcaaacgggatgcaaaaattaaaaatagtaaccaactcaaggctgtaggcggtaccttagataccttagattctctgttactttctactcctattgtgtatattctccttttgattacccaaaaatctatatttctcagatga

SEQ ID NO: 10040 - protein, 306 aa, Chlamydophila caviae
MLKLNKFKTPFYGDLFQRVVVHSLVLTFLVLLLYSSLFPVTSFALGFITALCSAVGTYEYGTMARVKMHYAFRLYSAMGSFIFVLTSFIAIRWRHVLPEFISTLPWSFLFIWVTINVFRSRKNKCGPLESSGITLFSMLYVGIPVRLFLHILYGFIHTDEPFLGVWWACFLIATTKGADIFGYFFGKALGQKKITPEISPHKTIVGFVAGCLGATLISVAFFLQIPARFANYITMPSILIALGVILGISGFFGDIIESIFKRDAKIKNSNQLKAVGGTLDTLDSLLLSTPIVYILLLITQKSIFLR

SEQ ID NO: 10041 - DNA, 1179 bp, Streptomyces avermitilis
  CDS (1)..(1179)
atgaacgaatcttcctggggggcgccgccacaagccgggtactgggggccgtccgaccaggggcctgcccagggggcagccccggcgggtcccacgtacgatgcgcatgacgcgcagcagactcgccccatgcccatcgtgcccgacgtacccgcgcatggcggagaccaggatgacgaccggggggccgctcggctgagtggccccttgttccgcgacgacacgccgcagacgacgtcctacgggtcacagacgccgtacgtgactcagtcgccctatgggtcccagacgccccatggggcccagccccagaagccggagcccatgcccgacgccccacagccagcgcccgccccgcagaagaagagcgcgggccgtgacctgggtgcggccataggggtcggcgtcgggctcggggtggtgatcgtcgcgtcgttgttcgtcgtcaaggccgtcttcgtcggggtcatagcggtcgccgtggtggtgggcctttgggagctcacctcacggctcgaggagcgcaagggcatcaaggcgcccctcgtaccgctcgcggtcggcggcgcggcgatggtcgtcgccggatacgtccggggtgccgagggcgcgtgggtggcgatggcgctcaccgcgctcgccgtcctggtctggcgcatgacggaaccaccggagggctacctcagggacgtcacggccggggtcttcgcggcgttctacgtcccgttcctggcgacgttcgtcgcgatgatgctcacggccgacgacggtccgcgccgggtgctcacgttcctgctgctcaccgtggtcagcgacacgggcgcgtacgcgatcggctggcgtttcggcaagcacaggctcgccccgcgcatcagccccggcaagacccgcgagggcctggtcggagcggtctcgttcgcgatggtggcgggcgcgctgtgcatggagttcctgatcgacgacggcagctggtggcagggcctcgtgctcggcttcgcggtcgccgccagtgccacgctcggcgacctcggcgagtccatgatcaagcgggatctgggcatcaaggacatgggcacgctgctgccggggcacggcggcatcatggaccggctggactcgctgctgccgacggctccggtggtgtggttgttgctggtgatcttcgtagggtctggctga

SEQ ID NO: 10042 - protein, 392 aa, Streptomyces avermitilis
MNESSWGAPPQAGYWGPSDQGPAQGAAPAGPTYDAHDAQQTRPMPIVPDVPAHGGDQDDDRGAARLSGPLFRDDTPQTTSYGSQTPYVTQSPYGSQTPHGAQPQKPEPMPDAPQPAPAPQKKSAGRDLGAAIGVGVGLGVVIVASLFVVKAVFVGVIAVAVVVGLWELTSRLEERKGIKAPLVPLAVGGAAMVVAGYVRGAEGAWVAMALTALAVLVWRMTEPPEGYLRDVTAGVFAAFYVPFLATFVAMMLTADDGPRRVLTFLLLTVVSDTGAYAIGWRFGKHRLAPRISPGKTREGLVGAVSFAMVAGALCMEFLIDDGSWWQGLVLGFAVAASATLGDLGESMIKRDLGIKDMGTLLPGHGGIMDRLDSLLPTAPVVWLLLVIFVGSG

SEQ ID NO: 10043 - DNA, 828 bp, Nitrosomonas europaea
  CDS (1)..(828)
atgcttagtacccgactccttaccgcattcatactattgaccgccttcctggcggcattattttatctgccggatattttctgggctgtattgcttctgggactgactgttactgcggcacgggagtggtgccgcctggggcagttttcagttggccagactgttctgtatatgatcctgactaccttgctggggggggaactgctctttctggtcagtgtggtgttatccaaaaatccggcagattcatcgatggtctggttttatgccgcatctgccgttttctggctgctggcagtacctttccagttggcgatgaaccggccgatccgtaatatatgggtgctcatgtccattggctggctggttttactgccggcatgcctgtcgctctatcagcttcgtgcaatggatccgctgttgctgcttgggtttatgggggtggtgtgggtatcagacagtgttgcttatttcatcgggcgtgcctatggcaaacacaagcttgcaccccggatcagcccgggcaaaacctgggaaggagtagctgccgcactgatcggggtactggtttatgctctgatctggttttattcggtacataaagatcaggcattggttggctggttgattcctctgttactcctgcttgcggtgctgggaatagtgggtgatttgtatgaatcactgttgaaacggcaggccggtgtcaaggatagtggcaccatacttcccggtcatggcggggtattggaccgtattgatgcattactgcccgttcttcccgttgccgctcttgcggccattttattttattcgactgaatcatga

SEQ ID NO: 10044 - protein, 275 aa, Nitrosomonas europaea
MLSTRLLTAFILLTAFLAALFYLPDIFWAVLLLGLTVTAAREWCRLGQFSVGQTVLYMILTTLLGGELLFLVSVVLSKNPADSSMVWFYAASAVFWLLAVPFQLAMNRPIRNIWVLMSIGWLVLLPACLSLYQLRAMDPLLLLGFMGVVWVSDSVAYFIGRAYGKHKLAPRISPGKTWEGVAAALIGVLVYALIWFYSVHKDQALVGWLIPLLLLLAVLGIVGDLYESLLKRQAGVKDSGTILPGHGGVLDRIDALLPVLPVAALAAILFYSTES

SEQ ID NO: 10045 - DNA, 801 bp, Enterococcus faecalis
  CDS (1)..(801)
atgagacaacgtgtcatcacagctatcgtcgcattaatcatctttattccaattatctggtatggtggttttgcaattgagattgccgctgttgctttggcagtagtcggcgtgtacgagttattccgtatgaaaggattaacgttattaagttttgaaggcgttttatcagcattaggggccgtttttttagttatcccgacaattaaatggttaaactttttgccggaaatgcaaacaaatttcattttattttatgtcactgtaatgttgttgttaggtgcttcggtaatttctaaaaatacatatacgattgaagaagctggctttccagttattgtcagtttatatgtagggatggggttccagaactttattagtgcccgttccgcaggttttgaagtcttgttatttgctttattcattgtctgggcaacggatattggtgcatatctatttggacgccgatttggtcgtcataaattgatgccagatgtttcacccaacaagacaatagaaggtgcacttggtggtattttatcagccgtcgttgtagcagcgttgtttttagttttcacagctaataaagggctatttccttatccaatgccggtgatgctcgtattgacggttctgttttctatagtagggcaattcggtgatttggttgaatcttctatcaaacgtcattatggcgtgaaagactctggtaacatcttgccaggacatggtggtattttagatcgttttgatagtttattatttgttttcccaattatgcacttatgtggattattttaa

SEQ ID NO: 10046 - protein, 266 aa, Enterococcus faecalis
MRQRVITAIVALIIFIPIIWYGGFAIEIAAVALAVVGVYELFRMKGLTLLSFEGVLSALGAVFLVIPTIKWLNFLPEMQTNFILFYVTVMLLLGASVISKNTYTIEEAGFPVIVSLYVGMGFQNFISARSAGFEVLLFALFIVWATDIGAYLFGRRFGRHKLMPDVSPNKTIEGALGGILSAVVVAALFLVFTANKGLFPYPMPVMLVLTVLFSIVGQFGDLVESSIKRHYGVKDSGNILPGHGGILDRFDSLLFVFPIMHLCGLF

SEQ ID NO: 10047 - DNA, 819 bp, Coxiella burnetii
  CDS (1)..(819)
atgaaaaataacatgcttaaatatcgcgtccttacggcgttaattttattttttttcgtattattagccatttggtttttacccatgccctggttcgctattttaattggggcgattatgatttgggctgcgtgggaatggtctgctttggcaggcattaaaaataaatactggcgcggtttttacgtgatattattggggatcacgttatttgctgcttattatttacctattttttgggtattaatcgcctcagtaatcctttggttgtgggcggcagtagccattttttgttatgccatttacatagcacccttggggtttcaatatccggcagtaaaattgattgtcgggttttttgctttaatttcttgttggttagctatcaatgccctacgagaagatatcggcggaccgggctggttattatttgggttgatgttagtttggtcgatggacacaggggcttatgcagcaggacgactctggggaaaacatacattgattgctcgtgtcagccctaaaaaaacttgggaaggattgggcgggggaataattttatcgctattgattgccgttatcggggggattttattccatttgcctttctctcaattatctttggtaatcttgcttgcgttgattacagtctttttcgctgttatcggtgatctttttgaaagcatgttaaaacgccaggcgggggttaaagatagcggtcgattattacctggacatggtggtatacttgatcgtgtcgacagcttgattgtcgccttacccatttttacactagggtctttattaataagcggctaa

SEQ ID NO: 10048 - protein, 272 aa, Coxiella burnetii
MKNNMLKYRVLTALILFFFVLLAIWFLPMPWFAILIGAIMIWAAWEWSALAGIKNKYWRGFYVILLGITLFAAYYLPIFWVLIASVILWLWAAVAIFCYAIYIAPLGFQYPAVKLIVGFFALISCWLAINALREDIGGPGWLLFGLMLVWSMDTGAYAAGRLWGKHTLIARVSPKKTWEGLGGGIILSLLIAVIGGILFHLPFSQLSLVILLALITVFFAVIGDLFESMLKRQAGVKDSGRLLPGHGGILDRVDSLIVALPIFTLGSLLISG

SEQ ID NO: 10049 - DNA, 744 bp, Shigella flexneri
  CDS (1)..(744)
atgatttcaggcccacgctggatgacgttgacgttttttacgctgataagttttctggcattgaaagaatattgtacgcttatatccgtacatttttcgcgttggttatattgggttattcctcttaactatttgcttatcggttttaattgctttgagctgtttctgttatttatacctttgactgggtttctgatattagccacctggcgagtttttgtgggtgacccctccggttttcagcataccgtgagcgccattttttggggatggataatgaccgtttttgccttgagtcatgccgcctggctattaatgttgccaaccataaatatccagggcggggcgttactggtgttatttcttttggcgttaaccgagtcaaacgatattgcacagtatttatgggggaaatcctgcggcagaagaaaagtggtccccaaagtcagcccgggaaaaacgctggaaggtctgctggggggcgtaatcaccaccatgattgcgtcactgattattggaccgttgctgacaccgctaaatacattacaggcattattagcgggtttgttaattggtattagtggtttttgcggcgatgtagtgatgtcagccatcaaacgagatattggtgttaaagatagtggaaaactattactaggacatggcggactccttgacaggattgactcattaattttcaccgctccggtatttttttattttattcgctactgctgttactga

SEQ ID NO: 10050 - protein, 247 aa, Shigella flexneri
MISGPRWMTLTFFTLISFLALKEYCTLISVHFSRWLYWVIPLNYLLIGFNCFELFLLFIPLTGFLILATWRVFVGDPSGFQHTVSAIFWGWIMTVFALSHAAWLLMLPTINIQGGALLVLFLLALTESNDIAQYLWGKSCGRRKVVPKVSPGKTLEGLLGGVITTMIASLIIGPLLTPLNTLQALLAGLLIGISGFCGDVVMSAIKRDIGVKDSGKLLLGHGGLLDRIDSLIFTAPVFFYFIRYCCY

SEQ ID NO: 10051 - DNA, 810 bp, Tropheryma whipplei
  CDS (1)..(810)
atgctaaaacaaagggtacaggcccgcacgggaagggatttggtccttgcaatcggtgtgggtcttattttgggcggactgcttctcatttctctttttgtctttctgcatttgtttgttctggtttgcatacttgtcggagttacctgccttgccgagatctttacagccacccacacgcgcggtatcttcatagtccgccctttcttgaccttgtctactgttgttctgcccgtattggcattcttttttgcatcctggtttttaccgtcgatcgcgtttttcatgcttacaatcctgcttgcccaattttttctgcgtgccaggttttctttacattcattattcatttttttgtatataccaattaccgtttcactcttcgcatttattgccgcacatccaacgggaaggttatgggtgtttttcatgcttgtcacggtaattgcatcagatacattctcgtacgtctttggaacactgttcggaaggcatcttcttgcaccgcgtataagtccaaataaaacatgggaggggctcataggtggtttcttttcatctctcttttttggcacactaacaggtattttgctgcttcacaagtcattgctgttcagtgcaactgccgcctcaattctgtttctctttgcaatccttggtgatttagccgagtcttatataaagcgcagacttggtgttaaggatatgagcggaatacttcccgggcatggaggaatgcttgacagagtggactcaatgcttttaaatatttttccaattcttttgcttgtgcacatgaattttgtgtaa

SEQ ID NO: 10052 - protein, 269 aa, Tropheryma whipplei
MLKQRVQARTGRDLVLAIGVGLILGGLLLISLFVFLHLFVLVCILVGVTCLAEIFTATHTRGIFIVRPFLTLSTVVLPVLAFFFASWFLPSIAFFMLTILLAQFFLRARFSLHSLFIFLYIPITVSLFAFIAAHPTGRLWVFFMLVTVIASDTFSYVFGTLFGRHLLAPRISPNKTWEGLIGGFFSSLFFGTLTGILLLHKSLLFSATAASILFLFAILGDLAESYIKRRLGVKDMSGILPGHGGMLDRVDSMLLNIFPILLLVHMNFV

SEQ ID NO: 10053 - DNA, 843 bp, Vibrio parahaemolyticus
  CDS (1)..(843)
atgaaacagagaataataacagcactaattttagctcccctggttattttaggtatttttaagttacccctaatgggctttattatcgcgttgacggcgataacactgttaggtttttgggagtggacacaatttacagaaagcaattctcgcattgctgcactgattccggcagccgttgttaccggacttagttttctctttatctcacctgacgcacatagcttaaaccatttgagtacacctcattatgttgtgttagggcttggttttgtgtggtggattattgcgagcttgatggcaattacttacccgaaaaccacaaaatcttggcaaggcaatcttgttttacgacatgtttttggttttctgacattactcccttttctttggagtgtaatcattctaagagcctcagacatttcggtagatccataccacggtgcaaagctcgtaatgtacgtttgcttcttggtatgggctgcagacagcggtgcttacttcgctggtaaaagtttaggcaagcgcaagatggcaccacatgttagcccaaacaaaacgattgaaggtcttattggcggtatcatcgcggcactgattgttggctggttgtttgccgattggttcaatatccagttcacgagcccaattcatatgatcatcattacgttgatcactgtcgtgatttctgtattaggtgatttagtcgaaagcatgtttaagcgtgtctctggcatcaaagacagcagtaacatcattccaggccacggtggcgtattagatcgcatcgatagcctgactgctgcatttccagtctttgctcttctatactacgtattctaa

SEQ ID NO: 10054 - protein, 280 aa, Vibrio parahaemolyticus
MKQRIITALILAPLVILGIFKLPLMGFIIALTAITLLGFWEWTQFTESNSRIAALIPAAVVTGLSFLFISPDAHSLNHLSTPHYVVLGLGFVWWIIASLMAITYPKTTKSWQGNLVLRHVFGFLTLLPFLWSVIILRASDISVDPYHGAKLVMYVCFLVWAADSGAYFAGKSLGKRKMAPHVSPNKTIEGLIGGIIAALIVGWLFADWFNIQFTSPIHMIIITLITVVISVLGDLVESMFKRVSGIKDSSNIIPGHGGVLDRIDSLTAAFPVFALLYYVF

SEQ ID NO: 10055 - DNA, 816 bp, Pseudomonas syringae
  CDS (1)..(816)
atgctgaaacaacggatcatcacggcactcattctgttgccgattgccctgtgtggctttttcctgctgaccggcatgtactttgctctttttatcggcgtagtggtcgtactgggtgcctgggaatgggcgcggttggcgggctttgctgcccagtcgatgcgtgtggggtacgcggccctggtcgctgtgctgctgtttttcatgtacctgctgccgggtcttgaaccctgggtactggtcgcggcggtcatctggtggagcgttgcgaccttccttgttctgacttatcccgattccagcagtcactgggccagtgctgcctgcaagctggtgatcggtctgctgatcctgctgcccgcgtggcaggggctggtgctcatcaagcaatggccgctgggcaactggctgatcctgtcggtgatggtgctggtgtgggcggctgacatcggcgcgtatttctccggcaaggctttcggcaggcgcaagctggctcccaaggtcagtcccggtaaaagctgggagggcgtatacggcggtctggtggtcagtctgggtatcaccgcggcagtcggtgtttggcgtgactggactgtcgttcagttcatcgccgcactgttgggtgccgctgtgatcgtgttcatttccgtgatcggtgacctcaccgaaagcatgttcaagcgccagtccggggtcaaggacagcagtaatctgctgcctgggcacggcggcgttctggaccgcatcgacagcctgacggccgccattccggtatttgccgtgctgttgtgggccgctgactggggtgtcatgtga

SEQ ID NO: 10056 - protein, 271 aa, Pseudomonas syringae
MLKQRIITALILLPIALCGFFLLTGMYFALFIGVVVVLGAWEWARLAGFAAQSMRVGYAALVAVLLFFMYLLPGLEPWVLVAAVIWWSVATFLVLTYPDSSSHWASAACKLVIGLLILLPAWQGLVLIKQWPLGNWLILSVMVLVWAADIGAYFSGKAFGRRKLAPKVSPGKSWEGVYGGLVVSLGITAAVGVWRDWTVVQFIAALLGAAVIVFISVIGDLTESMFKRQSGVKDSSNLLPGHGGVLDRIDSLTAAIPVFAVLLWAADWGVM

SEQ ID NO: 10057 - DNA, 816 bp, Pseudomonas putida
  CDS (1)..(816)
atgcttaaacaacgcatcattactgcgctgatcctgctgccggtcgcgctgggtggtttcttcctgctcaatggcggggatttcgccctgttcatcggcttcgtagtgaccctcggtgcctgggagtgggcgcgccttgccgggctgatggcccagccgctgcgcattgcctatgcagcggtggtcgcgggggcgctgatgctgctgcacatccttccggaactggcgccctgggtgctgggcgctgccgtgatctggtgggggctggccacctggctggtgcttacctacccgcgcagcagcgacctgtgggccagtgcggcctgtcggttgttgatcggcctgctggtgttgctgccggcctggcaagggctggtgctgctcaagcactggcccttgggcaactggctgatcctgtcggtcatggtgctggtgtgggccgccgacatcggtgcgtacttctctggccgggcattcggcaagcgcaagctggctccgcaggtcagcccaggcaagagctgggaaggcgtgtacggtggtctggcggtcagcctgttgattaccctgggtgtcggcatcagccgcgactggggctttggtcagatcctgctgggcctgttgggcgctgcgttgctggtgatgtcctcggtggtcggtgacctgaccgagagcatgttcaagcgtcgctccggcatcaaggacagcagcaatctgctgcccgggcatgggggtgtgctcgatcgcattgacagcctgactgccgcaatcccgatcttcgccgtgctgttgtgggctgccgaatggggtgtgatgtga

SEQ ID NO: 10058 - protein, 271 aa, Pseudomonas putida
MLKQRIITALILLPVALGGFFLLNGGDFALFIGFVVTLGAWEWARLAGLMAQPLRIAYAAVVAGALMLLHILPELAPWVLGAAVIWWGLATWLVLTYPRSSDLWASAACRLLIGLLVLLPAWQGLVLLKHWPLGNWLILSVMVLVWAADIGAYFSGRAFGKRKLAPQVSPGKSWEGVYGGLAVSLLITLGVGISRDWGFGQILLGLLGAALLVMSSVVGDLTESMFKRRSGIKDSSNLLPGHGGVLDRIDSLTAAIPIFAVLLWAAEWGVM

SEQ ID NO: 10059 - DNA, 786 bp, Lactobacillus plantarum
  CDS (1)..(786)
atgagacaacgagtcattacggctgtcgttgcgttaattttatttatcccagtcatttttgtgggcggggtaaccttagatattgtggccatgctgttaggggccgttgcgatgagcgagttactcgtgatgcgtaaaaaattattgatttcatttgaagcaatcgtaagcatgcttgcagttatgattcaaattgcaccgaataactggttcaatggcttaccagaccaattaaacaaggagtacgtggtttacttcttagttatcttgctactgttacacactgtgtggtcgcggaatcgcttttcatttgatgatgccggaatgttgacgttaggcgtcctgtacatcgggatgggcttcaactacttcacggctgcgcggggtgtcagtgtttacatgttactcttcctgatgttcattgtctggctgacagatagtggggcttacatggtcggacgcaaactgggtcggcataaagtcacaccgatcagccccaataaaacatgggaaggttgtattgggggtagcgtgattggtgtgatcgttgccagtgcctttgcaattgggtttcacgtcggctatgctagcgtcatcagtatggtactgattactttagtcttatcagtagttggccagtttggcgatttagtagaatccgcgttgaagcgttactatggtgttaaggattctggtaagatcttgccgggacatggcggtatcctagatcgatttgatagtatgttattagtttttccaattgcacatttattcggcctcttttaa

SEQ ID NO: 10060 - protein, 261 aa, Lactobacillus plantarum
MRQRVITAVVALILFIPVIFVGGVTLDIVAMLLGAVAMSELLVMRKKLLISFEAIVSMLAVMIQIAPNNWFNGLPDQLNKEYVVYFLVILLLLHTVWSRNRFSFDDAGMLTLGVLYIGMGFNYFTAARGVSVYMLLFLMFIVWLTDSGAYMVGRKLGRHKVTPISPNKTWEGCIGGSVIGVIVASAFAIGFHVGYASVISMVLITLVLSVVGQFGDLVESALKRYYGVKDSGKILPGHGGILDRFDSMLLVFPIAHLFGLF

SEQ ID NO: 10061 - DNA, 798 bp, Clostridium tetani
  CDS (1)..(798)
atgaataaaagatatttaggagcactaatactatctcccctcattatatttttatttataggaggaaagtacttaaaagcactaatatttttaatatctcttagaggaatgtatgagttttataaggcaattgaaaaaaagatagaacctgtatctattttaggatatgtgctgtgtatagtatattacttatttatactaaatactgaaattaatggggaattatttttttatatatcaatattagcagtatttattttaatgttaatgccaatatttaatgaaaaatataattttataagtggaggagtgactttactgggatttatatatgttgccatattctttagttttataattctcgtgaatagtaaaatgtatggtaactatcttatatggttaatatttttatcttcttggatttgcgatacttccgcatattattctggtaaatactttggcaagaaaaaattatgtcctaaaataagtcctaaaaaaactatagagggctccattggaggactcttaggaagtgttataggttgcaccatatttggggtattttccataaatagaggtgtagatatttcactaatacattttatactaataggagctataagcggtatattatcacaactaggggacttagtagcatcttccataaaaagatatgtagatgtaaaagattatagccaactaataccaggacatggtggtatattagataggtttgatagtatattattttcttctgtaacggtatattattacttaacatttataattaatatatag

SEQ ID NO: 10062 - protein, 265 aa, Clostridium tetani
MNKRYLGALILSPLIIFLFIGGKYLKALIFLISLRGMYEFYKAIEKKIEPVSILGYVLCIVYYLFILNTEINGELFFYISILAVFILMLMPIFNEKYNFISGGVTLLGFIYVAIFFSFIILVNSKMYGNYLIWLIFLSSWICDTSAYYSGKYFGKKKLCPKISPKKTIEGSIGGLLGSVIGCTIFGVFSINRGVDISLIHFILIGAISGILSQLGDLVASSIKRYVDVKDYSQLIPGHGGILDRFDSILFSSVTVYYYLTFIINI

SEQ ID NO: 10063 - DNA, 843 bp, Bradyrhizobium japonicum
  CDS (1)..(843)
atgagcgaacccgagaccgtaccggctggctcgaagcctgccccaagcaatctcgtgatgcgggtcctcgcagcgctggtgctggcgccgcttgccattgcgctcgcttatgccggcggctggctgtgggcgctcctcgtcacgctggtgtcgatcgggctgttcgcggaatggctgatggtggtgggcgcggggtccgttgcgctgaccgcgtgcggaacgatcgtcctcgccatcatgggcttctgcgtcgccttcggcgcgctcaagaccgcaatcgtcaccggcctcgttggcggggccatcgtgacgctgatcgcgcgaggcaagttcgtctgggcggccgccggattcgcctatgcatcggcggcgctgctggcctcgatcctggtacggcaggatctcgtgaacggctttgccgcgctgatgttcgtgctgctcgtggtgtgggtgaccgacattggcggctatttcgccggccgcggcattggcggaccgaagctgtggccgcgcgtgagcccgaagaagacctgggccggcgcgctcggcggctttgccgccagccttgcggtcgctgccggctttgcggcttgcgggctcgggaaggcggttccactgctgctcgtcagcgccgtcctgtcggtggtctcgcagctcggcgatctcttcgaatccgcggtgaagcggcgcttcggtgtcaaggattccagtcacttaattcccggccatggcggtctactggaccgtctggacggttttgtcgccgccatcctggcggcatggattatcggctttctccgccatggtgtgcatagcgccggaagcggtcttgtggtttggtga

SEQ ID NO: 10064 - protein, 280 aa, Bradyrhizobium japonicum
MSEPETVPAGSKPAPSNLVMRVLAALVLAPLAIALAYAGGWLWALLVTLVSIGLFAEWLMVVGAGSVALTACGTIVLAIMGFCVAFGALKTAIVTGLVGGAIVTLIARGKFVWAAAGFAYASAALLASILVRQDLVNGFAALMFVLLVVWVTDIGGYFAGRGIGGPKLWPRVSPKKTWAGALGGFAASLAVAAGFAACGLGKAVPLLLVSAVLSVVSQLGDLFESAVKRRFGVKDSSHLIPGHGGLLDRLDGFVAAILAAWIIGFLRHGVHSAGSGLVVW

SEQ ID NO: 10065 - DNA, 957 bp, Bacteroides thetaiotaomicron
  CDS (1)..(957)
atgaaacaactattggacaaattattccctacgctaagcgatgagttaattattgtaatcacccttattatctgtttgctggtgacggcaagcatcgccctctttctggtaaaaaagctgtcgccgaaaaccaatatcagcgaactggttgcccgtacccgctcatggtggattatggcagcaatgtttatcggtgccgttttcatcagctacgacatttcttatttttttcttgcatttctctcttttatagcattcagagaactttattcggtattaggattcagagaggcagaccgccgtgcactgttctggggcatattggctattcctatccaatactatcttgcttatatcgcgtggtatggggcatacatcatattcatccccgtagttatgttcctgttattgccattacgactggtattgaaaggcgatacacacggaatcactaaatccatcgctttgctgcaatggattctgatgctttctgtatttggtatcagccacctcgcttatcttctctcgttacccgaattgccgggcttcaatgcgggaggacgcggactgctgatgttcctcgtgttccttacagaaatcaacgatatcatgcagttcgtctggggaaaactcttcggacgtcacaaaattctgcccaaagtgagtcccaacaaaacatgggaaggctttttgggaggtgtcgtcagcactacggttataggatactttctgggattcctcactccgctctccacgcccaacgtaattctggtcagcgccctcattgccattgccggatttgcgggagatgtagtcatctcggccatcaaacgtgataaaggcatcaaagacatgggagatagcatccccggtcatggtggagtattcgaccgcatagactctctgtcctatacagctccggtgttcttccacctcgtttattatatagcttattag

SEQ ID NO: 10066 - protein, 318 aa, Bacteroides thetaiotaomicron
MKQLLDKLFPTLSDELIIVITLIICLLVTASIALFLVKKLSPKTNISELVARTRSWWIMAAMFIGAVFISYDISYFFLAFLSFIAFRELYSVLGFREADRRALFWGILAIPIQYYLAYIAWYGAYIIFIPVVMFLLLPLRLVLKGDTHGITKSIALLQWILMLSVFGISHLAYLLSLPELPGFNAGGRGLLMFLVFLTEINDIMQFVWGKLFGRHKILPKVSPNKTWEGFLGGVVSTTVIGYFLGFLTPLSTPNVILVSALIAIAGFAGDVVISAIKRDKGIKDMGDSIPGHGGVFDRIDSLSYTAPVFFHLVYYIAY

SEQ ID NO: 10067 - DNA, 843 bp, Bacteroides thetaiotaomicron
  CDS (1)..(843)
atgattagtaattttataaaacgggccattacgggtatactctttgtcgccattctggtgggatgtatactctataattctttcagcttcggcattctgttcatggcgatcagtgcactgacgatctatgaattcggacagttaatcaacagccgtgcagaaggagtcaacgtaaacaaaaccattatcatgctgggaggagcttacctgttcctcgcagtgatgggattctgtatcgacgcagccgactccaagattttcattccttatttgctgttgctgctctatttgatgatcagcgaattgtatctgaaaaaggcaagttcaatgcttaactgggcatattccatgctcagccagctttatataggcctgccgtttgccttgcttaatgtcttggcgtttcatactgatccggaatatagcagcgtaagctacaatccgattctgccattgtccatctttatattcctttggctgagtgatacaggtgcatattgcgtcggttcattaattggcaaacaccgcttgtttgaacgtatctctcctaaaaaatcatgggaaggttccatcggcggcggagtagtagctatcggagcttcttttgtcttggcacattacttcacgattatgtcgatgtgggaatgggcaggtctcgctttagtcgttgtcgttttcggaacatggggcgacctgacagaatcattactgaaacgccagctgcacgttaaagattcagggaccattcttccgggacacggagggatgctcgaccgtttcgacagtgctttgatggctataccggcagcagtcttttatctgtatgcactaacttggttttaa

SEQ ID NO: 10068 - protein, 280 aa, Bacteroides thetaiotaomicron
MISNFIKRAITGILFVAILVGCILYNSFSFGILFMAISALTIYEFGQLINSRAEGVNVNKTIIMLGGAYLFLAVMGFCIDAADSKIFIPYLLLLLYLMISELYLKKASSMLNWAYSMLSQLYIGLPFALLNVLAFHTDPEYSSVSYNPILPLSIFIFLWLSDTGAYCVGSLIGKHRLFERISPKKSWEGSIGGGVVAIGASFVLAHYFTIMSMWEWAGLALVVVVFGTWGDLTESLLKRQLHVKDSGTILPGHGGMLDRFDSALMAIPAAVFYLYALTWF

SEQ ID NO: 10069 - DNA, 1386 bp, Mus musculus
  CDS (1)..(1386)
atgctggagctgcggcaccgcgggggctgccccggccctgggggagcgggggcgccgccaccccgcgagggagaggcggccggcggtgaccacgaaaccgagagcaccagcgacaaagaaacagatattgatgacaggtatggagatctcgatgccagaggcgattccgacgtgcctgaggtcccaccgtcctcagacaggacccccgagattctcaagaaagccctgtccggactatcttcaagatggaagaactggtggattcgcgggatcctcaccctcaccatgatctccctcttcttcctgattatctatatggggtccttcatgctgatgcttctggttctgggcatccaagtgaagtgcttccatgagatcatcaccatcgggtaccgggtctaccactcctacgacctcccatggtttaggacactaagttggtacttcctcctgtgtgtgaactacttcttctatggagagacggtggcagattacttcgccacgtttgttcagagggaggagcagctgcagttcctcattcgctaccacaggttcatatccttcgccctctacctggcaggtttctgcatgtttgtcctgagcctggtgaagaagcactacagactgcagttctatatgttcgcatggacgcacgtcactttactgataaccgtcactcagtcacatcttgtcatccaaaatctgtttgaaggcatgatatggttccttgttcccatatcaagcgtcatctgcaatgacatcacagcttatctttttggatttttttttggaagaactcctctaattaagctgtctcctaagaagacttgggaaggattcattggtggtttcttctccacagtcatatttggattcattgctgcctatgtgttgtccaagtaccagtactttgtgtgcccggtggaataccgaagcgacgtcaactccttcgtgacagagtgtgagccctcagaactgttccagcttcagaattactccctccctccattcctacaggcagtgctgagccgggagactgtgagcttgtaccccttccagatacacagcattgccctttcaacgttcgcgtcactgattggcccatttggaggcttctttgccagtggattcaaaagagctttcaaaatcaaggattttgcaaacacgattcctggacatggcgggataatggacaggtttgactgtcagtatttgatggcaacgttcgtgcacgtgtacatcaccagcttcatcaggggtccgaatcccagcaaagtgctccagcagctgttagtgcttcaaccagaacagcagttaaatatctacagaaccctgaagattcatctcaccgagaaagggatcctgcagcccaccttgaaggtgtag

SEQ ID NO: 10070 - protein, 461 aa, Mus musculus
MLELRHRGGCPGPGGAGAPPPREGEAAGGDHETESTSDKETDIDDRYGDLDARGDSDVPEVPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVIFGFIAAYVLSKYQYFVCPVEYRSDVNSFVTECEPSELFQLQNYSLPPFLQAVLSRETVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYRTLKIHLTEKGILQPTLKV

SEQ ID NO: 10071 - DNA, 795 bp, Streptococcus mutans
  CDS (1)..(795)
atgcagaaacgtgttctttttgggggagtggctctggctatttttctccctttcctatttttgggaggtctcttttttcagctttttgttggtgttctagccatgattggcgtatctgaactgttgaaaatgaaggcgttagaaattttttcatttgaaggtattttagctatgcttgcggcttttgtgctgactattcctttagagaactacctgacttttttaccgattgatggcagctttagtgcttttggtctcgttatctttttgattttagcaggaacggtcttaaatactaatcgctattctttcgaagatgctgcttttcctattgcttccagtctttatgttgggattggttttcaaaatctcgttaatgctcgcatttctggacttgataaagtttttctagccctttttatcgtttgggcgactgatattggagcttatatgattggtcggcagtttggtcaacgtaaattgatgccggcagtttctcctaacaagactattgaaggcagcttaggaggaattttgtcggcagttgtcattgcttttatctttatgttgtttgataagaatgtttacgcaccgcatcacttcttagtcatgcttattttggttgctctctttagtatctttgcccaatttggtgatctagttgaaagttcaattaaacgacattttggtgttaaggattctggcaaactcataccggggcacggaggtattttagaccgttttgacagtatgatttttgtttttccaatcatgcacttctttggtttgttctaa

SEQ ID NO: 10072 - protein, 264 aa, Streptococcus mutans
MQKRVLFGGVALAIFLPFLFLGGLFFQLFVGVLAMIGVSELLKMKALEIFSFEGILAMLAAFVLTIPLENYLTFLPIDGSFSAFGLVIFLILAGTVLNTNRYSFEDAAFPIASSLYVGIGFQNLVNARISGLDKVFLALFIVWATDIGAYMIGRQFGQRKLMPAVSPNKTIEGSLGGILSAVVIAFIFMLFDKNVYAPHHFLVMLILVALFSIFAQFGDLVESSIKRHFGVKDSGKLIPGHGGILDRFDSMIFVFPIMHFFGLF

SEQ ID NO: 10073 - DNA, 870 bp, Wigglesworthia glossinidia brevipalpis
  CDS (1)..(870)
atgcttctgaaaattcgattaattagcacattgtttttatttatatgcattatatctattttattttattttaataataatgtttttttatattttatagttgcaatatttgctacatctatttgggaatggagcaatatatgtaaaataaaacacaatatatataaaattttatatttattttcttctatttcatttttctatttaataataaaatgtttggaaagatattccctaacaagtttatttgaaataaatatatatttaaaatattattttgaaatatcctttatatgttggatgcaatttataattatgacttttttttatcctaaattttcttatttttgggataagagtgtatttattagaacaatgtcttcatattttatattttttccattttttataacaataatattattatatcagtacaatttatattcatgtaattttggatcttggataatattttacttaataacatgcatttgttttgcagatataggagcatatgtttttggaaagattcttggaaaacataaattattcttaatggtatccccaaataaaactttagaaggagttataggaggaatatttttatcctttatttcaatttatttattttataaatataaatttttttatgtaaataaatttattttttttatttcttcttttatttctgttttttttggaatattaggagatttagtaatgagcatgtttaaaagaaaagcgaatattaaagatagtgggaaaataattcctggtcacggtggtattttagatcgtattgatagcttatctttttctattccaatttttttttatttgatcttttttatttttggtaattggagctga

SEQ ID NO: 10074 - protein, 289 aa, Wigglesworthia glossinidia brevipalpis
MLLKIRLISTLFLFICIISILFYFNNNVFLYFIVAIFATSIWEWSNICKIKHNIYKILYLFSSISFFYLIIKCLERYSLTSLFEINIYLKYYFEISFICWMQFIIMTFFYPKFSYFWDKSVFIRTMSSYFIFFPFFITIILLYQYNLYSCNFGSWIIFYLITCICFADIGAYVFGKILGKHKLFLMVSPNKTLEGVIGGIFLSFISIYLFYKYKFFYVNKFIFFISSFISVFFGILGDLVMSMFKRKANIKDSGKIIPGHGGILDRIDSLSFSIPIFFYLIFFIFGNWS

SEQ ID NO: 10075 - DNA, 849 bp, Vibrio vulnificus
  CDS (1)..(849)
atgagtttgaaacaaagaataattactgcactaattcttgcacctttggtaatcctggggatttttgaattatctctaccactttttatcgcagcgcttacagccgtgacttttttgggcttttgggagtggactcaatttgttgaggcaaagtctcgtatcaaagccatgctgccagcggttgttgtgacgatcggcagttttttctggattgaagccgattctgccagtctgaaccaaattggcttgccgcactatctcatgctagcagcaggcagtatctggtggctctatgccagtgctttggccatcacttatcctaaatccacacagagttggcaaggtcacaaacctctacgtcacctttttggcttgcttacccttattcctttcatgtggagcgtgattttattacgcgccgttgatattgaaagcgccccttattttggtgcaaaactggtgatgtttgtgtgtctcttggtttgggcagcagacagcggtgcctatttcgctggtaaaactttgggtaagcgtaaaatggcacctaaagtgagtccaaataaaaccatcgaaggccttattggcggcgttattaccgctattattgttggttggttcttctctggttggtttgacattccattctctagcccactacacatggttttgattacgcttgccaccgtggttatttcggtgcttggggaccttgtcgaaagtatgtttaagcgagagtcgggcatcaaagacagcagtaatatcattccaggtcatggcggtatccttgaccgaatcgatagccttactgccgcatttccgatttttgctcttctttatttcttgttctga

SEQ ID NO: 10076 - protein, 282 aa, Vibrio vulnificus
MSLKQRIITALILAPLVILGIFELSLPLFIAALTAVTFLGFWEWTQFVEAKSRIKAMLPAVVVTIGSFFWIEADSASLNQIGLPHYLMLAAGSIWWLYASALAITYPKSTQSWQGHKPLRHLFGLLTLIPFMWSVILLRAVDIESAPYFGAKLVMFVCLLVWAADSGAYFAGKTLGKRKMAPKVSPNKTIEGLIGGVITAIIVGWFFSGWFDIPFSSPLHMVLITLATVVISVLGDLVESMFKRESGIKDSSNIIPGHGGILDRIDSLTAAFPIFALLYFLF

SEQ ID NO: 10077 - DNA, 876 bp, Synechococcus elongatus
  CDS (1)..(876)
atgctctggatccgcattgctagtggacttgtcgcgatcgccctcgcgctgctaatgaccttcctgggcggttggtatttttgtctggggattggggcgctgatttatctggggcaactggaatattttgaactagcccgcgcgaaagggagtgcaccggctgctaaaacaaccctcgtcgtcagtcaagtgctgctgatcacttccctcctgcggcctgaccttgcggatgctgtctttccggttgcgggtacctttatttgtttttacctgctgtttcaacctaagctggcctcgatcgccgatatttccacctccattatgggcttgttttatggcggctatttgcccagctattgggtgcggctgcggggactagaacagcagtcaactctgcccttggggggcttctggccagaacggctgcaactgagcgactttcccttgggattgcaggtgacgctgttggcctttgcctgtatttgggcggcagatattggtgcctatgcggttgggaagctctttggccgcacccgcctctctcacatcagtcccaagaaaaccgtcgaaggagcggtgtttggcgtcttggcaagtttaggcatcgccctttggggggcctattccctcacctggccgctcccttggtttgcgggagccctgtttggtctgatgattgggattgccagcctcttgggcgatttaaccgagtcaatgatgaaacgggatgccggcgtcaaagattctgggcagttgattccgggccatggcggcattttagaccgcgccgatagctacgtattcacagcacccttggtcttttattttgtaacgctgctcttgcctatcttcgccactcgaaccggtttggattaa

SEQ ID NO: 10078 - protein, 291 aa, Synechococcus elongatus
MLWIRIASGLVAIALALLMTFLGGWYFCLGIGALIYLGQLEYFELARAKGSAPAAKTTLVVSQVLLITSLLRPDLADAVFPVAGTFICFYLLFQPKLASIADISTSIMGLFYGGYLPSYWVRLRGLEQQSTLPLGGFWPERLQLSDFPLGLQVTLLAFACIWAADIGAYAVGKLFGRTRLSHISPKKTVEGAVFGVLASLGIALWGAYSLTWPLPWFAGALFGLMIGIASLLGDLTESMMKRDAGVKDSGQLIPGHGGILDRADSYVFTAPLVFYFVTLLLPIFATRTGLD

SEQ ID NO: 10079 - DNA, 765 bp, Shewanella oneidensis
  CDS (1)..(765)
atgatcgctgtgtttctgatcgccgctaaggagtggggcaggatcatcgatagtcaatgtaatgtcacgcaatggagttttacttgcaccgttggcattttattgatcgcccttaatttaattgttcccgccgacaccatttggcttagggggcaaattcaccccatctattttgcggtggtaactataggtgccctttggtggatggtgtcactgctgcttgtgttgacttatcccaaaagtgctaagctgtggcaaaaaaatccgatgctaaagtccatgtttggacaattgactttagtgccttgttttgtcgcgctcattgcccttaaatccattagttcgcaaatatcgccttattacggtgcatcgttggtattactggtgatgctgattgtgtgggccgcggattctggtgcgtattttgtggggaaagccgtcggcaagactaagttaatgcctgcggtgagcccagctaaaacccttgaaggtttgctcggtggtttagtcacgacgctgattgttgttgctggcgttatggttatttctccagagcaagagttggggttggtcgtggcggtaacgctttttgtggcgttaatttctgcccttggggatttatcagaaagtatgtttaagcgcgccgcgtgcattaaagattcgggcacgattttgcctggacatggcggcgtactcgatcgcatcgacagccttactgcagccttgccggtgtttaccctaatctacattgcattttggatgtaa

SEQ ID NO: 10080 - protein, 254 aa, Shewanella oneidensis
MIAVFLIAAKEWGRIIDSQCNVTQWSFTCTVGILLIALNLIVPADTIWLRGQIHPIYFAVVTIGALWWMVSLLLVLTYPKSAKLWQKNPMLKSMFGQLTLVPCFVALIALKSISSQISPYYGASLVLLVMLIVWAADSGAYFVGKAVGKTKLMPAVSPAKTLEGLLGGLVTTLIVVAGVMVISPEQELGLVVAVTLFVALISALGDLSESMFKRAACIKDSGTILPGHGGVLDRIDSLTAALPVFTLIYIAFWM

SEQ ID NO: 10081 - DNA, 789 bp, Oceanobacillus iheyensis
  CDS (1)..(789)
atgaaacaaagaacaattacagcattacttgcactattaatctttgtcccattcatccttatcggtggacttccatttatggtattgatctatctgcttgctacaattggtttgttggagcttttacggatgaggcatataggaaactacctattcccttatattttatcggtttgtttagtttggctaatactattaccgacttattatggtgcagtatttaattggttttcaagatatgagctgattgccttattaatcctgatatttttagcttataccgtgttagtgaagaatcgatttacatttgatcatgtcggttttgtgattttagcagcattctatgtaggtcttggattttattatttattggaaactcgaaatggagataatgcattaaataatattttatttgctttcttcattgtttgggcaacagatacaggagcttacctgtttggcagaaaatggggaaaacggaagctctggccaaccattagtcctaaaaaaacaattgaaggggcattaggtggaatactaatagcttgtatcgtagctactgtatttcatttgatttcaccatttgatcacacatggttaattgtaattattgttaccattctggcatcgatttttggccaaattggtgatttggttgagtctgcatttaaacgtaattatgatgtaaaggattcagggaaaatcctacctggtcatggtggcattttagaccggtttgatagtatgttatttgtatttccgttattacattttatacattttttctaa

SEQ ID NO: 10082 - protein, 262 aa, Oceanobacillus iheyensis
MKQRTITALLALLIFVPFILIGGLPFMVLIYLLATIGLLELLRMRHIGNYLFPYILSVCLVWLILLPTYYGAVFNWFSRYELIALLILIFLAYTVLVKNRFTFDHVGFVILAAFYVGLGFYYLLETRNGDNALNNILFAFFIVWATDTGAYLFGRKWGKRKLWPTISPKKTIEGALGGILIACIVATVFHLISPFDHTWLIVIIVTILASIFGQIGDLVESAFKRNYDVKDSGKILPGHGGILDRFDSMLFVFPLLHFIHFF

SEQ ID NO: 10083 - DNA, 1164 bp, Mycoplasma penetrans
  CDS (1)..(1164)
atgaagatgttattaaaaaataaagaaaaatcattggttatttcagatgttgaaaccaaacctttaattaataaattagatagtaataaaaagaaaaatcttaaaaatagaactgttatttctgtatttatctttttatattatttaattattttagcttttgcttttttatctgataaatctgattatcctgaatttgcttgaataccttcattaagtgaaaagattactggtatttttgctatcttattattttttatggttttaattccttttgaactagcagtatttgaatcattaaaattgatttttcataaacatgaaaaaataccaataatcatcataatgatcttatgttcaatagtttatataattccattacttgtttatttaatagctcagtactttacaacttttctaatgcctagtaatcaagaaggagaaactgttagtattcaaaaatcttattacctaatagttttaagttctgtaggttcactaattgtattaatagttgctttaaatatcattttaaaaatatataaaaaagatagttttaaaaatgtaattacaattaatgttttattactagtaattgtttttggtttcattggttttgtatttgttgctttatcaaaaggatgaacagtgctattgttcataatgataagtgtaatgtgtacagatgtaatgtgttacctttgaggaatgttttttggaaaacataaaatggctaaagttattagcccaaataaaacttgagaaggagcaatattaggaacaataactactgttgctttacttcttgtttattgtggtttatgacaattagataccaaaacttatactgtacctattttgaattgatctttcacaagaggaagttatgtattagaaactatcattagttttgctactgttaatgactatagttcatgattaatactttgttttttatcagtgctattagttatcttttcaatattaggtgatttgctatttagttatgtaaaaagaaagtttgatatcaaagactttagtaacttattaaaaagtcatggtggaattttagatagagtagattcattgctaatgacttcactagtttactttttctattcactaattgctacttcaacttttttattttcagaacttatataa

SEQ ID NO: 10084 - protein, 387 aa, Mycoplasma penetrans
MKMLLKNKEKSLVISDVETKPLINKLDSNKKKNLKNRTVISVFIFLYYLIILAFAFLSDKSDYPEFAWIPSLSEKITGIFAILLFFMVLIPFELAVFESLKLIFHKHEKIPIIIIMILCSIVYIIPLLVYLIAQYFTTFLMPSNQEGETVSIQKSYYLIVLSSVGSLIVLIVALNIILKIYKKDSFKNVITINVLLLVIVFGFIGFVFVALSKGWTVLLFIMISVMCTDVMCYLWGMFFGKHKMAKVISPNKTWEGAILGTITTVALLLVYCGLWQLDTKTYTVPILNWSFTRGSYVLETIISFATVNDYSSWLILCFLSVLLVIFSILGDLLFSYVKRKFDIKDFSNLLKSHGGILDRVDSLLMTSLVYFFYSLIATSTFLFSELI

SEQ ID NO: 10085 - DNA, 897 bp, Escherichia coli O6
  CDS (1)..(897)
atgctggaaaaatctctggcaatactcttcgcgttgttaattttagcaacgctgataaaccgttttctggtatggcggttaccggagagaaaaggcgatgaagtaacattacgtattcgtacctggtggggcatcgtcatttgtttttcactggtgatttcaggtccacgctggatgacgttgacgttttttgcgctgataagttttctggcattgaaagaatattgtacgcttatatccgtacattttccgcgttggttatattgggttattcctcttaactatttgcttatcggttttaattgctttgagctgtttctgttatttatacctttggctgggtttctgatattagccacctggcgagtttttgtaggtgacccctctggttttctgcataccgtgagtgccattttttgtggctggataatgaccgttttcaccttgagtcatgccgcctggttattaatgttgccaaccataaatatccagggcggggcgttactggtgttatttcttttggcgttaaccgagtcaaacgatattgcacagtatttatggggaaaatcctgcggcagaagaaaagtggtccccaaagtcagcccgggaaaaacgctggaaggtctggtgggaggagtaatcaccaccatgattgcgtcactgattattggaccgttactgacaccgctaaatacattacaggtattattagcgggtttgttaattggtattagtggtttttgcggcgatgtagtgatgtcagccaccaaacgagatgttggtgttaaagatagcggaaaactattaccaggacatggcggactccttgacaggattgactcattaattttcaccgctccggtatttttttattttattcgctactgctgttactga

SEQ ID NO: 10086 - protein, 298 aa, Escherichia coli O6
MLEKSLAILFALLILATLINRFLVWRLPERKGDEVTLRIRTWWGIVICFSLVISGPRWMTLTFFALISFLALKEYCTLISVHFPRWLYWVIPLNYLLIGFNCFELFLLFIPLAGFLILATWRVFVGDPSGFLHTVSAIFCGWIMTVFTLSHAAWLLMLPTINIQGGALLVLFLLALTESNDIAQYLWGKSCGRRKVVPKVSPGKTLEGLVGGVITTMIASLIIGPLLTPLNTLQVLLAGLLIGISGFCGDVVMSATKRDVGVKDSGKLLPGHGGLLDRIDSLIFTAPVFFYFIRYCCY

SEQ ID NO: 10087 - DNA, 894 bp, Corynebacterium efficiens
  CDS (1)..(894)
atgagtgagccggagcaccatcaccggaccgtgcggatgcccaaaccgaaaaatagtgcgggtcgtgatctcaaggcggccgtcggcgtgggtgtcggtctcggactcctggtcatcgtcggcatcctactcagcccctggggctggtacctcgttgtcgccggcgctgttgccgtggcgacctgggaggtttgtggccgcctgaaggaagccggttaccacctgcccatgccgatcatgatcatcggtgggcaggccatggtgtggtgttcctggccgtttgagacctccgggatcctggcctcctatgtggccaccgtcttggtgttgatgttcttccggatcttctacaacggccccgagaaggaggccaggaactacctgcgggatacctcagtgggtatcttcgtgctcacctggatcccactgttcggcagcttcgcggcgatgttgtcgctgatggagaacaacgacgtcccggggaccttcttcatcctcaccttcatgttgtgcgtggtggggtccgatgtgggtggttatgcagctggcgtgttcttcggcgcccaccccatggcgccggcggtcagcccgaagaaatcctgggagggttttgccggttccatcctcctgggatcgctcaccggtgccatcacggtgcatttcctgctgcaccaccactggtggctcggtgtcatcctgggtatctgtctggttgtctgcgccaccctcggtgacctggtggaatcccagttcaaacgggacctcggcatcaaggacatgtccaatctgctgcccggacacggtgggctgatggaccgtctcgacgggatgctgccctcagcgatggtcacctggttgattctcagcgtggtgagcagctcctacgcggggtga

SEQ ID NO: 10088 - protein, 297 aa, Corynebacterium efficiens
MSEPEHHHRTVRMPKPKNSAGRDLKAAVGVGVGLGLLVIVGILLSPWGWYLVVAGAVAVATWEVCGRLKEAGYHLPMPIMIIGGQAMVWCSWPFETSGILASYVATVLVLMFFRIFYNGPEKEARNYLRDTSVGIFVLTWIPLFGSFAAMLSLMENNDVPGTFFILTFMLCVVGSDVGGYAAGVFFGAHPMAPAVSPKKSWEGFAGSILLGSLTGAITVHFLLHHHWWLGVILGICLVVCATLGDLVESQFKRDLGIKDMSNLLPGHGGLMDRLDGMLPSAMVTWLILSVVSSSYAG

SEQ ID NO: 10089 - DNA, 708 bp, Aquifex pyrophilus
  CDS (1)..(708): n means a or g or c or t/u
atgagtagggaatcntacggattggcaataggccttatcgttatactcattacctttttaccccttcccttgtttgcttttttcgtatgtcttctttccttttttgtatcaaaggaagtttcaaaggtttttaaagaagatatctctttattctcaccccttatactgcttgttcatcatcttctaagtccacttacttatcccttaatcggtcttcttgccctttacagggggtataaaacatggtcaattgaatcctttctcaaagttgtttttctcggcttttaccctgctctctttctttcttaccttataggtataagggaaaagggggttttcataactctcgtttttatattcggtatatggataaacgacgttttcgcttactacacgggaaagtatttcggaaaaactcctttatttcctaaaatctcacctaagaaaacccttgagggattattagggggtttaattcccgcatccttattttacggattccttctacctgaagattttttaaaggctttcttcataggaatgattacgctagtcttcggtgtcgcaggggattacttcaaatccttcataaagagacaataccacattaaggacttctcaaatattcttggggaacacggaggattcgctgacaggtttgacgcaatcatcttctcttctcccgtcttttacttcttcataaattaa

SEQ ID NO: 10090 - protein, 235 aa, Aquifex pyrophilus
MSRESYGLAIGLIVILITFLPLPLFAFFVCLLSFFVSKEVSKVFKEDISLFSPLILLVHHLLSPLTYPLIGLLALYRGYKTWSIESFLKVVFLGFYPALFLSYLIGIREKGVFITLVFIFGIWINDVFAYYTGKYFGKTPLFPKISPKKTLEGLLGGLIPASLFYGFLLPEDFLKAFFIGMITLVFGVAGDYFKSFIKRQYHIKDFSNILGEHGGFADRFDAIIFSSPVFYFFIN

SEQ ID NO: 10091 - DNA, 822 bp, Chlorobium tepidum
  CDS (1)..(822)
atgttgatgcaaagcaatctcatgcagagagtggcggttgccattgtgggcattccgctgttactctggctcaatatgcaaggtggtttgtattttctggggctggtgctcgcgctcagcctcatggcgacctgggagttctggcgcctggccacgcatcgggcacatccgccgtcggttgttattctgctgccgctgactgcctttgtgcagctcgatttctattacggcttcatcggctactgggaggcgattctcgccgtggtcatgcttctgtatgtgcttgaaatatggcggaaccagggttcccagttcatgaacctcggtgcgacgcttgtcggtctgctctacgtgaacctaagctttggtgcgttgctcaggctccgcttgtcggagaccaccggcgagggttccggcgaggcgctggtgctgctcatgttgctgtgtgtctgggcggcggatattttcgcctatttcggcggacgcggattcggaggcaagtttatcaaaaagaggctctttgcgcgcatcagcccgaagaagacctgggagggctatcttgctggaattgccggaagcgcgctggcggcgtgggcctgctcggcgtacatctccggctgccccgacgggcgggcgataccggcgggcctgctcatcggcgtggtcgcgcccgcaggcgacctgctcgaatcgatgttcaagcgtgatgcgggagtcaaggactcatcgggtgtcattccggggcacggcggtgtgcttgaccgctttgataccgtgatgttcgtctccccgctgctctatttcctcgtgcatcactggtga

SEQ ID NO: 10092 - protein, 273 aa, Chlorobium tepidum
MLMQSNLMQRVAVAIVGIPLLLWLNMQGGLYFLGLVLALSLMATWEFWRLATHRAHPPSVVILLPLTAFVQLDFYYGFIGYWEAILAVVMLLYVLEIWRNQGSQFMNLGATLVGLLYVNLSFGALLRLRLSETTGEGSGEALVLLMLLCVWAADIFAYFGGRGFGGKFIKKRLFARISPKKTWEGYLAGIAGSALAAWACSAYISGCPDGRAIPAGLLIGVVAPAGDLLESMFKRDAGVKDSSGVIPGHGGVLDRFDTVMFVSPLLYFLVHHW

SEQ ID NO: 10093 - DNA, 828 bp, Xanthomonas campestris
  CDS (1)..(828)
atgacccagacccgtgtgattgccgcgctgatcatggcgccgctcgccatctgcgcgatcgtgctgctgcccacccagtggctggcggcgctggcggcgatcctgttcctgaccgggctatgggagtggctcaagctgtccggcatcgacgacagcctgccgcgcaccgtgctgctgatgctcaacctgctgctgatggtgctgatggtctgggcatcggtcggctcgatggtgctgttccagatcgctgccctggtgggcgtgggctggtggctggtggcgctgctgtggctgcggttcttcaacttcggcgccgaccacggcaatggccaggcacgcgcgctcaagctggcggccggcacgctggcggtcctgccggcctgggccgcgctggtgctgctgcacgccaatcccgacaagggcaacctgtggctgctgaccgcgctgaccatggtctgggcggccgactcgggcgcgtatttcgccgggcggcggttcggcaagcacaagctggcaccgcggatcagccccaacaagaccatcgaaggcctgctgggcgggctggtcgccggtattgcagtggcctgcgccttcggctggctggccgggctgaccctggcgcatgtgccgcagctggtgctggtggccgcggtcgcggtgctggcctcggtgctgggcgatctgttcgaaagcctgctcaagcggcatgccggcgccaaggattcgggcacggtgattcccggccacggcggcgtactggatcggatcgacggcgtgctcgccgcgctgccggtgttcgcgctcggcaaggaaattctcggattctag

SEQ ID NO: 10094 - protein, 275 aa, Xanthomonas campestris
MTQTRVIAALIMAPLAICAIVLLPTQWLAALAAILFLTGLWEWLKLSGIDDSLPRTVLLMLNLLLMVLMVWASVGSMVLFQIAALVGVGWWLVALLWLRFFNFGADHGNGQARALKLAAGTLAVLPAWAALVLLHANPDKGNLWLLTALTMVWAADSGAYFAGRRFGKHKLAPRISPNKTIEGLLGGLVAGIAVACAFGWLAGLTLAHVPQLVLVAAVAVLASVLGDLFESLLKRHAGAKDSGTVIPGHGGVLDRIDGVLAALPVFALGKEILGF

SEQ ID NO: 10095 - DNA, 933 bp, Xanthomonas axonopodis
  CDS (1)..(933)
atgcatcagcagacgctgtggctgttcagcggtatcgcgctggtgctcatcatcgccacgctgatttccgaaaccctgcgttggcgcgcacgcgaacgccccagcgcagtgctggacaacctggtcgcccgcatccgtgcgtggtgggtgatggccgcggtggtcggccttgcgttcgtgtttggccgcgccggcgtcatcggcttgttcgcgttggtgtcgttgtttgcgctgcgcgagttcatcaccttgaccccgacccggcgcggcgattactacgcgttactggccgcgttctacgtcgtgttaccgtggcaatacggcctggtgtggaccggctggtacggcctgtacaccttgctgattccggtctacgcgttcctggtattgccgatcctggccaccatcggcggcgacaccacgcgttatctggaacgcaccgccaaagtgcagtggggcctgatgatctgcgtgttctgcatttcgcatgtgccggcgctgttgaacctggacattcccggctatgcggggcgcaatctgctgttgatcgccttcctggtgatcgtggtgcagtcctcggacgtactgcagtacgtgtggggcaaactggccggccgccatctgatcgcgccgaaattgtcgccgtccaaaacggtggaaggattcatcggcggcgtggtgtcggccagcctgctcgggatggcgctgtggtggatcaccccgttcgcgccgtggcatgccttcggcctggcattggtggccaacctgatgggatttttcggcgggctggtgatgtcggcgatcaagcgcgatcgcggcatcaaggactggggccatatgatcgaaggccacggcggtgtgctcgaccgcctggattcggtgtgcttcgccgcgccggtcttcttccacctgattcgctatggctgggcgtga

SEQ ID NO: 10096 - protein, 310 aa, Xanthomonas axonopodis
MHQQTLWLFSGIALVLIIATLISETLRWRARERPSAVLDNLVARIRAWWVMAAVVGLAFVFGRAGVIGLFALVSLFALREFITLTPTRRGDYYALLAAFYVVLPWQYGLVWTGWYGLYTLLIPVYAFLVLPILATIGGDTTRYLERTAKVQWGLMICVFCISHVPALLNLDIPGYAGRNLLLIAFLVIVVQSSDVLQYVWGKLAGRHLIAPKLSPSKTVEGFIGGVVSASLLGMALWWITPFAPWHAFGLALVANLMGFFGGLVMSAIKRDRGIKDWGHMIEGHGGVLDRLDSVCFAAPVFFHLIRYGWA

SEQ ID NO: 10097 - DNA, 786 bp, Thermoanaerobacter tengcongensis
  CDS (1)..(786)
atgttaaaaactcgaataataagcgctctggtaggactgccccttctatttttagtcttaataaaagggggggctcttttaactttttcactggtagctttaagcattctggggttaaatgagttttacaatgctaccaaaaacataggaattaggccttttaaaatatttggatatttgtctgctatttttttgtatttaatttttgacaagataaaatttgctgaaatagacctctttgtggccctttctatgctgttgtttttgctttttttaactaataaaaaatacactttaaaagactatgcagtgactttgatggggattgtgtacatacctctgctatttttgtacatacagaaaataagatgtctccctcacggcctttatactgtttggcttgtatttattgtgtcatggattacagatacttttgcctatttcacaggaaagtttttgggaaatcataaattagctcctgatctaagcccaaaaaagacagttgaaggggcaataggggggcttttaggttctactttagcaagctttttatttgtatggatttttcctcagacaaatatgactccttatgaagcccttattgtgggaagttttggcagtctaattgcccaggcaggggatttagtagcttcctttataaagagaaattgctacataaaagattttggcaatgtgattcccggccatggggggattttagatagatttgatagcatattattcgcttcgcccttcgtatattttattttcaagtactttttgtaa

SEQ ID NO: 10098 - protein, 261 aa, Thermoanaerobacter tengcongensis
MLKTRIISALVGLPLLFLVLIKGGALLTFSLVALSILGLNEFYNATKNIGIRPFKIFGYLSAIFLYLIFDKIKFAEIDLFVALSMLLFLLFLTNKKYTLKDYAVTLMGIVYIPLLFLYIQKIRCLPHGLYTVWLVFIVSWITDTFAYFTGKFLGNHKLAPDLSPKKTVEGAIGGLLGSTLASFLFVWIFPQTNMTPYEALIVGSFGSLIAQAGDLVASFIKRNCYIKDFGNVIPGHGGILDRFDSILFASPFVYFIFKYFL

SEQ ID NO: 10099 - DNA, 885 bp, Fusobacterium nucleatum
  CDS (1)..(885)
atgtttaaatggaatagggttttagttgcgttgataggagttccattattattatttatttatacaggtgagagttttttcaaaataaatctttatggattaccaatgttaatttttacaaatttagttattggtacaggaacttatgaattttataagatgataaaaatattagggaaagaagtttatgataaatttgggataattgttgccataataataccaaatttagtatatcttgagaatagaaggaattattttgaatataacctaatagctgttgtattgataatagcaactatctttatgttaacatataggatttttaaaaatcagataaggggaactttagagaaggtatcttatactttactaggaatagtatatgtatctgtgtttttttcacaaataatcattctttattttttaggagctatgtatccattaattttacaagttttagtttggatatcagatacatcagcaggaatagtaggagttgcaataggaagaaaattctttaaaaatggttttacagaaataagccctaaaaaatctgttgaaggtgcactgggttcagttgtttttacaggcttaacttttatgttaattgttgttatgtatattgaaaaaattaaaggtgcaacaataggagaaatatttttatcatttattataggagctgtaatatctgttgttgctcaaattggagatttaatagaatctttatttaaaagagaatgtggagttaaagattctggaactatccttatgggacatggtggaatattagatagatttgacagtatgatattagttttaccttttgtaactatggtactatatttctttcgtctatatgtaagttatcaatatggaatttaa

SEQ ID NO: 10100 - protein, 294 aa, Fusobacterium nucleatum
MFKWNRVLVALIGVPLLLFIYTGESFFKINLYGLPMLIFTNLVIGTGTYEFYKMIKILGKEVYDKFGIIVAIIIPNLVYLENRRNYFEYNLIAVVLIIATIFMLTYRIFKNQIRGTLEKVSYTLLGIVYVSVFFSQIIILYFLGAMYPLILQVLVWISDTSAGIVGVAIGRKFFKNGFTEISPKKSVEGALGSVVFTGLTFMLIVVMYIEKIKGATIGEIFLSFIIGAVISVVAQIGDLIESLFKRECGVKDSGTILMGHGGILDRFDSMILVLPFVTMVLYFFRLYVSYQYGI

SEQ ID NO: 10101 - DNA, 795 bp, Clostridium perfringens
  CDS (1)..(795)
atgaaatctaatagcagatatctaggcgcacttataatggctccatttattgcgtttatattcctaggtggaatttggcttaagctatttactattgctctttcttttgcaggattatatgaatattataaaactgttaaaatagcaaaattaaagcctatttctatagggggatatatattattaatattatattacttaacttcaaataattttgaaatgttatcatttttaataataatagctacatttatattactttgtgttcctatacttaatattgaatatacatttatagatgttgcagttactattttaggatttatatatgtaggagttttctttagcttcatacatttagtaaacatcaaagaaggtggacaatacctagtttggttaatattcctatcatcatggctttgtgatactgctgcatactattcaggtagattctttggtaaacacaaattatgtccaaaggttagtcctaagaagactatagaaggttctataggaggaatattaggaagtacattagcttgtggaatatttggtataataatatctaatagtttctctttaatacctgtatatcattattttataataggtatattatgtggagtattctgtcaatttggtgatttagttgcttcatcaataaagagatacgcaggaataaaagattatagtaatttaataccaggacatggtggaatattagatagatttgacagtatattatttgctggaacaatagtattcttctatttaacacttgtcttaaaattttaa

SEQ ID NO: 10102 - protein, 264 aa, Clostridium perfringens
MKSNSRYLGALIMAPFIAFIFLGGIWLKLFTIALSFAGLYEYYKTVKIAKLKPISIGGYILLILYYLTSNNFEMLSFLIIIATFILLCVPILNIEYTFIDVAVTILGFIYVGVFFSFIHLVNIKEGGQYLVWLIFLSSWLCDTAAYYSGRFFGKHKLCPKVSPKKTIEGSIGGILGSTLACGIFGIIISNSFSLIPVYHYFIIGILCGVFCQFGDLVASSIKRYAGIKDYSNLIPGHGGILDRFDSILFAGTIVFFYLTLVLKF

SEQ ID NO: 10103 - DNA, 816 bp, Ralstonia solanacearum
  CDS (1)..(816)
atgctgctgactcgcgtgatcaccgctgtctgcctgctgattgtcatcctgccgatcctgttgttcgctccgcccgccggcctgaccgggctggtgacggtgtttgccgtgctggcggcctgggaatgggggcgactggtccgtctgccgggctggtgggggccggtgctgtacgcggccgtggcggtcgtgctgacgatcgcctggcacgacatcccggtgcatggtgacacgcgagcgctgttctacgcagacatggttgcttgggcggcggcctggatgctgctggcgggcggcgtgcgcgagctgacgggcatgcgccgggcgctgttcgcgctgctgggctgggtgatcctgcccgcgttcgtgcaagcgacaatccaattgcgcgctgaggggatcgccttcctgctgtcggtggcggtgctggtgtgggcggcggacgtgggggcgtatttcgtcggcaaggcgatcggccgtcgcaagctcgcgccgagcatcagccccggcaaatcatgggaaggcgccatcggcggcgcggtgctggtgggcctcattgcggtgactgccggggccacgcactggttcgcgccgacctggttctcgcgccagttcgaccagcatggcgccgtgatcgcactggcgctgaccgtcgtgctggtggccgccagcgtcggcggagacctgttcgagtcgctgctcaagcgccaggtcggcatgaaggacagcagccgcctgctgcccggccatggcggggtgctcgaccgcatcgacgcactgctgccggtgctgccgctggctgtattgttgacctga

SEQ ID NO: 10104 - protein, 271 aa, Ralstonia solanacearum
MLLTRVITAVCLLIVILPILLFAPPAGLTGLVTVFAVLAAWEWGRLVRLPGWWGPVLYAAVAVVLTIAWHDIPVHGDTRALFYADMVAWAAAWMLLAGGVRELTGMRRALFALLGWVILPAFVQATIQLRAEGIAFLLSVAVLVWAADVGAYFVGKAIGRRKLAPSISPGKSWEGAIGGAVLVGLIAVTAGATHWFAPTWFSRQFDQHGAVIALALTVVLVAASVGGDLFESLLKRQVGMKDSSRLLPGHGGVLDRIDALLPVLPLAVLLT

SEQ ID NO: 10105 - DNA, 834 bp, Rhizobium meliloti
  CDS (1)..(834)
atgcaggccgaactcaaacttcgtattgcctccgggttggttctggctgcggtggttcttgctgcaacctggatcggcggcttcgccttccagcttctctccgtcgcgatcggcctgctcgtctattacgagtggtccaccatcaccaagctccccgagcgggactttcagggcaatgctctcggctggctggcgcaggtggtgatcgccggcctcgtcctcctcgactatatgcatatcagcctgccgggacttgccctctgtgtgctcgcggcagcgctttgggtactgataaagggaaccagctggtggctgccgggcgggatcgtctatgcgggcctgacgagcatttcgctcgcggcgatccgcggagcggactatctcgggctgatggcgatgcttttcgtgttcgccgtcgtatgggcaacggatattttcgcctacttcacggggcgggcgatcggcgggccgaagctggcgccggcaatctcgccgggcaagacctggtcgggcgcgatcggcggcgcgattttcggcgttcttgcgggtgtcgccgttttcatggctcacttttcgctcgaggacctgcgcatccccgtcatcgcgctggtcctgtccgtcgcaagccagataggcgatctgttcgagtccttcgtcaagcgccgcttcggcgtcaaggattcgagcagactgatcccgggccacggcggcgtcatggaccgggtggacgggctgatattcgcctgcattgccgcactggctctggtgcttgggcaattcctgctggcgggcggccgggaagtcgccttcggcgcgattctgctgggtctttga

SEQ ID NO: 10106 - protein, 277 aa, Rhizobium meliloti
MQAELKLRIASGLVLAAVVLAATWIGGFAFQLLSVAIGLLVYYEWSTITKLPERDFQGNALGWLAQVVIAGLVLLDYMHISLPGLALCVLAAALWVLIKGTSWWLPGGIVYAGLTSISLAAIRGADYLGLMAMLFVFAVVWATDIFAYFTGRAIGGPKLAPAISPGKTWSGAIGGAIFGVLAGVAVFMAHFSLEDLRIPVIALVLSVASQIGDLFESFVKRRFGVKDSSRLIPGHGGVMDRVDGLIFACIAALALVLGQFLLAGGREVAFGAILLGL

SEQ ID NO: 10107 - DNA, 942 bp, Rhizobium meliloti
  CDS (1)..(942)
atgtccttgaacgacaaactctttatcctctttgccggcatagccgctcttctcggagcggcatcgctgatcggcttcgtgctggcgcgccgcgcgacgtccgaaacggggcgggcgacaatcgacaatctcaatgcccgtatcagggcatggtgggtgatgatcgccatcttcgcggtgagtttcactctcggtcgcggcgtcacgctcgtgctttttgctctcacctccttctacacgctgcgcgagttcgtctcgctgacgccgacgcgtgccgccgatcacctgccgctcgttgcttccttttacgttctgctgccgctgcaatactggctgatctcgatcgactggtatgcgcttttcaccattctgataccggtctacggcttcctcctcctgccgagcctttccgcgctcaagggcgacacggagcagttcctgctgcgcgtctcgcgaatccagtggggccttatgctgaccgtctattgcatcagccacgcaccggccctgctgacgctcgacatccccggccgggcgggcgaaggcttcctgctgctcttcttcctcatcacaatcgcgcagttcagcgatgtcatgcagtatgtcttcggcaagcttttcggccggacgaaggtcgcaccggtcgtcagcccctcgaaaacggtcgagggacttgccggaggcgggctttcggccgtggctgccggcgcggccttgtggtggataacgcccttcacgccgctggaggcggccgcgatggccttcgccatcgtcgccatgggcttcctcggcggcctggcgctctcggcggtgaagcgctcgatgggcgtgaaggactggggctcgatgatcagcggtcatggcggcgtgctcgaccgcatggattcgctgagcttcgcggccccggtttttttccacctgacgcggtatttttatacctga

SEQ ID NO: 10108 - protein, 313 aa, Rhizobium meliloti
MSLNDKLFILFAGIAALLGAASLIGFVLARRATSETGRATIDNLNARIRAWWVMIAIFAVSFTLGRGVTLVLFALTSFYTLREFVSLTPTRAADHLPLVASFYVLLPLQYWLISIDWYALFTILIPVYGFLLLPSLSALKGDTEQFLLRVSRIQWGLMLTVYCISHAPALLTLDIPGRAGEGFLLLFFLITIAQFSDVMQYVFGKLFGRTKVAPVVSPSKTVEGLAGGGLSAVAAGAALWWITPFTPLEAAAMAFAIVAMGFLGGLALSAVKRSMGVKDWGSMISGHGGVLDRMDSLSFAAPVFFHLTRYFYT

SEQ ID NO: 10109 - DNA, 816 bp, Rhizobium loti
  CDS (1)..(816)
atgagcaaccttcagctccgcgtcatttcagcggtcgtgcttgccgtcatcgcccttggcctgacctggcttggcggcctgcctttccggctgctgtgcgcagccatgtcggcgatgatcttttacgagtggacacgcatgtcgcggccagccgcggccaatgggctgagtttcctgccggaggcgctggtcgtcgtgttcatcggcgccttgattgccgggctcgccgcatcctggctgctgctgcttgtcgtggttctgatcgccgtcacggcgattgccgccctggttcgcaaggccgggcaatgggaggtaagcggtcttgcctatgccagtgtgtccggcctgtcgcttgccctgctgcgtgatggcgaccattcgggcctcgtcgccatcctgttcctgttcgccgtcgtctgggcgaccgacatttttgcctatttcgtcgggcgcgccgtcggcggtcccaaactggcgccgtcgatttcgcccggcaaaacgcgcagcggcgcgctcggtggcgctttcggtggcgttgtcgccggggtcatgctggcagcaggcgccggtgccggcaatctggccttgctcggccttgtggcgcttgcgctttcgattgtggcccaggccggtgacctgttcgaatcctgggtcaaacggcggcatggccgcaaggattcgggcgtgctcattccgggccatggcggcgtcatggatcgtgtcgacgggcttgtcgcggcggctcttgccctatacgtcattggctggatttcggcgggcgccgatcatccggcgcaggggctgtttccgatttga

SEQ ID NO: 10110 - protein, 271 aa, Rhizobium loti
MSNLQLRVISAVVLAVIALGLTWLGGLPFRLLCAAMSAMIFYEWTRMSRPAAANGLSFLPEALVVVFIGALIAGLAASWLLLLVVVLIAVTAIAALVRKAGQWEVSGLAYASVSGLSLALLRDGDHSGLVAILFLFAVVWATDIFAYFVGRAVGGPKLAPSISPGKTRSGALGGAFGGVVAGVMLAAGAGAGNLALLGLVALALSIVAQAGDLFESWVKRRHGRKDSGVLIPGHGGVMDRVDGLVAAALALYVIGWISAGADHPAQGLFPI

SEQ ID NO: 10111 - DNA, 795 bp, Streptococcus pyogenes
  CDS (1)..(795)
atgaaagaacgtgttgtttgggggggagtagcagtagctattttcctaccttttctcataataggaaacctaccattccaattatttgtaggcgttttggccatgattggggtatcagaattactgaaaatgaaaagattagaagtcttttcttttgaaggtgtttttgccatgttagccgcctttgtattggcagttccgatggaccattacctcacttttttaccaattgatgcgaatgttgctttttacagcttaatggtttttttcattttggcaggtactgttttaaatagcagagcttattcatttgatgatgcggcctttccgattgcaactagtttttatgttgggattggttttcaacatttgatcaatgctcgcctgtcaggaattgacaaggtctttttggccttatttatcgtttgggccactgatattggagcatatctgattgggcgtcagtttggtagacgcaaactattgcctacagtttctccaaacaaaaccattgaaggtagtttaggagggatcgcttgtgcagtccttgtgtcttttatctttatggtgattgataggtctgtttatgcgccacatcactttttgaccatgttggttttggtcgctcttttttccatttttgcccaatttggtgatttggttgaaagtgctctcaaacgtcactttggtgtcaaagattcaggtaagcttatcccgggacatggtggtattttagaccgctttgattccatgatttttgtttttcccatcatgcatctctttggtttattttaa

SEQ ID NO: 10112 - protein, 264 aa, Streptococcus pyogenes
MKERVVWGGVAVAIFLPFLIIGNLPFQLFVGVLAMIGVSELLKMKRLEVFSFEGVFAMLAAFVLAVPMDHYLTFLPIDANVAFYSLMVFFILAGTVLNSRAYSFDDAAFPIATSFYVGIGFQHLINARLSGIDKVFLALFIVWATDIGAYLIGRQFGRRKLLPTVSPNKTIEGSLGGIACAVLVSFIFMVIDRSVYAPHHFLTMLVLVALFSIFAQFGDLVESALKRHFGVKDSGKLIPGHGGILDRFDSMIFVFPIMHLFGLF

SEQ ID NO: 10113 - DNA, 870 bp, Pasteurella multocida
  CDS (1)..(870)
atgcttaaagaacgtgttttgtcagcgatcatgttaattgcaatagtatttattgcattgtttttcttttcacccttctattttgcacttgcagtaggtgttgtcgttattctcgctgtttgggagtggacgcaatttgcgcatttcaaatggtctttctggcgtttaggtttaacgggtttatccgcagcctttctatttctttggatttatggtgaaagtgactatttaaatgcgggtcgtgtgtttgaaaatacgctctcacttcttttattctcttctgtgctttggtggtttgtcgccttaggcttagtgataagttatcccaaaggggcgacctattggggaaaaaacaaattattgcaatttgcttttgcttttttaaccttagtgcctttctttgctggcgtgttacgtttacgcttagcacattatgtaacagatccctatcacggtttaattttattactctatgttttcattcttgtttggagcgcggattcgggagcatattttgctgggcgccagttcggcaaaaataaacttgcaccaaaagtttctcccggtaaaagttgggaaggcgtgatcggtggcttagtcacagcaggaattctagccagtatttttattcacttcacgcaagaaagtttgctttctggcatctcaatacctgctttcattgccctttctgttgccactgttgctgtatcaatattaggtgatctcaccgaaagtatgtttaaacgtcaaagtggcattaaagacagtagtcagctcattccgggacatggtggtattttagatcggattgatagtttaacggcggccgttccgttctttgcttatttttactttttcgtgatttcatga

SEQ ID NO: 10114 - protein, 289 aa, Pasteurella multocida
MLKERVLSAIMLIAIVFIALFFFSPFYFALAVGVVVILAVWEWTQFAHFKWSFWRLGLTGLSAAFLFLWIYGESDYLNAGRVFENTLSLLLFSSVLWWFVALGLVISYPKGATYWGKNKLLQFAFAFLTLVPFFAGVLRLRLAHYVTDPYHGLILLLYVFILVWSADSGAYFAGRQFGKNKLAPKVSPGKSWEGVIGGLVTAGILASIFIHFTQESLLSGISIPAFIALSVATVAVSILGDLTESMFKRQSGIKDSSQLIPGHGGILDRIDSLTAAVPFFAYFYFFVIS

SEQ ID NO: 10115 - DNA, 1839 bp, Arabidopsis thaliana
  CDS (241)..(1506)
gaaaggggaaaaaaaaaaaaaacagattcctgatattttctgcttcgcttcgctttgctttggcctttgggtttgctttgccttttatctccacaataataatattcgttaacctctcctcgttctcgtcgctgtttcttcccgatctttgctatagttctggattcaaaatctttcttccccaatagatgtttgtctcttaatttttgatttttctgcaaaatcaaatttttaagagctatggaggaagagaatgttactagttcaccttcaacaccggtacataggcttaggcatcgaagacgttctaatgaggttgttacggatggggataaagtgaatgcaagtcctttgttggttaatgatcggaataagtacaaatctttcatggtccggacctactctacgttatggatgattggtggttttgttttggttgtctacatgggtcatctttatatcacagctatggttgttgttattcaaatatttatggctaaagagttgtttaatctgctgaggaaagctcctgaggataaatgtctcccctatattaaacagctcaattggcacttctttttcactgccatgcttttcgtttatggacggatccttagtcaacggttagccaataccatgactgcagatcagttcttctatcggctagtcagcggcttaatcaaataccatatggcaatctgttacttgttgtatattataggtttcatgtggttcattctcacattaaagaagaagatgtacaagtaccagtttggccagtatgcttggacccacatgatcttgatagtcgtgtttactcaatcgtcgttcactgttgccaacatatttgaagggatcttctggtttcttctcccagcatctttaattataatcaacgacatcttcgcctacattttcggtttcttctttggaagaacgcctttaataaagctgtctccaaagaaaacatgggagggattcatcggagcctctgtgacaactatcatctctgcatttgttctggcaaatattttgggtcgtttcccttggttgacatgcccacgacaggatttgtccactggctggctacagtgtgacgctgatccattgttcaaacctgaaccttttgctttacctgcatggattccagaatggtttccttggaaggaaatgacgatcctccctgttcagtggcatgctttatgcctcggtttgttcgcttcaatcatagcaccttttggaggatttttcgctagcggtttcaaaagagcattcaaaattaaggactttggtgatagtattccaggacatggtggaatcacagatagaatggactgccagatggttatggcagtatttgcctacatatatcttcaatcatttattgtctcccaaagcgtttcggttgacaaaatcctagaccagatattgacgaaccttacctttgaggaacaacaagcgctcttcgtgaagttaggacaaatgctgaaggacaagctctcataggctccattgccaaaagtttcttttattcagattctgattctccaagaacaggttcctctggaatatccttttatctttgtccttactagagacaataaatttaaaattggattaagatttgttgtttcctgccattgtaaatcctctcgaaatttgtcgaaaaaaatagaagtttttttttttaagtcttctcattggatacaaaaggtttgaaggaagttgtatctactactatctacttatttagtagctttggtggtttttagctgtattttgtatattggttaaaatgaaacaacatttggtttgtttgtctcatgattcgatttgttc

SEQ ID NO: 10116 - protein, 421 aa, Arabidopsis thaliana
MEEENVTSSPSTPVHRLRHRRRSNEVVTDGDKVNASPLLVNDRNKYKSFMVRTYSTLWMIGGFVLVVYMGHLYITAMVVVIQIFMAKELFNLLRKAPEDKCLPYIKQLNWHFFFTAMLFVYGRILSQRLANTMTADQFFYRLVSGLIKYHMAICYLLYIIGFMWFILTLKKKMYKYQFGQYAWTHMILIVVFTQSSFTVANIFEGIFWFLLPASLIIINDIFAYIFGFFFGRTPLIKLSPKKTWEGFIGASVTTIISAFVLANILGRFPWLTCPRQDLSTGWLQCDADPLFKPEPFALPAWIPEWFPWKEMTILPVQWHALCLGLFASIIAPFGGFFASGFKRAFKIKDFGDSIPGHGGITDRMDCQMVMAVFAYIYLQSFIVSQSVSVDKILDQILTNLTFEEQQALFVKLGQMLKDKLS

SEQ ID NO: 10117 - DNA, 813 bp, Brucella suis
  CDS (1)..(813)
atgtcaaatctgcaaacccgcatcatcaccgctatcgttctgggcaccatcaccttgtggctgacatgggttggcggtgtgggctttacgctcttttccatcgcgattggccttgccatgttttacgagtggacggaactgtccgcgacacggcaaaccgccttttcgcgccttttcggctgggcgtggctgatcgttaccgggattctcctgatccttgaccgcggtgcattgctgacaatcgggtttcttgtcgccggttgcgccattttgcttgtcacacagtggaaaagcggtcgtggctggcctgctgccgggcttttctatgcgggtttttcggcgctttcactttcgctcttgcggggggatgagccgttcggttttaccactatcgtctttctcttcgccgtcgtgtggtctacggatattgcggcctatttcaacgggcgggccttgggcgggcctaagcttgcgccacgtttctcgcccaacaaaacgtggtcaggcgccatcggcggggctgcggctgcggttgcgggcgggcttcttgtcgcctcgcttgtggcggctccgggaggctggggcgtgccggtgctggcgctgctcctgtccatcgtttcccagattggcgatcttgccgaatcgtgggtgaaacgccagttcggtgcaaaggattccggccgtcttcttcccggccatggcggcgtactcgatcgcgttgacgggcttgtcgccgctgccgcacttttgtatctctttggtgcgatttttgccgagccagatgttccgtctgcaatcttctttagtttctga

SEQ ID NO: 10118 - protein, 270 aa, Brucella suis
MSNLQTRIITAIVLGTITLWLTWVGGVGFTLFSIAIGLAMFYEWTELSATRQTAFSRLFGWAWLIVTGILLILDRGALLTIGFLVAGCAILLVTQWKSGRGWPAAGLFYAGFSALSLSLLRGDEPFGFTTIVFLFAVVWSTDIAAYFNGRALGGPKLAPRFSPNKTWSGAIGGAAAAVAGGLLVASLVAAPGGWGVPVLALLLSIVSQIGDLAESWVKRQFGAKDSGRLLPGHGGVLDRVDGLVAAAALLYLFGAIFAEPDVPSAIFFSF

SEQ ID NO: 10119 - DNA, 702 bp, Geobacter sulfurreducens
  CDS (1)..(702)
atggcgcttccggaccgcagggcggaaggagtagctgcttccctggccggggcacttatacccgcgttcctggctgctcaggatcgtatcatcgaaatggttcctttccgcacgtcggcaaccctgttcgcttttgtcctgacgattgtcttcctcgcattcgctctcagggttctgttcagctttcgcgatgtccggtcggccgcagtcgaaacggctctgttcgcgacggggtttctctacgtgccgctgctcctgacccaccttgcatggctgcgcgctcttccggacggggtcggctggatcttcctcgttctcgttatcgtcatgtccggagatacggcagcgtactatgtgggaagtaatctgggccgccgcaagctttatccgtcagttagtcccaacaagagcgttgagggggcgatcggcggattactcggcagccttgccggaacctttgtggcgcgtcttacctttttccccggactgaccgtccttgactgcattgccacggcgctcctgttgggagttctcggtcaggtcggcgacctcttcgagtcgttgctcaagcgcagtttcggcgtcaaggattcgggaacgatcgtgcccggacacggcggcattctcgaccgattggacagtattctgtttgctgtgccggctgcctactactacgctcttttcgtgttcatgaaccgatag

SEQ ID NO: 10120 - protein, 233 aa, Geobacter sulfurreducens
MALPDRRAEGVAASLAGALIPAFLAAQDRIIEMVPFRTSATLFAFVLTIVFLAFALRVLFSFRDVRSAAVETALFATGFLYVPLLLTHLAWLRALPDGVGWIFLVLVIVMSGDTAAYYVGSNLGRRKLYPSVSPNKSVEGAIGGLLGSLAGTFVARLTFFPGLTVLDCIATALLLGVLGQVGDLFESLLKRSFGVKDSGTIVPGHGGILDRLDSILFAVPAAYYYALFVFMNR

SEQ ID NO: 10121 - DNA, 936 bp, Mycobacterium paratuberculosis
  CDS (1)..(936)
atggctacctcagatcccggtgcaggcgacgagccggagcatgccgtcgagaacacgaccgagggtgcggccgggcagcgggccaagaagaaaacctcccgggccggacgtgacctgcgggccgccatcgcggtgggcgccggtatcggcgccgtgctcatcgtcacgctggtgttcgcgccccgcttctgggtgccgatcgtcgcgatggccatcctggtcgccagccatgaggtggtccgccggctgcgcgaggccggatacgtcatcccggtcattccgttgctggccggcggccagctcacggtgtggctgacctggccgttccacgccgccggcgcgttggccggcttcggcgtcaccgtggtggcctgcctgttctggcggttgttcatgcaggacaaccgcaagcgccccgagccgttcgccggttcgccctcggcgaactacctgcgcgacgcgtcggccaccgtcttcctggcctgctgggtgccgttgttcgcctccttcgccgccctgctggtctatcccgccgacggtgccgggcgggtgttctgcctgatgatcaccgtggtggcctccgacgtcggcggctacgccgtgggcgtgctgttcggcaagcatccgatggtcccggcgatcagccccaagaaatcctgggagggcctggccggctcgctggtgctgggtatcaccgcggccaccctggcggcgacttttctggccggcaaggcgccgtgggtgggcgcgctgctgggggtggtgctggtgttcacctgcaccctcggcgacctggtggagtcgcaggtcaagcgtgacctgggcatcaaggacatgggccggctgctgcccggccacggcggcctgatggaccggctggacggtgtgctgccgtcggcggtcgccgcctggacggtgctgacgctcgttccgtaa

SEQ ID NO: 10122 - protein, 311 aa, Mycobacterium paratuberculosis
MATSDPGAGDEPEHAVENTTEGAAGQRAKKKTSRAGRDLRAAIAVGAGIGAVLIVTLVFAPRFWVPIVAMAILVASHEVVRRLREAGYVIPVIPLLAGGQLTVWLTWPFHAAGALAGFGVTVVACLFWRLFMQDNRKRPEPFAGSPSANYLRDASATVFLACWVPLFASFAALLVYPADGAGRVFCLMITVVASDVGGYAVGVLFGKHPMVPAISPKKSWEGLAGSLVLGITAATLAATFLAGKAPWVGALLGVVLVFTCTLGDLVESQVKRDLGIKDMGRLLPGHGGLMDRLDGVLPSAVAAWTVLTLVP

SEQ ID NO: 10123 - DNA, 792 bp, Lactobacillus johnsonii
  CDS (1)..(792)
atgaaacaacgtgtaataacagctattgtagctttaattttatttattccgattgttttaatgggcggcatttggattgatgtcctagtttgtgcgtttgcagcagttggaattagcgaaatttttattatgaagaagcaaattattgtttcttgggattttatcttggccttattagcaaccttgactatggcagtccccgattcattctttaaatttttacctgcgtttttaaataagtatgatattttttatatcttcgtaatgttgatgctcgtaagaacggttttgtctaagaataaggttacatttgatgatgccggagtttatactttggctgccttatacatcggaactggctttcacttcatggccgctattagaaatgcccatcttggattagcaattttaggctatgtatttgcagttgtttggtcaacggatattgcagcgtatatggtgggacgtaagattggaaagcataaattatggccagttattagtcctaataaaacatgggaaggatctattggagcagtaatttgtgcagtaattatcgcagcaatttatgttaccttagttcctactggtaggaataatgctatgatgattgttctagccttcttcttatcaattgttggtcagatgggagatttagttgaatcagcttataaacgcttttatggtgtgaaagattcaggtaaaatcttgcctggtcatggaggaattttagatcgatttgatagcatgcttttcgttttacctgttgttgcatttatgggtattttatag

SEQ ID NO: 10124 - protein, 263 aa, Lactobacillus johnsonii
MKQRVITAIVALILFIPIVLMGGIWIDVLVCAFAAVGISEIFIMKKQIIVSWDFILALLATLTMAVPDSFFKFLPAFLNKYDIFYIFVMLMLVRTVLSKNKVTFDDAGVYTLAALYIGTGFHFMAAIRNAHLGLAILGYVFAVVWSTDIAAYMVGRKIGKHKLWPVISPNKTWEGSIGAVICAVIIAAIYVTLVPTGRNNAMMIVLAFFLSIVGQMGDLVESAYKRFYGVKDSGKILPGHGGILDRFDSMLFVLPVVAFMGIL

SEQ ID NO: 10125 - DNA, 858 bp, Treponema denticola
  CDS (1)..(858)
atgaaaataaaaaaacttattgaaaggcttatcatattttttgtaggagcacctttagttttagcttcaatttattttttgcctcattataatttcttggtttatcatatcgaattgtttattgcagcccttattgcaaattatgagatctataatattttgtcccaaaggtctcctgcctatcctaaaaagatacttgcttgtttcggtacgattttagttctgtcatcatatctgataggcttacatgccgtaccatttcaatatatcttcattgtgttcggctgtgtaacagtcggaatgatgtttatggaagttatattttcattctcgggaaattttaccaacagcattgcccgtctcacaaccggagtgtttatgctgatttatccttgggggttgacggtttttttatctgcaattgcgagccttccaaatgcaggcgcccttatcatcatgtttttccttatgacattcggctgtgattcctttgcatggcttttcggtatgctgctcggaaaaaacaacagaggttttattaaggcaagccccaaaaaaagtattgtaggttttataggcggcttcataggttccatcacagccgccgttgcttcattttatttttttaataaacaatttaacggaaaattaagagagcttataataatagctctttttacggccctctttgccataatcggagatataatagaatctatcttgaagcgttctgcagacgtaaaggattcggggaaggtaattttaggacgcggcggaattcttgacagtattgattccctgcttatagcagctcccgtattctataccctttgtatgttcttattaggcggcttttaa

SEQ ID NO: 10126 - protein, 285 aa, Treponema denticola
MKIKKLIERLIIFFVGAPLVLASIYFLPHYNFLVYHIELFIAALIANYEIYNILSQRSPAYPKKILACFGTILVLSSYLIGLHAVPFQYIFIVFGCVTVGMMFMEVIFSFSGNFTNSIARLTTGVFMLIYPWGLTVFLSAIASLPNAGALIIMFFLMTFGCDSFAWLFGMLLGKNNRGFIKASPKKSIVGFIGGFIGSITAAVASFYFFNKQFNGKLRELIIIALFTALFAIIGDIIESILKRSADVKDSGKVILGRGGILDSIDSLLIAAPVFYTLCMFLLGGF

SEQ ID NO: 10127 - DNA, 627 bp, Wolbachia pipientis wMel
  CDS (1)..(627)
atggtagataataattttataattagaatgttgtcctcaatagtaatattattcatattttcctttgctacatatttcagtgatttatcgttttacctattgattttttcgatagcagttttatcttcttttgaatggtataatctaacccagggaaacaaaattttatacgtttttgcattattattgattgcactaccaagcgcctcattaatatatttatataatctaccacagggaaaatacgcattagtatggttcgtcttaaccatttggggaattgacgttactgcctacctgtttggcaagaattttggtggagctaaaatttgcccaattattagccctggaaaaacttgggcaggacttcttggtgcgattttagctggagtagtgtgcacaatttttggatcaatattttttggtctattttcaattttttattctccaatcattggccttgcaattgctattctagcgcaacttggcgatttcactgagtcgcttgttaaaagagcttacggtgttaaagatagtggaaatatgatacctggccatgggggagtgctcgaccgtatggacagtttcatttttactgcccctcttattgctatttacataagctaa

SEQ ID NO: 10128 - protein, 208 aa, Wolbachia pipientis wMel
MVDNNFIIRMLSSIVILFIFSFATYFSDLSFYLLIFSIAVLSSFEWYNLTQGNKILYVFALLLIALPSASLIYLYNLPQGKYALVWFVLTIWGIDVTAYLFGKNFGGAKICPIISPGKTWAGLLGAILAGVVCTIFGSIFFGLFSIFYSPIIGLAIAILAQLGDFTESLVKRAYGVKDSGNMIPGHGGVLDRMDSFIFTAPLIAIYIS

SEQ ID NO: 10129 - DNA, 792 bp, Bacillus cereus
  CDS (1)..(792)
atgaaacagagaattattactggagtggttgctgccgcgctattcattcccatcgtaatttacggtggcgtgccttttacggttttagtgtatgcacttgcttctataggtttatatgaattaattcgtatgaataagcttacgcttatttcagtaccaacagttttagctgcagtattattatggattattttaattccaagtagtgcatcagaactgtttacttggattggattaggtaaattagaaatcacatttgtgattgttctattacttttatcatatacagtcctttctaagaatacatttacttttgacaatgcttcatttttactaatggcaacaacatatgttgcaatgggattcttatatttgaatgaaacgagaattttaggaattaaatatgtgttttgcgcattatttgttatatgggctactgattcaggcgcatatttcgtaggaaaagcattaggaaaaagaaagttatggccagaaattagtccaaataaaacgattgaaggttcattaggcggcatcgtttgtggaattattgtagcgcttgtttacaacatgtttttcccagtggaatcgaatgtagtaattttaattgtgctgacaattatcatttctatttttggacaaattggtgatttagtacaatctgcatttaaacgtcattatggcgtaaaagattcaggtacaattttacctggacatggtggtatattagatcgaacagatagttggttattcgttttaccaattctctacttcttattacaatacaattaa

SEQ ID NO: 10130 - protein, 263 aa, Bacillus cereus
MKQRIITGVVAAALFIPIVIYGGVPFTVLVYALASIGLYELIRMNKLTLISVPTVLAAVLLWIILIPSSASELFTWIGLGKLEITFVIVLLLLSYTVLSKNTFTFDNASFLLMATTYVAMGFLYLNETRILGIKYVFCALFVIWATDSGAYFVGKALGKRKLWPEISPNKTIEGSLGGIVCGIIVALVYNMFFPVESNVVILIVLTIIISIFGQIGDLVQSAFKRHYGVKDSGTILPGHGGILDRTDSWLFVLPILYFLLQYN

SEQ ID NO: 10131 - DNA, 909 bp, Leptospira interrogans
  CDS (1)..(909)
atgggtgaaacttctaagagactcgcttccgcggctgtgctcatactattttatctttttatgatattctatcctggtttttattatctgcaaacctatttgattcttcttttaggcggggctattggtatcaaagaattttataatctttctgatcgaggtgaggacggaagaccgtttagaggaaccggcgttttctttatgttgttagtcatttcgttttattactttcgatttttgggttctcaaaatcaatttgaagcgcctttgttctttctgcaaaatataaaatattttattcctccttttaatccggttcccgttgcgtttcttttactgtttatcgttacgtttactttgcaaataaccaaacgcccgttagacggtgctatcttttctgtttcatccacttttttaggtgtgttctacgttgcggttccgttgggtcactttttacttttgctcggaatggctcagggaatctattatattgtttttgtttcggtggtcacttttctgacggacgccggcgcttattttggtgggagatggttcggaagacatccggctggtcttgccatttctcctaaaaaaacctgggaaggttacgtgactggaattttcacggcgatcggttccgtttttatcttcaacataatttgggaatattctactggaactctcgcagccgtcagaggattggaagtttttttgatttccgcgattttatcttttgtcagtgtgattggagatcttttagaatccgcaatgaaacgggatgcaaagatcaaagactccggttctttgattccggggcacggtggaattttagatcttgcggatgctcttttgattaccatccccgtcttgtattactatcttcagatcaaggggaatcttggagtctaa

SEQ ID NO: 10132 - protein, 302 aa, Leptospira interrogans
MGETSKRLASAAVLILFYLFMIFYPGFYYLQTYLILLLGGAIGIKEFYNLSDRGEDGRPFRGTGVFFMLLVISFYYFRFLGSQNQFEAPLFFLQNIKYFIPPFNPVPVAFLLLFIVTFTLQITKRPLDGAIFSVSSTFLGVFYVAVPLGHFLLLLGMAQGIYYIVFVSVVTFLTDAGAYFGGRWFGRHPAGLAISPKKTWEGYVTGIFTAIGSVFIFNIIWEYSTGTLAAVRGLEVFLISAILSFVSVIGDLLESAMKRDAKIKDSGSLIPGHGGILDLADALLITIPVLYYYLQIKGNLGV

SEQ ID NO: 10133 - DNA, 657 bp, uncultured marine gamma proteobacterium EBAC20E09
  CDS (1)..(657)
atgttatcaagactattaaccgcattatccttaatatcacttattttagttgtactttatttgcagtcagcatggttgtttactattctaatttgttttgtttgcatactagctttgtatgaatggattgcaaataatttcaaaaataaattatttgggttctttttaatttttaattttggtttttggtcaatttttttaattcttggctgggagtcatactttgataatgatatagggtctcctctggtaatgagcttcttcttgtatggaattattatcttgaatactgcactttttgatacctttgcttatattattggatctaactttggtaaaacctatatagttaagaaaattagtccaaataaaacattggagggtttggttggaggattgttttcttcaataattcttggcagccttattggtttgtctttggttccaaagaactattggataattgttattttcatattaggcggtttgtctgcattttttggggaccttttaattagtttttttaagagacaaactggagttaaagacacaggaacaattttgcctggacatggaggcattttagatagaattgattcccatcttttagccactcctttattaataattattttatttttattagtttcattatga

SEQ ID NO: 10134 - protein, 218 aa, uncultured marine gamma proteobacterium EBAC20E09
MLSRLLTALSLISLILVVLYLQSAWLFTILICFVCILALYEWIANNFKNKLFGFFLIFNFGFWSIFLILGWESYFDNDIGSPLVMSFFLYGIIILNTALFDTFAYIIGSNFGKTYIVKKISPNKTLEGLVGGLFSSIILGSLIGLSLVPKNYWIIVIFILGGLSAFFGDLLISFFKRQTGVKDTGTILPGHGGILDRIDSHLLATPLLIIILFLLVSL

SEQ ID NO: 10135 - DNA, 825 bp, Thermus thermophilus
  CDS (1)..(825)
atgacggaccacctccccacccgcgtcttctccgccctggccggggcccttctcctcctcctcgtcctttgggggggcatccccctcatcctccccaccctcctcttcgtccactggctcggcacccgggagctcgcggagatgctggcgaggagggggatcgccctcaacacccccctcctgctcgcgggaggggttttggtcttcctcttctccttgccccagctctactggcacttcccccaggtgccctggcgggaggtggccctgggcctcttcctcctcgccagcttcagctacgagctcctcttcggggccaacctcccccgcttcgccttcggcctcatggccttcctctacctgccctggagcctggggtacgtcctcctcctcagggagaccccggacgcggccatgggcctttggaccctcaccctgcccctggtggcgagcttcgccacggacatcggcgcctacttcatagggcgggccttcggtaggcggaagctcgccccggagatcagcccgggcaagaccgtggagggctccttggggggcatcgcggtgagcttcctcgccctggtggtctacactgggctcgtgcgcgaggtcttccccttcgggcttttggagctttggcttttcagcctcctcctctccctgggggcccagctcggggacctcgccgagtccatgctgaagcgcttcgccggggtgaaggactcagggaacttcctccccgggcacggaggccttctggaccggatagacagcctcctcttcgccttccccctcacgtacttcctggtggtgctcttcacataa

SEQ ID NO: 10136 - protein, 274 aa, Thermus thermophilus
MTDHLPTRVFSALAGALLLLLVLWGGIPLILPTLLFVHWLGTRELAEMLARRGIALNTPLLLAGGVLVFLFSLPQLYWHFPQVPWREVALGLFLLASFSYELLFGANLPRFAFGLMAFLYLPWSLGYVLLLRETPDAAMGLWTLTLPLVASFATDIGAYFIGRAFGRRKLAPEISPGKTVEGSLGGIAVSFLALVVYTGLVREVFPFGLLELWLFSLLLSLGAQLGDLAESMLKRFAGVKDSGNFLPGHGGLLDRIDSLLFAFPLTYFLVVLFT

SEQ ID NO: 10137 - DNA, 807 bp, Desulfovibrio vulgaris
  CDS (1)..(807)
atgaccctcgccacctcacacctgcagcgcctcgtaacgggcgcggccctcgccctgctgctcaccgccggactcgccctcgggggctgggttctcgtcctgcttgcgcttgtggcgtcatcgctcgccctgctcgaattctacaccatgttctggccatgcaatgacaaactgcacatgaaggccataggcctcgtgctgggcgcgggcatgctggtggcagggcacctcgacaagccatggctcatcgtgggctgccttgccggagcctttctcgctggcgcgttgcagttcctcggcgactggggacgtggcgacgatgaaagccgcttcgccgacggccagattctcgccgcaggcctgctgtatgtccccctcctgctgctgcccgtgctgcatctttcgttacgcgaccagttgctggtggcccttgccgccttcatctccgacaccggtgcctactacatcggaacctacctcggcagagcacgcatctggccccgcgtcagccccaagaagagctgggctggcagcataggcggccttgtgctgtgcatcgccatgtgcgtgggcctcggcctgtggtggggtgtgcgaccgtggtggcagttcgccatgctgggtgtcttgctgaacgcggcctcacagctgggcgacttcttcgaatcggcactcaagcgcaccctcggcgtcaaggactcgggcacgttgcttcccggtcatggtggtctgctcgaccgcatcgacagccttctcttcgtggtgcccgtctacgccgccgccgacagcgtgctggcgttcttctga

SEQ ID NO: 10138 - protein, 268 aa, Desulfovibrio vulgaris
MTLATSHLQRLVTGAALALLLTAGLALGGWVLVLLALVASSLALLEFYTMFWPCNDKLHMKAIGLVLGAGMLVAGHLDKPWLIVGCLAGAFLAGALQFLGDWGRGDDESRFADGQILAAGLLYVPLLLLPVLHLSLRDQLLVALAAFISDTGAYYIGTYLGRARIWPRVSPKKSWAGSIGGLVLCIAMCVGLGLWWGVRPWWQFAMLGVLLNAASQLGDFFESALKRTLGVKDSGTLLPGHGGLLDRIDSLLFVVPVYAAADSVLAFF

SEQ ID NO: 10139 - DNA, 789 bp, Listeria monocytogenes str
  CDS (1)..(789)
atgaaaacgagaattattactgcagttgttgcgcttatattttttattccattcgttgtctacggaggaattccatttgaactattaagtattttactagcaacgattgctttatatgaagtacttgtaatgacaaaacaacgaattttttcgatgaatggaataattactttactattaatgtggttagttgtcgtgccagatagatatttggactttttagatacactgcatattactgaaatggaagttatttttattttaatggctttattactcgctaatactgtattttcacgaaataaattccattttgatcaagttggtatttgtatggttgccgctttttatacaggatttggtttccattacttggcattaactcgtgaagctgggttaatgtatgtactttttgctttatttattgtttggtcaactgatacaggggcttattttattggaaaagcgattggaaaacacaaattagctccgaatgttagcccaaacaaaacggtggaagggtttatcggcgggattgtatgtgcacttgtcattgctgggggcttttattattttgctgagctaccaggaaatattgcactcgtactagcgcttttagtctttctttctatttttggacagttgggagacttggtcgaatctgctttgaaacgcttttatggtgtaaaagattctgggaaaatcttaccagggcatggtggtattttagaccgctttgatagcttgttgttcgttttacctctgctacatatacttcaaattatttaa

SEQ ID NO: 10140 - protein, 262 aa, Listeria monocytogenes str
MKTRIITAVVALIFFIPFVVYGGIPFELLSILLATIALYEVLVMTKQRIFSMNGIITLLLMWLVVVPDRYLDFLDTLHITEMEVIFILMALLLANTVFSRNKFHFDQVGICMVAAFYTGFGFHYLALTREAGLMYVLFALFIVWSTDTGAYFIGKAIGKHKLAPNVSPNKTVEGFIGGIVCALVIAGGFYYFAELPGNIALVLALLVFLSIFGQLGDLVESALKRFYGVKDSGKILPGHGGILDRFDSLLFVLPLLHILQII

SEQ ID NO: 10141 - DNA, 1014 bp, Mycoplasma mobile 163K
  CDS (1)..(1014)
atgaaaatatttaaaaaatcacctttttctcttattaaaaataatgttcttagaaaatcaattattggattattaatttttattgttattctttcaataacactattaattaggtttttaaatctatctggtgcaattattggattctttttttatagtattttacttggaattttctttgtagaatttacaacacattatggatttaaaaaatgacaacaatttatattaatttctattgcaattttaatatttgtttttcctataaatttttattctagtttattaagatctaatggatttgatccaattaattataatgaaacaggattaagagaatcattacctagtaatttaatttctccttttgttttttctccaattcttccttcaaatttctcatttcctaactacttgattttacttgttttagcaattttgactctcttgttttttgccttaaatagcaaattgacaattagagatatccccaaaattctaattgtaacttttgtgataattttcttcgttattttttcaagatttatattttttttaaattttagctcttacactttgtttattatgcttattgttggtgtgatttttgcagattcatttgcctattttggtggaaaacttcttggacaaaaaattttcaaaaggaaattggctcctactatttcgcccaacaaaacaatagaaggagctattataggaactttattttcagcaatatttattttaggatggggatatggcacaaatgtttttggaaattacagatattcattagatgcaaatgcatttgcaataatttgtgctttaataattccaattatttccatttttggagatttgttcttttcttgaattaaaagaaatctaaaaattaaagatttttctgttttttttcctgaacatggaggacttttagatcgtttcgattcactttcttttgctacttgatttatttcgttggttttaatttttgcaggagtgctatttatttaa

SEQ ID NO: 10142 - protein, 337 aa, Mycoplasma mobile 163K
MKIFKKSPFSLIKNNVLRKSIIGLLIFIVILSITLLIRFLNLSGAIIGFFFYSILLGIFFVEFTTHYGFKKWQQFILISIAILIFVFPINFYSSLLRSNGFDPINYNETGLRESLPSNLISPFVFSPILPSNFSFPNYLILLVLAILTLLFFALNSKLTIRDIPKILIVTFVIIFFVIFSRFIFFLNFSSYTLFIMLIVGVIFADSFAYFGGKLLGQKIFKRKLAPTISPNKTIEGAIIGTLFSAIFILGWGYGTNVFGNYRYSLDANAFAIICALIIPIISIFGDLFFSWIKRNLKIKDFSVFFPEHGGLLDRFDSLSFATWFISLVLIFAGVLFI

SEQ ID NO: 10143 - DNA, 918 bp, Onion yellows phytoplasma
  CDS (1)..(918)
atgataaaaaagagaataataacaggggccaccttagttttattttcttttttcttttattattatgcccctttagaaatcaaatttgtagtttttgcccttttagcaataaaagcagtgcaagaaatgttttttatactcaaacatcccaaagataaccaaaaacagacctttattaaatttgggttagttgccacttctactttattattttttacagttgtttgtttgatgttgtatccaaatatttgtcaaaatcaaaacttaataaaagacgcaaaacaattaaactttttattccttaataaagacacatttgtatccctaacaaaatcaactccctcgaacctaaattttttccttcttttattcttaccttttgtgttagttttaataatgctagtttttttaccttttttgcaaactaaagatgtaagcaaaacctttcttatcaccttttatattggttttttgatggcttgtcttttttctttgtttttcctgcattggcattatttgcttttgttttttttagcagttatgctcactgattcttctgcttttttagcacgtttcccgcgtttttgcccctttttaggaacaagacccctagcttttcacctaagtcctaaaaaaactcaaaaaggtgctattttaggcacttttggctctactataacagtcttgatggtctttttatttattgattgcaactcttgcattagttttcccatctatgcttttttaatttctattatttctcaaattagcgatttgttagcttccaaatttaaaagagattatggcatcaaagactttggaagtttccttccaggtcatggtggttttttagataggtttgattcttggcttttgagttctttttttgctctcatactctttaatttacctttttaa

SEQ ID NO: 10144 - protein, 305 aa, Onion yellows phytoplasma
MIKKRIITGATLVLFSFFFYYYAPLEIKFVVFALLAIKAVQEMFFILKHPKDNQKQTFIKFGLVATSTLLFFTVVCLMLYPNICQNQNLIKDAKQLNFLFLNKDTFVSLTKSTPSNLNFFLLLFLPFVLVLIMLVFLPFLQTKDVSKTFLITFYIGFLMACLFSLFFLHWHYLLLFFLAVMLTDSSAFLARFPRFCPFLGTRPLAFHLSPKKTQKGAILGTFGSTITVLMVFLFIDCNSCISFPIYAFLISIISQISDLLASKFKRDYGIKDFGSFLPGHGGFLDRFDSWLLSSFFALILFNLPF

SEQ ID NO: 10145 - DNA, 1089 bp, Oryza sativa
  CDS (1)..(1089)
atggccgccgcggtggccacagcgacgacgccggccgccgcccacctccaccaccaccaccgccaccaccgcctccccctcctcccctcccagccacgtccccgccccaccctccgcctccgcctcctcatcccgacaccaccccctctccgccgcctcctccgccgctccccgctcctcgcggccgccgctgtctccgccgatggaggcggcggcgggggcggcggcggggaggaggcggagaggaagagggagaagtcgcggcagcttcagaagcgtgtgctcgtgggcgtcgccatcggggtgggcgcgggcggcgtcgtggtggccggcgggtgggtgttcgcggccgccgtggccgcggctgtcctcgccggagctcgtgagtacttcgggctcgtccgcgggaccgccggcgggggaggcacgccgccgccgcgcttcgtgtcccgcgtctgctctgccatctgcgctctcatgcctatccttaccctgtactatgggcatatggatgttaccgtgacgttttctgcattccttattgcgatatcattgttattgcaaagaggaaatcctcgttttgcacagctgactagttcagtttttggtctcttttattgtggctatcttccttctttctgggttaagctccgatctggactagctgctcctgccttaaatacaatatgtgttttgccagaaattgcatacagttggccaatacttcttggtgggcaagctcactggacagttggacttgtagcaaccttgatttctattagtagcattattgccgctgatacatctgctttcctttgtggacgggcatttggtcgcactcctcttactgatataagccctaagaagaccttggagggtgctttagctggtctaactggctgtgtactgaccactgtgcttctttcaagcgtcttacattggccaagatcgctgctgagtgctactgcttacggaatcttgatctttctgggttcgttgttcggggatcttgtcgagtctctgatcaagcgtgatgctggtgtgaaggactctggatcactcattcctggccatggtaaccttttttaa

SEQ ID NO: 10146 - protein, 362 aa, Oryza sativa
MAAAVATATTPAAAHLHHHHRHHRLPLLPSQPRPRPTLRLRLLIPTPPPLRRLLRRSPLLAAAAVSADGGGGGGGGGEEAERKREKSRQLQKRVLVGVAIGVGAGGVVVAGGWVFAAAVAAAVLAGAREYFGLVRGTAGGGGTPPPRFVSRVCSAICALMPILTLYYGHMDVTVTFSAFLIAISLLLQRGNPRFAQLTSSVFGLFYCGYLPSFWVKLRSGLAAPALNTICVLPEIAYSWPILLGGQAHWTVGLVATLISISSIIAADTSAFLCGRAFGRTPLTDISPKKTLEGALAGLTGCVLTTVLLSSVLHWPRSLLSATAYGILIFLGSLFGDLVESLIKRDAGVKDSGSLIPGHGNLF

SEQ ID NO: 10147 - DNA, 849 bp, Rhodopseudomonas palustris
  CDS (1)..(849)
atgagccaggacaaggcggcgccggcgccggcggccgagcaggggtcccggaatctgattttgcgaattgcggctgcgctggtgctggcgccgggcgcgatcgcgatcgcttatctaggcggctggccctgggcggtgctcgcgaccgccgttgcggtcggcctgctgctggaatggctgagcatcgtcggcctcggccgtgactggccgatcatcggggtcggcggactcggtctggtcgtctgcggtgcagcgctgggtgccggtgtgccgtggctggctgctgccgcgatcgtcatcgcgcttgccgttctggcgctgctcggcggcgggcagcgccgttgggcgacgtccggattgggctacgcggcggctgccctggtcgcctcgatcctgatccgcgccgatccggactacggctttgccgccttgatgatgattctcttgatcgtctgggtgaccgacatcggcggctatttcgccggtcgcgggatcggcggcccgaagctgtggccgcgggtcagcccgaagaagacctgggcgggcgcaatcggcggcttcgtgctgagcctcgtgatcgctgctggttttgccctgttgggcgttggaaaaatggcgccgctgcttgtgcttgcggcgatcctttcaactgtttctcagctcggtgatctgttcgaatccgcggtcaagcgccggttcggcgtaaaggactccagccacatcattcccggccacggcgggttgatggatcggcttgatggctatgtggcggcggtcgtggtggcggtattgatcgggctgacgcgcggaccgctggatggtattggccgcggattgatggtgtggtga

SEQ ID NO: 10148 - protein, 282 aa, Rhodopseudomonas palustris
MSQDKAAPAPAAEQGSRNLILRIAAALVLAPGAIAIAYLGGWPWAVLATAVAVGLLLEWLSIVGLGRDWPIIGVGGLGLVVCGAALGAGVPWLAAAAIVIALAVLALLGGGQRRWATSGLGYAAAALVASILIRADPDYGFAALMMILLIVWVTDIGGYFAGRGIGGPKLWPRVSPKKTWAGAIGGFVLSLVIAAGFALLGVGKMAPLLVLAAILSTVSQLGDLFESAVKRRFGVKDSSHIIPGHGGLMDRLDGYVAAVVVAVLIGLTRGPLDGIGRGLMVW

SEQ ID NO: 10149 - DNA, 879 bp, Corynebacterium diphtheriae
  CDS (1)..(879)
atgcctcattcatcaacggcttttgagcacttgcctaaaccgaagaattcggctggtcgaaacctgaaagccgcgatcagcgttggaattggcttgggcgccctcgtattgctcgctatctttgttattccttttggttggtatccattagtggctatcgcaatcgcagtggcaacttgggaggtagagcgccgtttaatagaagccggttatcttttgcaacgttgggtcatgcttattggcggacaagtcatgttgtggcttagttggccatttggtccgaagggattagtggctggtttcgtcggcgttgtactcgctacgatgtttggtcggcttttccatcatggtcgttctatgccaccgaaaaactatctgcgagatactgccgtcgcaatttttgttttaacgtggatcccactttttggtagttttgcggcaatgctttcgctgtttgaaacagaaacagcacccggaaagtacttcatcgtcacattcatgttgtgcgttatcgcctctgacgtaggcggttatattgcaggcgtgatgttcggatcgcaccccatggcacctgcggtaagcccaaagaaatcgtgggagggctttatcggttctgtagtctttggcatgattgttggagcattcactgtgtcctatttattagggcatcaatggtggtggggattagttctcggatttggacttgtgatctgcgcgacactgggcgatcttgtcgaatcccagtttaagagggaactcgggatcaaagacatgtctgcgattttgcccggccatggtggtctgatggatcggcttgacggtatgttgccatcggctatggtgacatggttagtcttgagtgtgatttcttcagtatag

SEQ ID NO: 10150 - protein, 292 aa, Corynebacterium diphtheriae
MPHSSTAFEHLPKPKNSAGRNLKAAISVGIGLGALVLLAIFVIPFGWYPLVAIAIAVATWEVERRLIEAGYLLQRWVMLIGGQVMLWLSWPFGPKGLVAGFVGVVLATMFGRLFHHGRSMPPKNYLRDTAVAIFVLTWIPLFGSFAAMLSLFETETAPGKYFIVTFMLCVIASDVGGYIAGVMFGSHPMAPAVSPKKSWEGFIGSVVFGMIVGAFTVSYLLGHQWWWGLVLGFGLVICATLGDLVESQFKRELGIKDMSAILPGHGGLMDRLDGMLPSAMVTWLVLSVISSV

SEQ ID NO: 10151 - DNA, 1026 bp, Mycoplasma mycoides
  CDS (1)..(1026)
atgaatacaattattactaaagatgaaaataaaatcaaacaaattaaaaaaaatttaaaaacaagactaatttcagcaacaattttagtattgttattgggtgtttatttagcatttccaatattgtattactttactaatgatagttcttctaaacttataattacttataatgtaatttcattagtttgaagtagttgtgtattatttttatcaattagagagttattaatttcatttgaaattaaaaatttagatcaaaaactatttattgaaattttaacagtcattttattttgaattccatttagtaatattgaaacaaaaatcccagtttataatgatttaaacttaaaagaatattgatatttaatagtaattgcaattggtttatacttatttttaattaccttttttttaatgaaattttgtaataaaaacatttatcaagcaactaaaattgtctttgttttattaattatggttcttgcttttaaagcaattaattttttaggttttttaaaagcacataacaaaattttgtatggatttagttctattatttgaatatgagcaactattattctaactgatagttttgcttatttatttggaattagatttggtaaacacaaattagctccaactattagtcctaaaaaaacttgagaaggagcaattggtggatttttttctagtgtaattattaatttaatttgagttttaactatcttttttattccatgaacaaaaagttttgccccatttataggaatgtatgatttattgttaaaagatgataatttaatgttaataacttatatatttttaactgttttagtttctttatttactcaatttggagatttaatttttagttatattaaaagaagtatcgatattaaagatttttctaatttaatcccaggtcatggtggaattttagatagattagattcattttattttgtcttttttatcatttatataattttacatattagtctaacatttaatagaatatag

SEQ ID NO: 10152 - protein, 341 aa, Mycoplasma mycoides
MNTIITKDENKIKQIKKNLKTRLISATILVLLLGVYLAFPILYYFTNDSSSKLIITYNVISLVWSSCVLFLSIRELLISFEIKNLDQKLFIEILTVILFWIPFSNIETKIPVYNDLNLKEYWYLIVIAIGLYLFLITFFLMKFCNKNIYQATKIVFVLLIMVLAFKAINFLGFLKAHNKILYGFSSIIWIWATIILTDSFAYLFGIRFGKHKLAPTISPKKTWEGAIGGFFSSVIINLIWVLTIFFIPWTKSFAPFIGMYDLLLKDDNLMLITYIFLTVLVSLFTQFGDLIFSYIKRSIDIKDFSNLIPGHGGILDRLDSFYFVFFIIYIILHISLTFNRI

SEQ ID NO: 10153 - DNA, 837 bp, Bdellovibrio bacteriovorus
  CDS (1)..(837)
atgacaacaaccatgaaaagcttcctaactagagcggtttcggcccttattgcccttgcgatcatcatcggactttatgtctcgttgggggttctgggactgaaaatcgccgtgggtctgattgttgtcatcggcaactgggaactgatcggcattttgttccacaatgaaaaatccaaagtcataaaaactcttttccgactgatgacctatgccgtgttcgcagcgtcgatcacttctttgagcatgggttccatcatctatgctttggcgaccatcgtgatgatcatcacagttcttttgtcttctcacaaagaaggcaatctggaatacatggcctcagctcaggcaaaatctgcgctgggtctgttctatatgggtcttttgccttcctttgctttccgtttattggatcaggcgtatggactttactggttcatcttcctgctggcggtagtatttgctggcgacactctggcgtatgtttttggcgtcttgtttggcaaaaacaaagtcatgccttctgtatcccctaaaaaatcctggcagggttctatcgggggcatcatcggctctgtggcggcaggtctgatctgctggttgttcctgtttccggaaaacagcgtgggtgtcttcctgcttctgggtggcatctctgggtttgtgggccagttcggagacttcttcgaatctttgctaaaacgtgtggcggatgtgaaggattcgggcaaaatcatgccaggtcatggtggtgtcttggatcgagtcgatggggtcctattcgcaagtcctgttgttttgggcggagttttgattctatctcatcttttgtcctaa

SEQ ID NO: 10154 - protein, 278 aa, Bdellovibrio bacteriovorus
MTTTMKSFLTRAVSALIALAIIIGLYVSLGVLGLKIAVGLIVVIGNWELIGILFHNEKSKVIKTLFRLMTYAVFAASITSLSMGSIIYALATIVMIITVLLSSHKEGNLEYMASAQAKSALGLFYMGLLPSFAFRLLDQAYGLYWFIFLLAVVFAGDTLAYVFGVLFGKNKVMPSVSPKKSWQGSIGGIIGSVAAGLICWLFLFPENSVGVFLLLGGISGFVGQFGDFFESLLKRVADVKDSGKIMPGHGGVLDRVDGVLFASPVVLGGVLILSHLLS

SEQ ID NO: 10155 - DNA, 939 bp, Parachlamydia sp
  CDS (1)..(939)
atgcacctgtcctttggccagattttactcctaatcatcttctggaagccattgtcgattatcaaaaaagagaaagaagatggggaggcgtataaattggcaaatcagtttaaacaacgagttgtcacaagcagcgtgactattttcttagtcattatctcgatttatttttctcatgttccttactttaaacctatttttgtattacttaatgcagcaattatctcattggctcttctcgagtattatcaattggcacattataaaggatttcaacctttaaatttattaggtgtgggaacaacaacagcttatgtcatcagcagtttttacgctggacaagaacccaatttatctgatcttcctctttttgttttattaggctgtcttctactattttttttagcctattttaataaacagttagaacccttaggtaatattgctgtcaacctattcggaattggctatgtcgtcatccctttgacatgtgctttgcaaatcaattatttttcatctcctcatataactgatggacgtttgtggctcgcctatgcacttgctgttaccaaaatgacagatgttggtggatatataagcggaaaaattttcggaaaaatcaaattagcttctcatattagccccaaaaaaactatcgaaggttccattggaggtttaatattgtctcttttgactagcctagctttttattattttgtattcccttttaaacatccaatctccttttggcaaagtatatggctaggaatagtcatcagtgtactttctcaattcggagacttatctgaatccatcttaaagagagacgctggggtcaaagatagcagtcaactaccgggtttagggggcatccttgatatgacagattctcttgtttttaccttgcctttagtgtatctttggctaaaagtttcatga

SEQ ID NO: 10156 - protein, 312 aa, Parachlamydia sp
MHLSFGQILLLIIFWKPLSIIKKEKEDGEAYKLANQFKQRVVTSSVTIFLVIISIYFSHVPYFKPIFVLLNAAIISLALLEYYQLAHYKGFQPLNLLGVGTTTAYVISSFYAGQEPNLSDLPLFVLLGCLLLFFLAYFNKQLEPLGNIAVNLFGIGYVVIPLTCALQINYFSSPHITDGRLWLAYALAVTKMTDVGGYISGKIFGKIKLASHISPKKTIEGSIGGLILSLLTSLAFYYFVFPFKHPISFWQSIWLGIVISVLSQFGDLSESILKRDAGVKDSSQLPGLGGILDMTDSLVFTLPLVYLWLKVS

SEQ ID NO: 10157 - DNA, 849 bp, Photobacterium profundum
  CDS (1)..(849)
atgttaaagcaacgaattattactgcactaatcctcgcgcctttagtgattgccgggatatttttactaccattttcttttttcgtcattgctcttgccgcgattacattgattggtttttgggaatggacacagtttgttgatgctaaatcgcgcctcgttgcgatggtcgtacctacgatgaccctaggcctaagcttggtagtaataccttttgatgtaactgcattatcaacactgaccgaatcacaccatggtatattgtttgttggggggatttggtggttaattgcatctaccttagcaataacatacccatccagcgtaaaactttggtctgcatcttcttcgctaaaacacttctttgggttacttacactcatcccattcttttggagtatcttaatgctccgcgctgttaactatgcagaaaacccatatcatggtgcaaaactcgtgttattggtttgttttctggtgtgggcggcagatactggcgcgtacttctctggtaaacgtttcggaaaaactaaaatggcccctgcggttagcccgaataaaaccattgaaggtttagtcggcggggcattgttagcgatccttattacgtggggtggcgcgacattgatggatattccatttacgagcttaagcaatcttttcatcattgctattattacagtgattgcatctgttttgggtgacttggttgaaagtatgttcaagcgtgtttctggcatcaaagatagtggtaatattttacctggtcacggtggtatccttgatcgtattgacagcttaacggctgcgcttcctgtttttgctttattgtatctttgggtgctgtaa

SEQ ID NO: 10158 - protein, 282 aa, Photobacterium profundum
MLKQRIITALILAPLVIAGIFLLPFSFFVIALAAITLIGFWEWTQFVDAKSRLVAMVVPTMTLGLSLVVIPFDVTALSTLTESHHGILFVGGIWWLIASTLAITYPSSVKLWSASSSLKHFFGLLTLIPFFWSILMLRAVNYAENPYHGAKLVLLVCFLVWAADTGAYFSGKRFGKTKMAPAVSPNKTIEGLVGGALLAILITWGGATLMDIPFTSLSNLFIIAIITVIASVLGDLVESMFKRVSGIKDSGNILPGHGGILDRIDSLTAALPVFALLYLWVL

SEQ ID NO: 10159 - DNA, 20 bp, Primer
atgctggcagcgtgggaatg

SEQ ID NO: 10160 - DNA, 25 bp, Primer
ttaaagcgtcctgaataccagtaac

SEQ ID NO: 10161 - DNA, 645 bp, Escherichia coli K12
  CDS (1)..(645)
atgcgccctcttattttatcgattttcgcactatttcttgcgggatgtacgcacagccagcaaagtatggtcgatacatttcgcgccagccttttcgataatcaggatatcaccgtagcggatcagcagatccaggcgttgccttattccactatgtatttacgccttaatgaagggcaacgaatctttgtggtactgggatatatagaacaagaacaaagcaaatggttatcccaggataacgccatgctggttacccacaatggacgtcttttaaaaaccgtcaaacttaataataatctgctggaagtgacaaattccgggcaggaccctctgcgtaacgcgctggcaataaaagatggcagccgctggacgcgcgatattctctggagtgaagacaaccattttcgctctgcgaccctgagttctactttttcctttgctggattagagacgctgaatattgcgggtcgcaatgtgctgtgtaatgtctggcaggaagaggtgacttccacgcggccagaaaaacagtggcaaaacacattctgggtcgattcggctactggccaggttcgtcaaagtcggcaaatgttaggcgcaggggttattcccgtagaaatgacgtttcttaaacccgcaccatga

SEQ ID NO: 10162 - protein, 214 aa, Escherichia coli K12
MRPLILSIFALFLAGCTHSQQSMVDTFRASLFDNQDITVADQQIQALPYSTMYLRLNEGQRIFVVLGYIEQEQSKWLSQDNAMLVTHNGRLLKTVKLNNNLLEVTNSGQDPLRNALAIKDGSRWTRDILWSEDNHFRSATLSSTFSFAGLETLNIAGRNVLCNVWQEEVTSTRPEKQWQNTFWVDSATGQVRQSRQMLGAGVIPVEMTFLKPAP

SEQ ID NO: 10163 - DNA, 639 bp, Salmonella enterica subsp. enterica serovar Typhi
  CDS (1)..(639)
atgaagcgactcgcacttatcctgatttgcctgctattacaggcgtgttcggccaccaccaaaggcctgggcgattcactgtgggacagtttgttcggtacgccaggcgtacagctaacggatgacgatattcaaaacatgccttatgccagccagtacatgcagcttaacggcggtcctcaactgtttgtggtgctcgctttctcggaaaacgggcagcagaaatgggtgacgcaggatggcgcgacgatcgtgacgcagcatggccgtctggtcaaaactctgctcggcggcgacaacctgatcgatgtgaataatctggcgaccgacccgctggcgaaaccaggacagattatcgatggcgcgacctggactcgcaccctgggctggaccgaacatcgccaggtgcgttacgccaccgcccgttccgtttttacatggcgagggaccgatagagtgaacgtcggcagtgaggaaaccgccgtgcgggtgttagatgaagaagtgacgaccgatcaaacgcgctggcgtaatcgctactgggttgatagcgaaggccaaattcgccagacggaacagtatctgggcgcgaattactttccggtgaaaaccacgctgattaaggcggcaaaatcatga

SEQ ID NO: 10164 - protein, 212 aa, Salmonella enterica subsp. enterica serovar Typhi
MKRLALILICLLLQACSATTKGLGDSLWDSLFGTPGVQLTDDDIQNMPYASQYMQLNGGPQLFVVLAFSENGQQKWVTQDGATIVTQHGRLVKTLLGGDNLIDVNNLATDPLAKPGQIIDGATWTRTLGWTEHRQVRYATARSVFTWRGTDRVNVGSEETAVRVLDEEVTTDQTRWRNRYWVDSEGQIRQTEQYLGANYFPVKTTLIKAAKS

SEQ ID NO: 10165 - DNA, 690 bp, Vibrio cholerae
  CDS (1)..(690)
atgcatagactctattatttagctttttgtcagttatttttgataatgggatgcagcaatagctcacagcatttatctgaaacgatgcaattggctatttttggcacgccagctccagttatttccccacaaaaagtcgccagtattccttacgctagtttatatattcagcaaaatgacaaccctctcgcattaatggtattaggttgggcagagccaaccagaaataatcgtcatccggcgttaaagtgggtttcagcagggcaagaaatgctcgtcactgaaggtgggcgaattactaaaaccttgaacttagatggtgcaaacttaatcagccttgaatcggattcaaccgatccgctgttacttgggttacatcgagcgagcaccccacgtgagtggcacttctatttaagctggcagcctggttatcactttcgctatttagcgcattctcaatttatcactctcggcgagcagcaaaaacaactgccaaatggtgagtcgcgtactttgctgcgcatcgatgaacaaataaccatagcagcgctaaaccagcagtatcacaatcaatactggctcgaaccaagcactggcgcagttatcgctagcgaacaacaattagcgcccggcacccaccgttatgcactggcggtcgcgaaatcttacctcaaccaagggggtatttaa

SEQ ID NO: 10166 - protein, 229 aa, Vibrio cholerae
MHRLYYLAFCQLFLIMGCSNSSQHLSETMQLAIFGTPAPVISPQKVASIPYASLYIQQNDNPLALMVLGWAEPTRNNRHPALKWVSAGQEMLVTEGGRITKTLNLDGANLISLESDSTDPLLLGLHRASTPREWHFYLSWQPGYHFRYLAHSQFITLGEQQKQLPNGESRTLLRIDEQITIAALNQQYHNQYWLEPSTGAVIASEQQLAPGTHRYALAVAKSYLNQGGI

SEQ ID NO: 10167 - DNA, 732 bp, Vibrio vulnificus
  CDS (1)..(732)
atgataaatctcccttttcagcaggctattttgcctcgttttcttatgcgcagtgcagccgtagccagtttgattctcctttccggttgtgtgcaacgtttcgatgacatgagcacaacgctaaatgaagcgttctttggcgcagaagacattacccaaacctctcagcaggtgttagcgcttccctacgccagtacttatatgcgaattaatgacggtcagcgtattttcatggtgctcggctacgctgagcaaaacccagaaaacaatcaactacagctaaaatgggtttcttcagatggcgggatgatcgtcacggaaaacggccgagtggttaaaacgcttaatcttccttatggaaatcttatacgtagagaggtggatttagcgcactctcaacaagcaaaaccttggcaaaccaaccttcaatggcaaagccagtatgattggaagacacaaggctccaatagcaataaaggtatgcattacgggtaccttggcaatgtaacgctcacacaaatggggagtgaagaggcaatttccgctatttggcagcaaacgttaaccatctggcaagagaacatcttcttccctcaattagataccacggtgcaaaaccaatactgggttaatgacagtggacaagtaatgaagagcattcaatatcttgggcctgaaatgacgcgcattgaattcgagatcctgaaaccgtttgcggaggtggcacaatga

SEQ ID NO: 10168 - protein, 243 aa, Vibrio vulnificus
MINLPFQQAILPRFLMRSAAVASLILLSGCVQRFDDMSTTLNEAFFGAEDITQTSQQVLALPYASTYMRINDGQRIFMVLGYAEQNPENNQLQLKWVSSDGGMIVTENGRVVKTLNLPYGNLIRREVDLAHSQQAKPWQTNLQWQSQYDWKTQGSNSNKGMHYGYLGNVTLTQMGSEEAISAIWQQTLTIWQENIFFPQLDTTVQNQYWVNDSGQVMKSIQYLGPEMTRIEFEILKPFAEVAQ

SEQ ID NO: 10169 - DNA, 645 bp, Shigella flexneri
  CDS (1)..(645)
atgcgccctcttattttatcgattttcgcactatttcttgcgggatgtacgcacagccagcaaagtatggtcgatacatttcgcgccagccttttcgataatcaggatatcactgtagcggctcagcagatccaggcgttgccttattccacgatgtatttacgccttaatgaagggcaacgaatctttgtggtactgggatatatagaacaagaacaaagcaaatggttatcccaggataacgccatgctggttacccacaatggacgtcttttaaagaccgtcaaacttaataataatctgctggaagtgacaaatcccgggcgggcccctctgcgtaacgcgctggcaataaaagatggcagccgctggacgcgcgatattctctggagtgaagacaaccattttcgctctgcgaccctaagttctactttttcctttgctggattagagacgctgaatattgcgggtcacaatgtgctgtgtaatgtctggcaggaagaggtgacttccacgctgccagaaaaacagtggcaaaacacattctgggtcgattcggctactggccaggttcgtcaaagtcggcaaatgttaggcgcaggggttattcccgtagaaatgacgtttcttaaacccgcaccatga

SEQ ID NO: 10170 - protein, 214 aa, Shigella flexneri
MRPLILSIFALFLAGCTHSQQSMVDTFRASLFDNQDITVAAQQIQALPYSTMYLRLNEGQRIFVVLGYIEQEQSKWLSQDNAMLVTHNGRLLKTVKLNNNLLEVTNPGRAPLRNALAIKDGSRWTRDILWSEDNHFRSATLSSTFSFAGLETLNIAGHNVLCNVWQEEVTSTLPEKQWQNTFWVDSATGQVRQSRQMLGAGVIPVEMTFLKPAP

SEQ ID NO: 10171 - DNA, 678 bp, Vibrio parahaemolyticus
  CDS (1)..(678)
atgatgaacacctttctatcgctaaaatggatgcgcttacttattgccctacctttactgagctcaatcttgggctgtacacaaaaatttaatgacgtatccgcgactgttcaagaagcttatggtaactacatcgatgtcgagctaactccagaagaaattgaagcggtcccttatgccagcgcttacttaaaaattggtgaccaaaaacaggtcttcgtagtgttggcctttgctgagcaaaacccattaactggcaatacccagttaaagtgggtaagtgcggacaaggcaatggtggtaacagagaatggtcatatcgttaaaaccattggtttgcaaaccaccaatctagcaggcatttatggcaacattcccgcctactcaacaccttctacgcaatacgctctctcttacgactggtctgacaaataccgttatggattcctggctaaagtagagcgcgctcttcaaggtaaagaaaccgtcataacccctatttcatcgatcgctactgatgtttatacagaggttgtaacgtttactagcttagaaaaaagtgtagagaaccaatactgggtaaacagtaaaggagaagttgtaaaaacacgtcaacacttaggtcccaatatggtgcctgttgaattgacgattctgaaagggtacagcaaatcatga

SEQ ID NO: 10172 - protein, 225 aa, Vibrio parahaemolyticus
MMNTFLSLKWMRLLIALPLLSSILGCTQKFNDVSATVQEAYGNYIDVELTPEEIEAVPYASAYLKIGDQKQVFVVLAFAEQNPLTGNTQLKWVSADKAMVVTENGHIVKTIGLQTTNLAGIYGNIPAYSTPSTQYALSYDWSDKYRYGFLAKVERALQGKETVITPISSIATDVYTEVVTFTSLEKSVENQYWVNSKGEVVKTRQHLGPNMVPVELTILKGYSKS

SEQ ID NO: 10173 - DNA, 687 bp, Vibrio vulnificus
  CDS (1)..(687)
atgcgtagtgcagccgtagccagtttgattctcctttccggttgtgtgcaacgtttcgatgacatgagcaccacgctacatgaagcgttctttggcgcagaagacattacccaaacctctcagcaggtgttagcacttccctacgccagtacttatatgcgaattaatgacggccagcgcattttcatggtgctcggctacgctgagaaaaacccagacaacaatcaactacagctaaaatgggtttcttcagacggcgggatgattgtgacggaaaacggccgagtggttaaaacgcttaatcttccttatggaaatcttatacgtagagaggtggatttaacgcactctcaacaagcaaaatcttggcaagccaaccttcaatggcaaagccagtatgattggaagacacaaggctccgatagcaataaagggaagcattacgggtatcttggcgatgtgacgctcacgcaaatggggagtgaagaggctatttccgctatttggcagcaaacgttaaccatttggcaagagaacatcttcttccctcaattagataccacggtgcaaaaccaatactgggttaatgacagtggtcaagtaatgaagagcattcaatatcttgggcctgaaatgacgcgcattgaattcgagatcttgaaaccgtttgcggaggctgcacaatga

SEQ ID NO: 10174 - protein, 228 aa, Vibrio vulnificus
MRSAAVASLILLSGCVQRFDDMSTTLHEAFFGAEDITQTSQQVLALPYASTYMRINDGQRIFMVLGYAEKNPDNNQLQLKWVSSDGGMIVTENGRVVKTLNLPYGNLIRREVDLTHSQQAKSWQANLQWQSQYDWKTQGSDSNKGKHYGYLGDVTLTQMGSEEAISAIWQQTLTIWQENIFFPQLDTTVQNQYWVNDSGQVMKSIQYLGPEMTRIEFEILKPFAEAAQ

SEQ ID NO: 10175 - DNA, 711 bp, Shewanella oneidensis
  CDS (1)..(711)
atgcgtatatataaaagactttttccctttatcgctgcttcggcagtatgtctgagcctttcgggctgtagccaacgcataagcgcattaaacgatacggttaaactcgccttttgggggaatgaagatatagtgctctcacctgagcaagtatcagctaatccttatgcgagtatctatgtaaaaattgaagatacggcccaggcatttgtggtattagcctttgcagagcctaaaatcagcctatcttcagtaaaaaactcgcccgaagaactcgagcttaaatggttatcagcagataaaggcatgttagtgacagttaacggccgcctagtcaaaacccataatctgctcacaggtaatttagcggcagtagaaagtgatgagccagatccactgttattaggattgcacttaagctccaccccaaaaacgtggactcgaatgctcgattggcaacccggttatcattatagttacaaagtaaaatcagagtttaaactgattagcgacgacaatattctaattaatggcactcccacacaagctttgcattttagtgaaagcgtctctgtggatgctctcaatattcaataccaaaatgagttttggctagatccacaaactggcagtgttattaagagtcatcaaaaaattgcgcctaatctgccatttattgatatcaccttacttaagccttttgctgcttag

SEQ ID NO: 10176 - protein, 236 aa, Shewanella oneidensis
MRIYKRLFPFIAASAVCLSLSGCSQRISALNDTVKLAFWGNEDIVLSPEQVSANPYASIYVKIEDTAQAFVVLAFAEPKISLSSVKNSPEELELKWLSADKGMLVTVNGRLVKTHNLLTGNLAAVESDEPDPLLLGLHLSSTPKTWTRMLDWQPGYHYSYKVKSEFKLISDDNILINGTPTQALHFSESVSVDALNIQYQNEFWLDPQTGSVIKSHQKIAPNLPFIDITLLKPFAA

SEQ ID NO: 10177 - DNA, 639 bp, Escherichia coli
  CDS (1)..(639)
atgaagcgacctgcactcattcttatctgcctgttattacaggcctgttcagccacgactaaagagctgggcaattcactgtgggacagtctgttcggcacgccaggcgtacagctgacggatgatgatattcaaaatatgccctacgccagccagtacatgcagcttaatggcgggccgcagttatttgtggtgctggccttcgctgaagacggacaacaaaaatgggtcactcaggatcaggctactctcgttacccaacatggccgtctggtgaagactctgctcggcggcgacaacctgattgaagtgaataaccttgctgccgacccgctgattaaacccgcacaaatcgttgatggcgcaagctggacgcgcacgatgggctggaccgagtaccagcaggtacgctacgccaccgcacgctcagtcttcaaatgggatggcaccgataccgtcaaagtcggcagcgatgaaaccccggttcgcgtgctggacgaagaagtctccaccgaccaggcgcgctggcataaccgctattggatcgacagcgaagggcaaattcgccagtcggaacagtatctcggcgcggattattttccggtgaaaaccactctcatcaaggcggcaaaacaatga

SEQ ID NO: 10178 - protein, 212 aa, Escherichia coli
MKRPALILICLLLQACSATTKELGNSLWDSLFGTPGVQLTDDDIQNMPYASQYMQLNGGPQLFVVLAFAEDGQQKWVTQDQATLVTQHGRLVKTLLGGDNLIEVNNLAADPLIKPAQIVDGASWTRTMGWTEYQQVRYATARSVFKWDGTDTVKVGSDETPVRVLDEEVSTDQARWHNRYWIDSEGQIRQSEQYLGADYFPVKTTLIKAAKQ

SEQ ID NO: 10179 - DNA, 696 bp, Photobacterium profundum
  CDS (1)..(696)
atgcggatatttcaacgctttacccttttaacactgactattctactgtctgcaggtataactggctgcagccaaaagtttaatgatgttaacgataccttatcactcgcgctttttggtgataacgatacagaattcgccaatgatgacgtacagcgcctgccctatgctagcctctatgctcaggttgatgatggtccacaagcttttatggtattggccttagccgaatcggctttatcattaacgccaaacactcgcacacaactcaaatgggtatcatccgacaaaggtatgctggtcactgaaagcggtcgattagtcaaaagcctgaatttacctcagggtaatttgattgatacctacagtaaccagcctgatccgctaattttaggcttacaccgtgcgagcacgcccatgcactggcaacgcagtattgattggcaacccggctaccatttcgattaccaattaacctcgcggtttgcacgtcaagacaatgccgtcattatgatcaatgagcgccctattacaacgtggcactttgttgaaaccgttaccattgatgtactcgatacaagctataaaaatcaattttggatcgacggaaaaacaggcaaggtacttaaaagtcagcaaaaattagcacctggcttacctttcattgacatgactttattgaagccttattcataa

SEQ ID NO: 10180 - protein, 231 aa, Photobacterium profundum
MRIFQRFTLLTLTILLSAGITGCSQKFNDVNDTLSLALFGDNDTEFANDDVQRLPYASLYAQVDDGPQAFMVLALAESALSLTPNTRTQLKWVSSDKGMLVTESGRLVKSLNLPQGNLIDTYSNQPDPLILGLHRASTPMHWQRSIDWQPGYHFDYQLTSRFARQDNAVIMINERPITTWHFVETVTIDVLDTSYKNQFWIDGKTGKVLKSQQKLAPGLPFIDMTLLKPYS

SEQ ID NO: 10181 - DNA, 26 bp, Primer
atgcgccctcttattttatcgatttt

SEQ ID NO: 10182 - DNA, 25 bp, Primer
ttatggtgcgggtttaagaaacgtc

SEQ ID NO: 10183 - protein, 51 aa, consensus; identical to SEQ ID NO: 1954
  MISC_FEATURE (1)..(51): Xaa in all positions is any amino acid.

SEQ ID NO: 10184 - protein, 94 aa, consensus; identical to SEQ ID NO: 1955
  MISC_FEATURE (1)..(94): xaa in all positions is any amino acid,

SEQ ID NO: 10185 - protein, 715 aa, consensus
  MISC_FEATURE (1)..(715): Xaa in all positions is any amino acid.
PXXXXXXXXXXXXXXXXXSXXXXXXXXXXXXXXXXXXXXXXXXXXXXXXXXXXRXXXXXXNXXXXXRHLKKXDGEPXXRKDIQXXFXXXXXXXXXXXFTNXXXPXXXXXXXXXXXXXXXXXXXXXXXXXXXXXXXXXXKXXFAXLYXXTXXXSXKXSKXLRDKLLXDXXXAXXXXXXXLLVNIGRXNTTXNFXXEMXXQLRTXHXXPXLQXXXXXXXXKXLQDXPRLKSILKXXXXXXXXXXXXXXXKXXXXXXXXXXXVNXXXXIXXXXXXXXXXXXXXXXXXXXXXXXXXXXXXXXXXXXXXXXXXXXXXXXXXXXXXXNXXXXXXDXXXXXXXXXXXXXVEXXXXXXEXXXXDXXXEXKXXXXXXXKXXXKXXXAXXXFXXXXXXXXXXXXRXXXXXXXXXXXXXILXXXXXXXXXXXLXXXXXXXXXRXXXGXXXXXXXXXXXXXXXXXXXXXXXEXXXPAGXXXLXXXXXXXXXXPXXXXXXXXXXRXXRXEXXXXXXXXRXXXRXXXXXXXXXSIXXXXXXXDXXXEXXXXXXXXXEXXXXXXXXXXLXXXXXXTXXXXXXXXXXXXXXXXXXXXXEXXXXXXXXXXXXXXXXXXXXXXXXXXXXNXXDXXXXXXXXXXXXXNGXXXXXXXXXXXXXXXXXXXXXXDIXXXXXXXEXEXXXXXXXXXXXXXXXKXXXXXXXXXXXXXXXXXXXSXXXXXXXXXXXXXDD

SEQ ID NO: 10186 - protein, 33 aa, consensus; identical to SEQ ID NO: 4356
  MISC_FEATURE (1)..(33): consensus for the disclosure of xaa see table XV

SEQ ID NO: 10187 - protein, 36 aa, consensus; identical to SEQ ID NO: 4357
  MISC_FEATURE (1)..(36): consensus for the disclosure of xaa see table XV

SEQ ID NO: 10188 - protein, 39 aa, consensus; identical to SEQ ID NO: 4358
  MISC_FEATURE (1)..(39): consensus for the disclosure of xaa see table XV

SEQ ID NO: 10189 - protein, 323 aa, consensus; identical to SEQ ID NO: 5813
  MISC_FEATURE (1)..(323): Xaa in all positions is any amino acid.

SEQ ID NO: 10190 - protein, 55 aa, consensus
  MISC_FEATURE (1)..(55): consensus for the disclosure of xaa see table XV
XXXXGXXXXXXXXXXXXXXGXXXXXXXXXXXXXXXXXXXXXXXXXXXXXXXXXXX

SEQ ID NO: 10191 - protein, 19 aa, consensus
  MISC_FEATURE (1)..(19): consensus for the disclosure of xaa see table XV
XXXXXXXXXEXEXXXXXXK

SEQ ID NO: 10192 - protein, 37 aa, consensus
  MISC_FEATURE (1)..(37): consensus for the disclosure of xaa see table XV
XXXXXXXXXXXXXEXXXXXXXXXXXXXXXXXXXXXXX

SEQ ID NO: 10193 - protein, 49 aa, consensus
  MISC_FEATURE (1)..(49): consensus for the disclosure of xaa see table XV
XXXXXXXXXXXXXXXXXXXXXXXXXXXXXXXXXXXXXSXXXXXXXXXXR

SEQ ID NO: 10194 - protein, 473 aa, consensus
  MISC_FEATURE (1)..(473): Xaa in all positions is any amino acid.
RHXXXXXXXXXXXXXXXXXXXXXXXXXXXXXGGXIGXGLFXGXXXXXXXXGPXXXXXXXYXXXGXXXXXXXXXXGEXXXXXPXXXXXFXXXXXXXXXXXXXXXXXGXXXXWXYXXXXXXXXXXXXXXXXXXXXXWXXXXXXXXXXXXXXXXXXXXXXXXXXXXXXXXXXXXXNXXXVXXXGEXEFWXXXXKXXXXXXXXXXGXXXXXXXXXXXXXXXXXXXXXXXXXXXXXXXXXXXXXXXXXXXXGXXXXXXXXXXXXXXXXXXXXXXFXXXGXEXXXXXAXEXXXPXXXXXXAXXXXXXRIXXFYXXXXXXXXXXXPXXXXXXXXXXXXXXXXXXXXSPFXXXXXXXXXXXXXXGXXXXXXXXNXVXXXXXXSXXNSXXXXXXRXXXXXXXXXXXXXXXXXXXXXXXXXXXXPXXXXXXXXXXXXXXXXXXXXXXXXXXXXXXXXXXXXXXXXXXXXXXWXXIXXXXXXXR

SEQ ID NO: 10195 - protein, 136 aa, consensus
  MISC_FEATURE (1)..(136): Xaa in all positions is any amino acid.
GXXXMXXXFGFXGXXXSLXXSKXXAXXXXXXXXIXXPXXXXEXWLXXWXXXQXXXXXXXMPXXAXYXXXXXNAFATGXXXXXXLXAXSTGLLXXMXXXEAEAVXXHEXXHXXNGDMXTMXLXQGVXNTFVIXXXRX

SEQ ID NO: 10196 - protein, 46 aa, consensus; identical to SEQ ID NO: 546
  MISC_FEATURE (1)..(46): xaa in  all positions is any amino acid.

SEQ ID NO: 10197 - protein, 289 aa, consensus
  MISC_FEATURE (1)..(289): Xaa in all positions is any amino acid.
RXXLFLXTNXAVXXXXXXXXXXXXXXXGXXXXXXXGLXXMXXXFGFXGXXXSLXXSKXMALRSVXXXVIXXPRNXXEXWLXXTVXXQXXXXGIXMPXXAIYXXXDXNAFATGAXXXXXLVAVSTGLLXNMXXXEAEAVXAHEXXHXXNGDMVTMXLXQVXNTFVIFXSRXXXXXXXXXXXXXXXXXXXXXXXXXXYXXXXXXLEXXFGXLAXXIXMWFSRXREFXADAGXAXLVGXXKMIAALXRLXXXXEXXXXXXXXXAFXIXGXXXXXXXXLFXXHPPLXXRIXAL

SEQ ID NO: 10198 - protein, 189 aa, consensus
  MISC_FEATURE (1)..(189): Xaa in all positions is any amino acid.
LXXXXXXGXXXXXXXXXXXXXXXXXXXXXXXXXXXXXXXXXXAXXXXXXLXXXXXEXXXXXXXXXXXXXXXXXXXXXXXXXXXXXXXXXGXXXPXXXXXXGKXXKXXXXXXXXXXXXXXXXXXXXXXTXXTXXXXXXLXXXLXXXRXXGXXXXXXXXEXXXXXXXXAXPXXXXXXXXXXXXXXXXXXXR

SEQ ID NO: 10199 - protein, 37 aa, consensus
  MISC_FEATURE (1)..(37): consensus for the disclosure of xaa see table XV
XXXXXXGGXGHXPXXXXXXXXXXXXXXXXXGXXFXXP

SEQ ID NO: 10200 - protein, 67 aa, consensus
  MISC_FEATURE (1)..(67): consensus for the disclosure of xaa see table XV
XXXXXXXNXXXDXXXXXXXXXXXXXXXXXXXXXXXXXXXDXXXXXXXXXXXXXRXXXXXXXXXKXXX

SEQ ID NO: 10201 - protein, 9 aa, consensus
  MISC_FEATURE (1)..(9): xaa in position 2 is Val, Ile, Leu or Met, xaa in position 4 is Ile, His or Val, xaa in position 6  is Gly, Asn or Ser, xaa in position 8 is any amino acid.
GXGXHXEXG

SEQ ID NO: 10202 - protein, 403 aa, consensus
  MISC_FEATURE (1)..(403): Xaa in all positions is any amino acid.
NXXXXXXXXXXXGXXXXXXXXXXXXXXXXXXXXXXXXXXXXXXXXXXXXXXVXXXSGGGSGHEPXXXGXVXGXGXLXXAXXGXXFXSPXXXXXXXXXXXXXXXXXXXXXXXXXXXXXXXXXXXGXLXXXXNYXGDXXXFXXAXXXXXXXXXXXXXXXXXXXDDXXXXXXXXXXXXRRGXAGXXXXXKXXGAXAXXGXXXXXLXXXXXXXXXXXXXXXXXGXXLXXXXXPXXXXXXXXXXXXXXXXXXXXXXXXXEXGXGIHGEXGXXXXXXXXXXXXXXXXXXXXXXXXXXXXXXXXXXXXXXXXXXXXXXXXXXXXXXXXXXXXXXXXXNXXGXXXXXEXXXXXXXXXXXXXXXXXXXXXXXXXXGXXXTSXXMXXXXXXXXXXXXXXXXXXXXXXXXXGXS

SEQ ID NO: 10203 - protein, 50 aa, consensus
  MISC_FEATURE (1)..(50): consensus for the disclosure of xaa see table XV
XXXXYXXXXXHXXYLXXXQXXXXXXXXXXXXXXXXXXXXXGXXXXEXDXX

SEQ ID NO: 10204 - protein, 47 aa, consensus
  MISC_FEATURE (1)..(47): consensus for the disclosure of xaa see table XV
XXXXXXXXXXXXXXXXXXXXXXXXXFXXXXXXPXXXXXXXXXXXXXX

SEQ ID NO: 10205 - protein, 15 aa, consensus
  MISC_FEATURE (1)..(15): consensus for the disclosure of xaa see table XV
XXXXXXXXXXXXXXX

SEQ ID NO: 10206 - protein, 49 aa, consensus
  MISC_FEATURE (1)..(49): consensus for the disclosure of xaa see table XV
XXXPXXXXXXSXNXXXXXXXXXXWXXGXEXXXXXXEXXXXXXXXXXXXX

SEQ ID NO: 10207 - protein, 1212 aa, consensus
  MISC_FEATURE (1)..(1212): Xaa in all positions is any amino acid.
PLXXYXIXXXHNXYLXXXQXXXXXXXXXXSXXXXXXXLXXGXRXXEXDXWXXXXXXXXXXXXXXXXXXXXXXXXXXXXXXXXXXXXXXXXXXXXXXXXXXXXXXXXXXXXXXXXXXXXXXXXXXXXXXXXXXXXXHGXXXXTXTXXXXXXXXXXXIXXXAFXXSXXYPXXXXXEXHXXXXXQXXXXXAXXXXXXXGXXLXXXXXXXXXXXXXXXXXXXXXPSPXXLXXXIXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXEXXXXXXXXXXXXXXXXXXXXXXXXXXXXXXXXXXXXXXXXXXXXXXXXXXXXXXXXXXXXXXXXXXXXXXXXXXXXXXXRXYPXXXRXXSSNXXXXXXXXXXWXXGXQXVAXNXQXXXXXXXXXXXXFXXNGXXXXXXXXXGYXXKPXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXPXXXXXXXXXXXXXXXXXXXXXPXLXXXRXXVXXXXXXXXXXXXXXXXXXXXXXPXXXXXXGXXXXXXXXXXXXXXXXXXXXXXXXXXXXXXXXXXXXXXXXXXXXXXXXXXXXXXXXXXXXXXXXXXXXXXXXXL

SEQ ID NO: 10208 - protein, 37 aa, consensus
  MISC_FEATURE (1)..(37): consensus for the disclosure of xaa see table XV
DXXXXXXGXXXXXXXXXXXXXXXXXSPXKXXXGXXXX

SEQ ID NO: 10209 - protein, 32 aa, consensus
  MISC_FEATURE (1)..(32): consensus for the disclosure of xaa see table XV
XXXXXSXXKRXXXXKXXXXXXXXXGGXXDXXD

SEQ ID NO: 10210 - protein, 337 aa, consensus
  MISC_FEATURE (1)..(337): Xaa in all positions is any amino acid.
EXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXYXXGXXXGXXXXXXXXXXXXXSPXKTXXGXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXGDLXXSXXKRXXXXKDXXXXXPGHGGXXDRXD

SEQ ID NO: 10211 - protein, 57 aa, consensus
  MISC_FEATURE (1)..(57): consensus for the disclosure of xaa see table XV
XXXCXXXXXXXXXXXXXXXXXXXXXXXXXXXXXXXPYXXYXXXXXXXXXXXVLXXXE

SEQ ID NO: 10212 - protein, 28 aa, consensus
  MISC_FEATURE (1)..(28): consensus for the disclosure of xaa see table XV
KWXXXXXXXXXVWXGXXXKXXXXXXXNL

SEQ ID NO: 10213 - protein, 45 aa, consensus
  MISC_FEATURE (1)..(45): consensus for the disclosure of xaa see table XV
EXXXXXXXXXXXXNXXWXXXXXGXXXXXXQXXXXXXXXXXXXXXK

SEQ ID NO: 10214 - protein, 217 aa, consensus
  MISC_FEATURE (1)..(217): Xaa in all positions is any amino acid.
GCXXXXXXXXXTXXXXXFXXXXXXXXXXXXXXXPYASXYXXXXXXXXXFXVLXXXEXXXXXXXXXXXXXXXQXKWXSXEXXMXVTXXGRXXKTXXLXXXDLXXXXXXXXXXXXXXPXXXXXXXXXXXXXXXXXXXXXXXXXXXXXXXXXXXXXGXXXXXXXXXXXXXXXXXXEXXXXXXXXXXXXNXXWXXXXXGXVXXSXQXLXXXXXXXXXXXXK

SEQ ID NO: 10215 - DNA, 645 bp, Escherichia coli K12; identical to SEQ ID NO: 10161
  CDS (1)..(645)

SEQ ID NO: 10216 - protein, 214 aa, Escherichia coli K12; identical to SEQ ID NO: 10162

SEQ ID NO: 10217 - DNA, 639 bp, Salmonella enterica subsp. enterica serovar Typhi; identical to SEQ ID NO: 10163
  CDS (1)..(639)

SEQ ID NO: 10218 - protein, 212 aa, Salmonella enterica subsp. enterica serovar Typhi; identical to SEQ ID NO: 10164

SEQ ID NO: 10219 - DNA, 690 bp, Vibrio cholerae; identical to SEQ ID NO: 10165
  CDS (1)..(690)

SEQ ID NO: 10220 - protein, 229 aa, Vibrio cholerae; identical to SEQ ID NO: 10166

SEQ ID NO: 10221 - DNA, 732 bp, Vibrio vulnificus; identical to SEQ ID NO: 10167
  CDS (1)..(732)

SEQ ID NO: 10222 - protein, 243 aa, Vibrio vulnificus; identical to SEQ ID NO: 10168

SEQ ID NO: 10223 - DNA, 645 bp, Shigella flexneri; identical to SEQ ID NO: 10169
  CDS (1)..(645)

SEQ ID NO: 10224 - protein, 214 aa, Shigella flexneri; identical to SEQ ID NO: 10170

SEQ ID NO: 10225 - DNA, 678 bp, Vibrio parahaemolyticus; identical to SEQ ID NO: 10171
  CDS (1)..(678)

SEQ ID NO: 10226 - protein, 225 aa, Vibrio parahaemolyticus; identical to SEQ ID NO: 10172

SEQ ID NO: 10227 - DNA, 687 bp, Vibrio vulnificus; identical to SEQ ID NO: 10173
  CDS (1)..(687)

SEQ ID NO: 10228 - protein, 228 aa, Vibrio vulnificus; identical to SEQ ID NO: 10174

SEQ ID NO: 10229 - DNA, 711 bp, Shewanella oneidensis; identical to SEQ ID NO: 10175
  CDS (1)..(711)

SEQ ID NO: 10230 - protein, 236 aa, Shewanella oneidensis; identical to SEQ ID NO: 10176

SEQ ID NO: 10231 - DNA, 639 bp, Escherichia coli; identical to SEQ ID NO: 10177
  CDS (1)..(639)

SEQ ID NO: 10232 - protein, 212 aa, Escherichia coli; identical to SEQ ID NO: 10178

SEQ ID NO: 10233 - DNA, 696 bp, Photobacterium profundum; identical to SEQ ID NO: 10179
  CDS (1)..(696)

SEQ ID NO: 10234 - protein, 231 aa, Photobacterium profundum; identical to SEQ ID NO: 10180

SEQ ID NO: 10235 - DNA, 26 bp, Primer
atgcgccctcttattttatcgatttt

SEQ ID NO: 10236 - DNA, 25 bp, Primer
ttatggtgcgggtttaagaaacgtc

SEQ ID NO: 10237 - DNA, 1503 bp, Saccharomyces cerevisiae
  CDS (1)..(1503)
atgtcattcgacgacttacacaaagccactgagagagcggtcatccaggccgtggaccagatctgcgacgatttcgaggttacccccgagaagctggacgaattaactgcttacttcatcgaacaaatggaaaaaggtctagctccaccaaaggaaggccacacattggcctcggacaaaggtcttcctatgattccggcgttcgtcaccgggtcacccaacgggacggagcgcggtgttttactagccgccgacctgggtggtaccaatttccgtatatgttctgttaacttgcatggagatcatactttctccatggagcaaatgaagtccaagattcccgatgatttgctagacgatgagaacgtcacatctgacgacctgtttgggtttctagcacgtcgtacactggcctttatgaagaagtatcacccggacgagttggccaagggtaaagacgccaagcccatgaaactggggttcactttctcataccctgtagaccagacctctctaaactccgggacattgatccgttggaccaagggtttccgcatcgcggacaccgtcggaaaggatgtcgtgcaattgtaccaggagcaattaagcgctcagggtatgcctatgatcaaggttgttgcattaaccaacgacaccgtcggaacgtacctatcgcattgctacacgtccgataacacggactcaatgacgtccggagaaatctcggagccggtcatcggatgtattttcggtaccggtaccaatgggtgctatatggaggagatcaacaagatcacgaagttgccacaggagttgcgtgacaagttgataaaggagggtaagacacacatgatcatcaatgtcgaatgggggtccttcgataatgagctcaagcacttgcctactactaagtatgacgtcgtaattgaccagaaactgtcaacgaacccgggatttcacttgtttgaaaaacgtgtctcagggatgttcttgggtgaggtgttgcgtaacattttagtggacttgcactcgcaaggcttgcttttgcaacagtacaggtccaaggaacaacttcctcgccacttgactacacctttccagttgtcatccgaagtgctgtcgcatattgaaattgacgactcgacaggtctacgtgaaacagagttgtcattattacagagtctcagactgcccaccactccaacagagcgtgttcaaattcaaaaattggtgcgcgcgatttctaggagatctgcgtatttagccgccgtgccgcttgccgcgatattgatcaagacaaatgctttgaacaagagatatcatggtgaagtcgagatcggttgtgatggttccgttgtggaatactaccccggtttcagatctatgctgagacacgccttagccttgtcacccttgggtgccgagggtgagaggaaggtgcacttgaagattgccaaggatggttccggagtgggtgccgccttgtgtgcgcttgtagcatga

SEQ ID NO: 10238 - protein, 500 aa, Saccharomyces cerevisiae
MSFDDLHKATERAVIQAVDQICDDFEVTPEKLDELTAYFIEQMEKGLAPPKEGHTLASDKGLPMIPAFVTGSPNGTERGVLLAADLGGTNFRICSVNLHGDHTFSMEQMKSKIPDDLLDDENVTSDDLFGFLARRTLAFMKKYHPDELAKGKDAKPMKLGFTFSYPVDQTSLNSGTLIRWTKGFRIADTVGKDVVQLYQEQLSAQGMPMIKVVALTNDTVGTYLSHCYTSDNTDSMTSGEISEPVIGCIFGTGTNGCYMEEINKITKLPQELRDKLIKEGKTHMIINVEWGSFDNELKHLPTTKYDVVIDQKLSTNPGFHLFEKRVSGMFLGEVLRNILVDLHSQGLLLQQYRSKEQLPRHLTTPFQLSSEVLSHIEIDDSTGLRETELSLLQSLRLPTTPTERVQIQKLVRAISRRSAYLAAVPLAAILIKTNALNKRYHGEVEIGCDGSVVEYYPGFRSMLRHALALSPLGAEGERKVHLKIAKDGSGVGAALCALVA

SEQ ID NO: 10239 - DNA, 3580 bp, Homo sapiens (man)
  CDS (82)..(2835)
ccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctgtatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtgaacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgatgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtcttccatttggataaaaggaaccaaccaacaaacaatgccatcactggaatttcccaccgctttgtgagccgtgtcgtatgacctagtaaactttgtaccaattc

SEQ ID NO: 10240 - protein, 917 aa, Homo sapiens (man)
MIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVNEYSLNAGKQRYEKMISGMYLGEIVRNILIDFTKKGFLFRGQISETMKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 10241 - DNA, 2551 bp, Kluyveromyces marxianus var. lactis, Candida sphaerica
  CDS (552)..(2009)
gctagctctcgcgacttctcggtaaaaccttgcttctcctattattcccgtagcgagcctggaaaaatttcggcggcggcttttttttttcagttcagcttcacaaagtttcctcttccacaaagttccttagaaacgaaaaacttcatatagacggatccatttgaatgtggaggcaggcaggaattcagatgaatttgaccttggaatgtaaagcgcaaaccactatttggttccgacttgacgttgcgagtggcagtttctggatcatttgcgtatataaatatataaatatgttgttctatcgtagagttctttccttttcagttgtaggttttgtccactgtgaattgttataccatcatttcttaattacagacagccccaagttttaaagtatacaagtctcattactacttactactactactactactgctgtgattaattgctatttttactagaaatactactagttatagcatcataagaagagtattagagctaacgcaaaagctaaacttttagattacattacataaatatcaagaatggttcgtttaggtccaaagaagcctccagccagaaaggggtccatggcagatgtgccagctaatttgatggaacaaatccacggtttggaaactttgttcaccgtctcttcagaaaaaatgagaagcattgtcaagcatttcatcagtgaattggacaaaggtttgtccaaaaagggtggtaacattcctatgattccaggttgggttgttgagtatccaactggtaaggaaactggtgatttcttagctcttgatttgggtggtaccaacttgagagttgtgttggttaaattgggtggtaatcatgatttcgacaccactcaaaacaagtacagattaccagaccatttgagaactggtacttctgaacaattgtggtcatttattgcaaagtgtttgaaggaattcgtcgatgaatggtacccagatggtgtttctgaaccattgccattgggtttcactttctcataccctgcatctcaaaagaagatcaattccggtgtgttgcaacgttggaccaagggtttcgatattgaaggtgttgaaggtcacgatgttgttccaatgctacaagaacagattgaaaagctgaatatcccaatcaatgtcgttcgattgatcaacgataccactggtaccttggttgcctctttgtacactgatcctcaaactaagatgggtatcattatcggtactggtgtcaacggtgcttactacgatgttgtttctggtattgagaaattggaaggtttgttgccagaagatatcggtccagattctccaatggcaatcaactgtgaatatggttccttcgataacgaacatttggtgttgccaagaaccaaatacgatgttataatcgatgaagaatctccaagaccaggtcaacaagctttcgaaaagatgacttctggttactatctaggtgaaatcatgcgtctagtactattggacttgtacgacagtggtttcatctttaaggaccaagatatctccaagttgaaagaggcttacgtcatggacaccagttatccatctaagatcgaagatgatccattcgaaaacttggaagacactgacgatctgttcaagactaacttgaacatcgaaactaccgttgttgagagaaagttgattagaaaattagccgaattggtcggaacaagagctgcaagattgactgtttgtggtgtttctgctatctgtgacaagagaggctacaagactgctcacattgcagctgatggttctgtcttcaacagatacccaggttacaaggaaaaggccgctcaagccttgaaggatatctacaactgggatgtcgaaaagatggaagaccacccaatccaattggtggctgctgaagatggttccggtgttggtgctgctatcattgcttgtttgactcaaaagagattggctgccggtaagtctgttggtattaaaggcgaatagaatagaagatagaggatgatttccctcatacaatccattatgaggaattaatctaaagatttgctattatattttttttctctgttatgaagttattagatcaatccaattcatgatatcattagttaacaagctttgaccattctggctttccacatcgacatagagacatataaacatcatttttctatatatgtaggccggaacagattgttcttcgcaaatgtaaactaacttatgtgttaatgtacaaatatgaatatatttcaaatttaaatcttaataatattagttatgcttatgtccagtttggataatatggcactagttattttaaaactattcaagcttgaagtgtatatttttatgatattacctatacaatactttctaaatgaacagcatagtcaatagccatatccacggtatccccactctctatcctgtctggagttgaatcatttccaaatgtgataacgcatgtgacgctcagtcacgttctttagcgaacgcctcatctccttttcatctcgagatagtag

SEQ ID NO: 10242 - protein, 485 aa, Kluyveromyces marxianus var. lactis, Candida sphaerica
MVRLGPKKPPARKGSMADVPANLMEQIHGLETLFTVSSEKMRSIVKHFISELDKGLSKKGGNIPMIPGWVVEYPTGKETGDFLALDLGGTNLRVVLVKLGGNHDFDTTQNKYRLPDHLRTGTSEQLWSFIAKCLKEFVDEWYPDGVSEPLPLGFTFSYPASQKKINSGVLQRWTKGFDIEGVEGHDVVPMLQEQIEKLNIPINVVRLINDTTGTLVASLYTDPQTKMGIIIGTGVNGAYYDVVSGIEKLEGLLPEDIGPDSPMAINCEYGSFDNEHLVLPRTKYDVIIDEESPRPGQQAFEKMTSGYYLGEIMRLVLLDLYDSGFIFKDQDISKLKEAYVMDTSYPSKIEDDPFENLEDTDDLFKTNLNIETTVVERKLIRKLAELVGTRAARLTVCGVSAICDKRGYKTAHIAADGSVFNRYPGYKEKAAQALKDIYNWDVEKMEDHPIQLVAAEDGSGVGAAIIACLTQKRLAAGKSVGIKGE

SEQ ID NO: 10243 - DNA, 1743 bp, Plasmodium falciparum
  CDS (211)..(1692)
tattatatatatatatttatatatatatatatatatatatatatatattttttttttaaataattgaatttgatccttatatcatatataaatattaggttaagcacataaatttttttattgccttagataaatataggaaaataagaatatctacatatatacatagagtaattatttaccatatacttttctgtatttaatttaaaaatgagtgagtacgatattgcaaaaaatgatgtaacatataccaagttagatacaatagaatgtgatataccaataaatgaagagttatcatggagaattaataaatttgtgaatcagttaagaatatcttattcaacattagaagaatttgtagacaattttgtatatgaattaaagaaaggtttagaagctcatcgtaaacatccaaatttatggattcctcatgagtgtagttttaagatgttggattcatgtattgctaatattcctactggtcaagagaagggtacatattatgctatagatttcggtggtactaattttcgagctgtaagagcttcattagatggaaaaggaaaaataaagagagatcaagaaacatatagtttaaaatttacaggatcctattctcatgagaaaggtttattagataagcatgcaacagcatcacaattatttgatcattttgctgaaagaattaaatatattatgggggaatttaatgatttagataataaagaagtgaagagtgttggatttaccttttctttcccttgtacatcaccttcaattaattgttcaattcttattgattggacaaagggatttgaaacaggtagagctacgaatgatccagtagaaggtcgtgacgtatgtaaattaatgaatgatgcttttgtaagagctgctattccagcgaaagtatgttgtgtattgaatgatgctgttggtactcttatgtcatgtgcatatcaaaaaggtagaggtaccccaccatgttatataggtattatattaggtactggttctaatggttgttattatgaacctgaatggaagaaatataagtatgctggaaaaattataaatatcgaatttggtaattttgataaagatttacctacatcacccatcgatttagttatggattggtattcagctaatcgtagtagacaattgtttgaaaaaatgatatctggtgcttacttaggtgaaatcgtaagaagatttatggtaaatgttttacaaagtgcatgttctaaaaagatgtggattagtgatagtttcaattcagaatctggtagtgttgtattaaatgatacttcaaaaaattttgaagatagtaggaaagttgctaaggctgcttgggatatggattttactgatgaacaaatttatgtcttacgtaaaatttgtgaagctgtatataatagatctgcagctcttgctcgtggtactatagctgctatagctaaaagaatcaaaattattgaacattctaaatttacttgtggtgttgatggctccttatttgttaaaaatgcttggtattgtaaaagattacaagaacatttaaaagttatcttagctgacaaagctgaaaatttaattattattccagcagatgatggttcaggaaagggagcagccatcacagcagcagtcatcgcattaaatgcggacattccacaattaccataaattataataatatatatatatatatatatatatgtatatatttgtatataa

SEQ ID NO: 10244 - protein, 493 aa, Plasmodium falciparum
MSEYDIAKNDVTYTKLDTIECDIPINEELSWRINKFVNQLRISYSTLEEFVDNFVYELKKGLEAHRKHPNLWIPHECSFKMLDSCIANIPTGQEKGTYYAIDFGGTNFRAVRASLDGKGKIKRDQETYSLKFTGSYSHEKGLLDKHATASQLFDHFAERIKYIMGEFNDLDNKEVKSVGFTFSFPCTSPSINCSILIDWTKGFETGRATNDPVEGRDVCKLMNDAFVRAAIPAKVCCVLNDAVGTLMSCAYQKGRGTPPCYIGIILGTGSNGCYYEPEWKKYKYAGKIINIEFGNFDKDLPTSPIDLVMDWYSANRSRQLFEKMISGAYLGEIVRRFMVNVLQSACSKKMWISDSFNSESGSVVLNDTSKNFEDSRKVAKAAWDMDFTDEQIYVLRKICEAVYNRSAALARGTIAAIAKRIKIIEHSKFTCGVDGSLFVKNAWYCKRLQEHLKVILADKAENLIIIPADDGSGKGAAITAAVIALNADIPQLP

SEQ ID NO: 10245 - DNA, 2757 bp, Bos primigenius taurus (cattle)
  CDS (1)..(2757)
atgatcgccgcgcaactactggcctactacttcacggaactgaaggatgaccaagtcaaaaagattgacaagtatctctatgccatgcggctctctgatgaaactctgttagatatcatgaatcgtttcaaaaaggagatgaagaatggcctctcccgggattttaatccgacagccacagtcaagatgttgccaacgtttgtaaggtctatcccggatggctcagaaaagggagatttcatcgccctggatcttggcggatcttccttccgaattctgcgggtgcaggtgaatcacgagcagaacaggcctgttcatatggagtctgaggtttacgacaccccggagaacatcatgcatggcagtggaagccagctttttgatcacgtgcttgagtgcctgggagactttatggagaaaaaaaaaatcaaggacaagaaattacctgttggattcaccttttccttcccctgtcggcaatccaagatagaccaggccatcctgatcacctggacaaagagatttaaagcaagaggcgctgaagggaactatgtggtgaagctgcttgacaaagccatcaaaaagcgtggggactatgatgccaacattgttgctgtggtcaacgatacggtggggaccatgatagactgcggttatgatgaccaacactgtgaagtgggcctaatcattggcacaggcacgaatgcttgctacatggaggaactgcgacagatcgactttggttggggcgacgatgggagaatgtgtattaacacggaatggggagacttaggggatgatggctcattagaagacatccgcaaggaattcgacagggagttcaggcgaggatccctcaaccctgggaaacagcgttttgagaagatggtcagtggaaggtacatggaggacgtggttcgactagtcctagtaaagatggccaaggagggcctcttatttgaagggcggatcacccccgagctgctcacccgagggaagtttaacaccagtgatgtgtcagccatcgaaaaagataaggaaggcctccacaatgccaaagaaatcctgacccgtttgggagtggagaggtcggatgatgactgtgtctcagtccagcacgtttgcaccattgtctcatttcgctcagccaacctggtggctgccacactgggcgccatcttgaaccgcctgcgtgataacaagagcacacccaggctgcgaaccacggttcgtgtcgacggatctctttacaagacgcacccacagtattcccggcgtttccacaagactctaaggcgcttggtgccagactccgatgtgcgcttcctcctctcagaaagtgggacgggcaagggggctgcaatggtgacggccgtggcgtaccggctggctgaacagcaccgccagatcgaagaaactctggcccactttcgcctgagcaaacagacgctgatggaagttaagaaaaggctacggaccgagatggaaatggggcttaggaaggagacaaacagcaacgctactgttaacatgctgccttccttcctccggagcatccccgacgggaccgaagatggtgacttccttgccctggatcttggaggaaccaatttccgtgtgctgctggtgaaaatccgtagtgggaaaaagagcacggtggaaatgcacaacaagatctaccgaattcctattgaaatcatgcagggcactggggaagagctgtttgatcacattgtctcctgcatctctgacttccttgactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcggtaaaaaggagagaggaatttgacctggacgtggtggctgtggtcaacgacacagtgggcaccatgatgacctgtgcttatgaggagcccacctgtgaggttggactcattgttgggacgggcagcaatgcttgctacatggaggagatgaagaacgtggagatggtggaggggaaccagcgtcagatgtgcattaacatggagtggggtgcttttggggacaacggttgttcggatgatataagaacagactttgacaaagtggtggacgaatattctctgaactctgggaaccaaaggtttgagaatatgattagcgggatttacctgggtgaaatcgtacgcaacatcctaattgacttcaccaagaagggattcctcttccgagggcagatctctgaaccgctgaagacccgtggcatctttgagaccaagtttctctctcagatcgagagtgaccgattagcactgctccaggtccgggctatcctacagcagctaggtctgaatagcacctgcgatgacagtatcctcgtcaagacagtgtgtggggtggtgtccaagagggcggcacagctgtgtggggccgggatggctgccgtggtggaaaagatccgagagaacagagggctggaccgcctcaacgtgactgtgggcgtggacgggacgctctacaagcttcatccgcagttctccagaatcatgcaccaaaccgtgaaggaactgtcaccaaagtgtaatgtgtccttcctcctgtctgaggatggcagcggcaagggggccgcccttatcactgccgtgggcgtgcggctgcgaggagagagcgccataagctaa

SEQ ID NO: 10246 - protein, 918 aa, Bos primigenius taurus (cattle)
MIAAQLLAYYFTELKDDQVKKIDKYLYAMRLSDETLLDIMNRFKKEMKNGLSRDFNPTATVKMLPTFVRSIPDGSEKGDFIALDLGGSSFRILRVQVNHEQNRPVHMESEVYDTPENIMHGSGSQLFDHVLECLGDFMEKKKIKDKKLPVGFTFSFPCRQSKIDQAILITWTKRFKARGAEGNYVVKLLDKAIKKRGDYDANIVAVVNDTVGTMIDCGYDDQHCEVGLIIGTGTNACYMEELRQIDFGWGDDGRMCINTEWGDLGDDGSLEDIRKEFDREFRRGSLNPGKQRFEKMVSGRYMEDVVRLVLVKMAKEGLLFEGRITPELLTRGKFNTSDVSAIEKDKEGLHNAKEILTRLGVERSDDDCVSVQHVCTIVSFRSANLVAATLGAILNRLRDNKSTPRLRTTVRVDGSLYKTHPQYSRRFHKTLRRLVPDSDVRFLLSESGTGKGAAMVTAVAYRLAEQHRQIEETLAHFRLSKQTLMEVKKRLRTEMEMGLRKETNSNATVNMLPSFLRSIPDGTEDGDFLALDLGGTNFRVLLVKIRSGKKSTVEMHNKIYRIPIEIMQGTGEELFDHIVSCISDFLDYMGIKGPRMPLGFTFSFPCQQTSLDAGILITWTKGFKATDCVGHDVVTLLRDAVKRREEFDLDVVAVVNDTVGTMMTCAYEEPTCEVGLIVGTGSNACYMEEMKNVEMVEGNQRQMCINMEWGAFGDNGCSDDIRTDFDKVVDEYSLNSGNQRFENMISGIYLGEIVRNILIDFTKKGFLFRGQISEPLKTRGIFETKFLSQIESDRLALLQVRAILQQLGLNSTCDDSILVKTVCGVVSKRAAQLCGAGMAAVVEKIRENRGLDRLNVTVGVDGTLYKLHPQFSRIMHQTVKELSPKCNVSFLLSEDGSGKGAALITAVGVRLRGESAIS

SEQ ID NO: 10247 - DNA, 1528 bp, Arabidopsis thaliana (mouse-ear cress)
  CDS (1)..(1497)
atggggaaagtggcggttgcgtttgcggcggttgctgttgttgcggcttgttctgttgccgcggtgatggttgggaggaggatgaagagtcggaggaaatggaggactgttgttgagattttgaaagagttggaggatgattgtgatactccggttgggaggttgaggcaagtggttgatgctatggccgtggagatgcacgctggtttggcttctgaaggtggctctaagcttaaaatgctcctcactttcgtcgatgatttgcccactgggagggagaaaggtacttattatgcacttcaccttggaggcacttattttaggattttaagggttcttctgggtgatcaaaggtcttatctagatgttcaagatgttgaacgacacccaataccttcacatttgatgaatagcaccagcgaggttcttttcaactttctcgccttttccttggaaaggtttattgaaaaggaggaaaacgggtccgattcacaaggtgttagaagggaacttgcatttacgttctcattccctgtcaagcatacttctatttcttcaggagttctaattaaatggaccaaaggttttgagattagtgaaatggttgggcaagatatagctgaatgtctacaaggagctctgaacagaagaggcctagatatgcatgttgcggctcttgtgaatgatactgttggagccttgtcgcttggatattatcacgatccagatacggttgttgcggttgtatttggaacaggtagtaatgcatgttacttggaaagaaccgatgccataatcaagtgtcagggtctgcttacaacttctggaagcatggtggtaaatatggagtggggaaatttttggtcctctcatttgcctagaacttcgtatgacattgacttggatgcagagagttcaaatgcaaatgatatgggatttgagaagatgatatcaggaatgtatctgggtgacattgttcgtagagtaattctccgcatgtcagaagattctgatatctttggacccatctcgcccgtgttatctgagccttacgttctaagaacaaattcagtctcagccatacatgaagatgacacacctgagttacaagaagtagcaagaatcttgaaagacataggggtatcagatgtaccactgaaggtgagaaaactagtggtgaaaatatgcgatgtggttacacgaagagcagggaggcttgcagcagcaggaatagcaggaatcttgaagaagataggccgagatggaagcgggggaatcacgagcgggagaagcagaagtgaaatccaaatgcagaaaagaacagttgttgcggtagaaggaggtttgtacatgaattacaccatgtttagggaatacatggaagaagctctcgtagagatactaggagaagaagtgagtcaatacgtggtggttaaagccatggaagatggttctagcattggctctgctctcctcgttgcctctttacagtcatgaatcatcatcgtcgtcgttcgtattaaatggt

SEQ ID NO: 10248 - protein, 498 aa, Arabidopsis thaliana (mouse-ear cress)
MGKVAVAFAAVAVVAACSVAAVMVGRRMKSRRKWRTVVEILKELEDDCDTPVGRLRQVVDAMAVEMHAGLASEGGSKLKMLLTFVDDLPTGREKGTYYALHLGGTYFRILRVLLGDQRSYLDVQDVERHPIPSHLMNSTSEVLFNFLAFSLERFIEKEENGSDSQGVRRELAFTFSFPVKHTSISSGVLIKWTKGFEISEMVGQDIAECLQGALNRRGLDMHVAALVNDTVGALSLGYYHDPDTVVAVVFGTGSNACYLERTDAIIKCQGLLTTSGSMVVNMEWGNFWSSHLPRTSYDIDLDAESSNANDMGFEKMISGMYLGDIVRRVILRMSEDSDIFGPISPVLSEPYVLRTNSVSAIHEDDTPELQEVARILKDIGVSDVPLKVRKLVVKICDVVTRRAGRLAAAGIAGILKKIGRDGSGGITSGRSRSEIQMQKRTVVAVEGGLYMNYTMFREYMEEALVEILGEEVSQYVVVKAMEDGSSIGSALLVASLQS

SEQ ID NO: 10249 - DNA, 1401 bp, Homo sapiens (man)
  CDS (1)..(1401)
atggcgatggatgtcacaaggagccaggcccagacagccttgactctggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtga

SEQ ID NO: 10250 - protein, 466 aa, Homo sapiens (man)
MAMDVTRSQAQTALTLVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 10251 - DNA, 1335 bp, Treponema pallidum subsp. pallidum (syphilis spirochete)
  CDS (1)..(1335)
atggatcagcatacacgtacacgcgatcttgtttctgcattttttgggcgctttcactttgatgtccagggaccttccgtccgcacggttgtcgacgtgttgcgcgcagatatggtgcgcggcttagaggaagaggcgcagcttcctccccgtatggggagtgcacttgcgatgattcccacttgggtggcgcccccccgtgtatccccctgcaaccgacgcgtgatagttatcgacgctggaggaaccaactttcgctcgtgcctcgtacgcttcggcgacagtggcacacctcacatcgagaatttagaaaaacgtcccatgcccggtaccacccgtgagtactcaaggacagagttttttggagaaattgcagacaacctggcacgtctgaaaggtgcagcggactgcattggcttttgtttctcttaccctattcgtatcagacctgacggtgacggtgaggttattcagtttgcgaaggaaatcaaagctgctgaggtcatcggcacgtgtgtcggtgctggtttgacagaagcgctaagtgctcggaactggcctgaactccgttctctcaaaatgctcaatgacgcaacgagtgcgctgcttgcaggtttttttgcggcaccagaggggtgttcgttcagttcatacgtaggttttattcttggcactggaatgaattctgcgtatctggagccagaccctattcctaaaattcctgcgcatcacacacctcaggtggtagtgtgcgaatcgggaaaaagcaacaaagtaccgcgcagtgtctttgacgaattattcactcaaactactgccgagccggatattgcacacctagagaagatgtcctcgggcacctacctcggtccccttgcttccgttgtcgtgcggcttgcggcacaagaaggtcttttctcacacgcagtacacgctgcactcagtacggtttcctttacactcgtggatatggatcgttttttatttgctccctctgtgtccaccaccacgttgggcgcgttgctcgcaccgggcaccgacacagaccgagagattctctttcttttgctcgatgcggtagttgcacgtgcagcacgcatcgctgcgggagtaatcgccgcctcagtattaaaaagcggtgctgggtatgatccgcttcgtcccgtgtgcgtgctcgcagaaggcaccacgttccaacgcacctaccgcctacgcacccgggttacttcccacctgcaagcctttttgactgaggagcgcggtgtgtatttcgatatcatttcacttgaaaacgccgtaacgctcggctctgcactcggaggactcagttcgtag

SEQ ID NO: 10252 - protein, 444 aa, Treponema pallidum subsp. pallidum (syphilis spirochete)
MDQHTRTRDLVSAFFGRFHFDVQGPSVRTVVDVLRADMVRGLEEEAQLPPRMGSALAMIPTWVAPPRVSPCNRRVIVIDAGGTNFRSCLVRFGDSGTPHIENLEKRPMPGTTREYSRTEFFGEIADNLARLKGAADCIGFCFSYPIRIRPDGDGEVIQFAKEIKAAEVIGTCVGAGLTEALSARNWPELRSLKMLNDATSALLAGFFAAPEGCSFSSYVGFILGTGMNSAYLEPDPIPKIPAHHTPQVVVCESGKSNKVPRSVFDELFTQTTAEPDIAHLEKMSSGTYLGPLASVVVRLAAQEGLFSHAVHAALSTVSFTLVDMDRFLFAPSVSTTTLGALLAPGTDTDREILFLLLDAVVARAARIAAGVIAASVLKSGAGYDPLRPVCVLAEGTTFQRTYRLRTRVTSHLQAFLTEERGVYFDIISLENAVTLGSALGGLSS

SEQ ID NO: 10253 - DNA, 1458 bp, Saccharomyces cerevisiae
  CDS (1)..(1458)
atggttcatttaggtccaaagaaaccacaggctagaaagggttccatggctgatgtgcccaaggaattgatggatgaaattcatcagttggaagatatgtttacagttgacagcgagaccttgagaaaggttgttaagcactttatcgacgaattgaataaaggtttgacaaagaagggaggtaacattccaatgattcccggttgggtcatggaattcccaacaggtaaagaatctggtaactatttggccattgatttgggtggtactaacttaagagtcgtgttggtcaagttgagcggtaaccatacctttgacaccactcaatccaagtataaactaccacatgacatgagaaccactaagcaccaagaggagttatggtcctttattgccgactctttgaaggactttatggtcgagcaagaattgctaaacaccaaggacaccttaccattaggtttcaccttctcgtacccagcttcccaaaacaagattaacgaaggtattttgcaaagatggaccaagggtttcgatattccaaatgtcgaaggccacgatgtcgtcccattgctacaaaacgaaatttccaagagagagttgcctattgaaattgtagcattgattaatgatactgttggtactttaattgcctcatactacactgacccagagactaagatgggtgtgattttcggtactggtgtcaacggtgctttctatgatgttgtttccgatatcgaaaagttggagggcaaattagcagacgatattccaagtaactctccaatggctatcaattgtgaatatggttccttcgataatgaacatttggtcttgccaagaaccaagtacgatgttgctgtcgacgaacaatctccaagacctggtcaacaagcttttgaaaagatgacctccggttactacttgggtgaattgttgcgtctagtgttacttgaattaaacgagaagggcttgatgttgaaggatcaagatctaagcaagttgaaacaaccatacatcatggatacctcctacccagcaagaatcgaggatgatccatttgaaaacttggaagatactgatgacatcttccaaaaggactttggtgtcaagaccactctgccagaacgtaagttgattagaagactttgtgaattgatcggtaccagagctgctagattagctgtttgtggtattgccgctatttgccaaaagagaggttacaagactggtcacattgccgctgacggttctgtctataacaaatacccaggtttcaaggaagccgccgctaagggtttgagagatatctatggatggactggtgacgcaagcaaagatccaattacgattgttccagctgaggatggttcaggtgcaggtgctgctgttattgctgcattgtccgaaaaaagaattgccgaaggtaagtctcttggtatcattggcgcttaa

SEQ ID NO: 10254 - protein, 485 aa, Saccharomyces cerevisiae
MVHLGPKKPQARKGSMADVPKELMDEIHQLEDMFTVDSETLRKVVKHFIDELNKGLTKKGGNIPMIPGWVMEFPTGKESGNYLAIDLGGTNLRVVLVKLSGNHTFDTTQSKYKLPHDMRTTKHQEELWSFIADSLKDFMVEQELLNTKDTLPLGFTFSYPASQNKINEGILQRWTKGFDIPNVEGHDVVPLLQNEISKRELPIEIVALINDTVGTLIASYYTDPETKMGVIFGTGVNGAFYDVVSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFENLEDTDDIFQKDFGVKTTLPERKLIRRLCELIGTRAARLAVCGIAAICQKRGYKTGHIAADGSVYNKYPGFKEAAAKGLRDIYGWTGDASKDPITIVPAEDGSGAGAAVIAALSEKRIAEGKSLGIIGA

SEQ ID NO: 10255 - DNA, 2442 bp, Rattus norvegicus (Norway rat)
  CDS (109)..(1605)
gcctatcttttgcaacactcagccagacagtcctcacctgcaacaggtggcctcaggagtcaggaacatctctacttccccaacgacccctgggttgtcctctcagagatggctatggatactacaaggtgtggagcccagttgttgactctgggcaccaacaaatgcacgaatgcatgctccctgctgtgcagagcgggtactcacaacgggcacatgaaccctcgctgccgaacagagcaggcggccgccacacagctgcccacctgcagagtccagctactcttgaactatcatgtggagggtcgagcagatcctggcagagttccagctgcaggaggaagacctgaagaaggtgatgagccggatgcagaaggagatggaccgtggcctgaggctggagacccacgaggagaagtcggagactttctctccttagacctgggaggaaccaacttcagagtgatgctggtcaaagtgggagagggggaggcagggcagtggagcgtgaagacaaaacaccagatgtactccatccccgaggacgccatgacgggcactgccgagatgctctttgactacatctctgaatgcatctctgacttccttgacaagcatcagatgaagcacaagaaactgcccctgggcttcaccttctccttccctgtgaggcacgaagacctagacaagggcatcctcctcaattggaccaagggcttcaaggcctctggagcagaagggaacaacatcgtaggacttctccgagatgctatcaagaggagaggggactttgagatggatgtggtggcaatggtgaacgacacagtggccacaatgatctcctgctactatgaagaccgccaatgtgaggtcggcatgattgtgggcactggctgcaatgcctgctacatggaggaaatgcagaatgtggagctggtggaaggggatgagggacgcatgtgcgtcaacacggagtggggcgccttcggggactcgggcgagctggatgagttcctactggagtatgaccggatggtggatgaaagctcagcgaaccccggtcagcagctgtacgagaagatcatcggtgggaagtatatgggcgagctggtacgacttgtgctgcttaagctggtggacgagaaccttctgttccacggagaggcctcggagcagctgcgcacgcgtggtgcttttgagacccgtttcgtgtcacaagtggagagcgactccggggaccgaaagcagatccacaacatcctaagcactctggggcttcgaccctctgtcaccgactgcgacattgtgcgccgtgcctgtgaaagcgtgtccactcgcgccgcccatatgtgctccgcaggactagctggggtcataaatcgcatgcgcgaaagccgcagtgaggacgtgatgcgcatcactgtgggcgtggatggctccgtgtacaagctgcacccgagcttcaaggagcggtttcacgccagtgtgcgcaggctgacacccaactgcgaaatcaccttcatcgaatcagaggagggcagcggcaggggagccgcgctggtctctgcggtggcctgcaagaaggcttgcatgctggcccagtgaaatccaggtcatatggaccgggacctgggttccacggggactccacacaccacaaatgctcccagcccaccggggcaggagacctattctgctgctacccctggaaaatggggagaggcccctgcaagccgagtcggccagtgggacagccctagggctctcagcctggggcagggggctgggaggaagaagaggatcagaggcgccaaggcctttcttgctagaatcaactacagaaaatggcggaaaatactcaggacttgcactttcacgattcttgcttcccaagcgtgggtctggcctcccaagggaatgcttcctggaccttgcaatggcctggcttccctgggggggacacaccttcatggggaggtaacttcagcagttcggccagaccagaccccaggagagtaagggctgctagtcacccagacctggctgttttcttgtctgtggctgaagaggccggggagccatgagagactgactatccggctacatggagaggactttccaggcatgaacatgccagagactgttgccttcatatacctccacccgagtggcttacagttctgggatgaaccctcccaggagatgccagaggttagagccccagagtccttgctctaaggggaccagaaaggggaggcctcactctgcactattcaagcaggaatcatctccaacactcaggtccctgacccaggaggaagaagccaccctcagtgtccctccaagagaccacccaggtccttctctccctcgttcccaaatgccagcctctctacctgggactgtgggggagtttttaattaaatatttaaaactacttca

SEQ ID NO: 10256 - protein, 498 aa, Rattus norvegicus (Norway rat)
MAMDTTRCGAQLLTLGTNKCTNACSLLCRAGTHNGHMNPRCRTEQAAATQLPTCRVQLLLNYHVEGRADPGRVPAAGGRPEEGDEPDAEGDGPWPEAGDPRGEVGDFLSLDLGGTNFRVMLVKVGEGEAGQWSVKTKHQMYSIPEDAMTGTAEMLFDYISECISDFLDKHQMKHKKLPLGFTFSFPVRHEDLDKGILLNWTKGFKASGAEGNNIVGLLRDAIKRRGDFEMDVVAMVNDTVATMISCYYEDRQCEVGMIVGTGCNACYMEEMQNVELVEGDEGRMCVNTEWGAFGDSGELDEFLLEYDRMVDESSANPGQQLYEKIIGGKYMGELVRLVLLKLVDENLLFHGEASEQLRTRGAFETRFVSQVESDSGDRKQIHNILSTLGLRPSVTDCDIVRRACESVSTRAAHMCSAGLAGVINRMRESRSEDVMRITVGVDGSVYKLHPSFKERFHASVRRLTPNCEITFIESEEGSGRGAALVSAVACKKACMLAQ

SEQ ID NO: 10257 - DNA, 3027 bp, Rattus norvegicus (Norway rat)
  CDS (81)..(2855)
gtcgtcttatttgggagctgagacttgaggaaggtgataacttctgaatccccccaggtagtcaataccattgtggaaacatggccgccattgagccttctggtctgcacccgggagaaagagactcaagctgcccccaggagggcattccaaggccctcaggtagcttagaactggcacaggaatacttgcaacaattcaaggtgaccatgacacagctgcagcagatccaagccagtcttctgtgttccatggagcaggcgctgaagggacaggacagtcccgctccttctgtccggatgttgcccacatacgtgaggtccacaccacatggcaccgagcaaggagacttcctggtgctggagctgggggccacaggagcctcactacgtgtgttgtgggtaacactgacgggcaccaaggaacacagcgtggagaccaggagccaggagtttgtgatccctcaagaggtgatcctaggtgctggccagcagctctttgactttgctgcccgctgcctctctgaattcctggatgcataccccgtggagaatcagggtctgaagcttgggtttaatttctcttttccttgtcaccagacaggcttggacaagagcaccctcatttcctggacaaaaggttttaggtgcagtggtgtggaaggccaggatgtggtccagttgctaagggatgccattcagaggcaggggacctacaatattgatgtggtagccatggtgaatgacacagtgggtaccatgatgggctgtgagctgggcaccaggccatgtgaagtcgggcttattgtagacactggtaccaatgcctgttatatggaggaagcgaggcacgtggcagctctggatgaggaccgcggccgtacctgtgtcagcatcgagtggggctccttctatgacgaagaggccctagggccagtactgaccaccttcgacgatgccctggaccacgagtccctggttcctggtgctcagaggtttgagaagatgattggtggcctttacttgggtgagctggtaaggctggtgctggtccacttgtcccagcatggggtcctctttggtggctgcgcctctcctgcgttgctgagtcaaaacagcatcctcctggaacatgtggccaaaatggaggaccctgccactgggatagcccacgtccacacagtcctgcagggcttgggtctgagccctcaggcctcagatgctgagctcgtgcagcgcgtgtgcatggctgtgtgcacgcgagctgcccagctctgtgcctctgccctggctgcagtcctatcccgcctccagcacagcagggagcagcagacactgcacgtggccgtggccactggagggcgagtgttcgaatggcaccccaggttcctctgcatcctaaaggagacggtaatgctcttggccccagagtgtgatgtctccttcatcccctctgtggatggtggtggccggggtgtggcaatggtgactgctgtggcagcccgcctggctacccacaggcgcatcctggaagagaccctggcaccatttcagctgagcttggagcagctgacagcggtgcaggcacaaatgcgggaagccatgatcagggggcttcaaggagagagctcctccctccgcatgctgcccacttacgtccgagcaacgcccgatggcagcgaacgaggtgacttcctggctttggacctagggggcaccaacttccgtgtcctgttggtacgcgtggccgagggcagtgttcagatcaccaaccaggtctactctattcctgagtatgtagcccagggctctggacagaagctctttgatcatattgtggactgcatcgtggacttccagaagaggcaaggccttagcggacagagcctacccctgggtttcaccttctcttttccttgcaagcagcttggcctggaccagggcatcctcctcaactggactaaggggttcaatgcatcaggctgcgagggccaagatgttgtgtatttattacgggaagccattaggcgcagacaggcagtggagctgaatgtggttgccattgtcaatgacacggtggggaccatgatgtcctgtggctatgatgatccctgttgtgagatgggcctcattgtcggaaccggtaccaacgcctgctatatggaagaactccggaatgtggcgagtgtgcccggggactcaggccacatgtgtatcaacatggagtggggtgcctttggggatgacggctcactgagcatgctcggcacctgctttgatgctagcgtggaccaggcatccatcaacccaggcaaacagaggtttgagaaaatgatcagcggaatgtacctgggggagatcgtccgccatatcctcctgcacttaaccagtcttggagttctcttccggggccagaagacgcaatgccttcagaccagggacatctttaagaccaagtttctctccgagattgagagcgacagcctggccctgcgtcaggtccgagccatcctggaggacctggggctgactctgacgtctgatgatgccttgatggtcctagaggtgtgccaggctgtgtcccgcagggccgcccaactctgcggggcaggtgtggctgcagtggtggaaaagatacgggagaaccggggcctgcaggagctgacagtgtctgtgggagtggatgggacgctctacaagctacatccccacttctccaggctggtgtcagtgacagttcggaagctagcccctcagtgcacagtcacctttttgcaatcggaggatgggtctgggaaaggggcagcgttggtcactcgtgtcgcttgccgcctgacccagatggcctgcgtttgaggaaaatctccaaagagcaattgggatctccctggactaaggattcagcccacacggaccctctggcgggcccagccacccacaactcccaaagaaacccacgggtggtgccctcataactgtccgcccacacccaatggctttctgagagaagcaccactctggttagcaa

SEQ ID NO: 10258 - protein, 924 aa, Rattus norvegicus (Norway rat)
MAAIEPSGLHPGERDSSCPQEGIPRPSGSLELAQEYLQQFKVTMTQLQQIQASLLCSMEQALKGQDSPAPSVRMLPTYVRSTPHGTEQGDFLVLELGATGASLRVLWVTLTGTKEHSVETRSQEFVIPQEVILGAGQQLFDFAARCLSEFLDAYPVENQGLKLGFNFSFPCHQTGLDKSTLISWTKGFRCSGVEGQDVVQLLRDAIQRQGTYNIDVVAMVNDTVGTMMGCELGTRPCEVGLIVDTGTNACYMEEARHVAALDEDRGRTCVSIEWGSFYDEEALGPVLTTFDDALDHESLVPGAQRFEKMIGGLYLGELVRLVLVHLSQHGVLFGGCASPALLSQNSILLEHVAKMEDPATGIAHVHTVLQGLGLSPQASDAELVQRVCMAVCTRAAQLCASALAAVLSRLQHSREQQTLHVAVATGGRVFEWHPRFLCILKETVMLLAPECDVSFIPSVDGGGRGVAMVTAVAARLATHRRILEETLAPFQLSLEQLTAVQAQMREAMIRGLQGESSSLRMLPTYVRATPDGSERGDFLALDLGGTNFRVLLVRVAEGSVQITNQVYSIPEYVAQGSGQKLFDHIVDCIVDFQKRQGLSGQSLPLGFTFSFPCKQLGLDQGILLNWTKGFNASGCEGQDVVYLLREAIRRRQAVELNVVAIVNDTVGTMMSCGYDDPCCEMGLIVGTGTNACYMEELRNVASVPGDSGHMCINMEWGAFGDDGSLSMLGTCFDASVDQASINPGKQRFEKMISGMYLGEIVRHILLHLTSLGVLFRGQKTQCLQTRDIFKTKFLSEIESDSLALRQVRAILEDLGLTLTSDDALMVLEVCQAVSRRAAQLCGAGVAAVVEKIRENRGLQELTVSVGVDGTLYKLHPHFSRLVSVTVRKLAPQCTVTFLQSEDGSGKGAALVTRVACRLTQMACV

SEQ ID NO: 10259 - DNA, 1870 bp, Schwanniomyces occidentalis
  CDS (186)..(1622)
tgagcccgcgcttcgatatgctgacagtgtccgaatttctttgtgacatcacaccatcaacgaagtagaaccaagtagtaatttcgtatataaatatttaaatttaccaaacatttgtctaaagaaaaattttaattcaattatattaaaatttctaattagatttattacacattaagcacaaaatggttcacttaggtccaaaacctccacaacatagaaaaggatccttcttggatgttcctgaatatttgttgaaggaattgacagaactcgaaggattattaacagtttcaggtgaaacattaaggaagattactgatcactttatttcagaattggaaaaaggtttatctaaacaagggggaaatattcctatgattccaggatgggttatggacttcccaacaggaaaagaaatgggtgattacttggctattgatttaggtggtactaatttgagagttgttttagttaagttaggtggtaacagggactttgacactactcaatccaagttcgcattgccagaaaacatgagaactgccaagtctgaagagttatgggaatttattgctgagtgtttacaaaagttcgtggaagaagaatttcgaaatggtgttctgtcaaatttaccattaggtttcaccttttcatacccagcatctcaaggttctatcaatgaagggtatttgcaaagatggaccaaaggtttcgacattgaaggtgttgagggacacgatgttgttccaatgttacaagctgcaattgaaaaacgtaaggttccaattgaagttgttgcgttaatcaatgacaccacaggtactttagttgcttctatgtacaccgatccagaagctaaaatgggtttattttccggtactggttgtaatggtgcttactacgatgttgtcgataacattccaaaattagaaggaaaggttccagatgacattaaaagctcttccccaatggccatcaactgtgaatacggtgctttcgataatgagcatatcattttgcctagaactaaatacgatatccaaatcgatgaagaatcaccaagaccaggacaacaggctttcgaaaagatgatctctggttactacttaggtgaagttttaagattgattttacttgatttaacctctaaacaattaattttcaaagaccaagatttgtctaaattacaagttccattcattttagatacctcaatcccagctagaattgaagaagatccgtttgaaaacttatctgatgtccaagaattatttcaagaaattttaggtattcaaactacttctccagaaagaaaaatcatccgtcgtctagcggaattgatcggtgaaagatcagccagattatcaatttgtggtattgctgctatttgcaagaagagaggctacaaaaccgctcattgtgccgctgatggttcagtctacaacaaatacccaggtttcaaagaaagagctgctaaaggtttgagagatatctttcaatgggaatctgaagaagatccaattgtcattgtgcctgcagaagatggtttaggtgcaggtgccgctatcattgctgcattgactgaaaaaagattaaaggatggattaccgttggtatgaagaaaactaatgattacgattgaaattctaaaaatgctttcgttcaatttctggatgtcaatttactagctggtttattacttcattgtattaacttttttacttctttatatctaatccttgtaagaatgtttcgacgataaagttttataaaattatcgaatgactttaaatataaatgatttctattttgcatattgatagtagagtacagatatagaaattagcttttaccataagacaagctt

SEQ ID NO: 10260 - protein, 478 aa, Schwanniomyces occidentalis
MVHLGPKPPQHRKGSFLDVPEYLLKELTELEGLLTVSGETLRKITDHFISELEKGLSKQGGNIPMIPGWVMDFPTGKEMGDYLAIDLGGTNLRVVLVKLGGNRDFDTTQSKFALPENMRTAKSEELWEFIAECLQKFVEEEFRNGVLSNLPLGFTFSYPASQGSINEGYLQRWTKGFDIEGVEGHDVVPMLQAAIEKRKVPIEVVALINDTTGTLVASMYTDPEAKMGLFSGTGCNGAYYDVVDNIPKLEGKVPDDIKSSSPMAINCEYGAFDNEHIILPRTKYDIQIDEESPRPGQQAFEKMISGYYLGEVLRLILLDLTSKQLIFKDQDLSKLQVPFILDTSIPARIEEDPFENLSDVQELFQEILGIQTTSPERKIIRRLAELIGERSARLSICGIAAICKKRGYKTAHCAADGSVYNKYPGFKERAAKGLRDIFQWESEEDPIVIVPAEDGLGAGAAIIAALTEKRLKDGLPLV

SEQ ID NO: 10261 - DNA, 1634 bp, Schizosaccharomyces pombe
  CDS (183)..(1550)
aacacttttcgcctcacttgcgaatctacgaaaggaatatataggtggttcaccccttttcttttcatttcgtgtttttaatagttatttacatcaacagagataactatttctgttaacgattttttttcccacttgttttcttccttttttggtgaattttaattaatttataataagcaatggaggctaattttcaacaagctgttaaaaagttagtcaatgactttgaataccctaccgagtccttgagagaggccgttaaggagtttgacgaattacgtcaaaagggtttacaaaagaatggtgaggtgcttgctatggctcctgcctttatctctacccttcccaccggcgctgaaactggtgacttcttggcccttgactttggtggtaccaacttgcgtgtttgttggatccaacttctcggtgacggcaagtatgagatgaagcacagcaagtccgtcttgccccgtgaatgcgttcgtaacgagtctgttaagcccatcattgactttatgagtgaccatgttgagcttttcatcaaggagcacttcccttccaagtttggctgccctgaggaggaataccttcctatgggtttcaccttttcttatcccgccaaccaagtttccatcaccgagagctacttgcttcgttggaccaagggtcttaacattcctgaggccatcaacaaggactttgcccaatttttgactgaaggtttcaaggctcgtaaccttcctattagaatcgaggctgtcatcaacgataccgtcggtactctcgttacccgtgcttatacttcaaaggagagcgacacctttatgggtatcattttcggaaccggtaccaacggtgcttacgtcgagcaaatgaaccaaattcccaagcttgctggcaagtgtactggtgatcatatgcttatcaacatggaatggggagcaactgatttctcttgccttcactccactcgttatgatttacttcttgatcatgatactcccaatgctggtcgtcaaatctttgagaagcgcgttggtggtatgtatctcggtgagcttttccgccgtgccttattccacttgatcaaggtttacaacttcaacgaaggtattttccctccttccattactgatgcttggtctttggaaacttctgttctttccagaatgatggttgaacgttctgctgagaatgttcgtaacgttcttagtacattcaagttccgtttccgcagcgacgaagaggctttgtacctttgggatgctgctcatgcaattggccgtcgtgctgctcgtatgtctgccgttcccattgcttctttgtatctttctaccggccgcgctggtaagaagagtgatgttggtgttgatggttctttagtcgaacactatcctcactttgttgacatgctccgtgaagccttgcgtgagcttatcggtgataacgaaaaattgatttccattggtattgccaaggatggcagtggtattggtgccgctctttgcgccctccaagctgttaaggaaaagaaaggcttggcctaaatcatgttagatgtctgttagctttttttgaattgtacgtagaaatgagcatgtaaatatgaaattgctttttaacagctttta

SEQ ID NO: 10262 - protein, 455 aa, Schizosaccharomyces pombe
MEANFQQAVKKLVNDFEYPTESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELFRRALFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 10263 - DNA, 1900 bp, Schizosaccharomyces pombe
  CDS (123)..(1577)
ctctaaagttgcttttgaaattttaaagatctttttcttttcctacgtaactccaagtgtcaaggaattgccatcttttcacttcttcctttcttttgtgtatcactactgaagttatcaaaatgtccttgcacgacgcttaccattggccttctcgtacacctagtcgtaagggttcaaatatcaaattgaacaaaactttacaagatcatttggatgaactggaagaacaattcaccattcccactgaacttttacatcgcgttaccgatcgctttgtttctgagctttacaagggcttaaccacgaacccgggtgatgttccaatggtccccacatggatcattggtactcctgatggcaatgagcatggctcttatttggcattagatttaggtggtactaacttgcgtgtttgtgcagttgaggttcaaggcaacggtaaattcgacattactcaaagcaaataccgtctacctcaagaactcaaagttggcactcgtgaggccctctttgattacattgccgactgtatcaagaaatttgtggaagaggttcacccaggtaaaagccaaaatttggaaattggtttcaccttttcttacccctgtgttcaacgctccattaacgatgcttcattagttgcctggactaagggctttgatattgatggcgttgagggtgaaagtgtaggtcctcttttatcagcagccttgaagcgtgttgggtgtaacaacgttagactcaatgccattttgagtgatactactggtacattggttgcttccaactatgccagcccaggtactgagattggtgtcatctttggaactggatgtaatgcttgttacattgaaaagttctcagaaattcctaagcttcataagtatgacttccctgaagatatgaacatgatcatcaactgtgaatggtgcgattttgacaaccagcatgttgtccttcctcgtaccaaatacgatgttgctattgatgaagagtctcccagacccggtcttcaaacgtacgagaaaatgattgctggatgctatttgggtgatatcttgcgtcgtattcttcttgacctttatgaacagggagctctctttaacggtcaggacgttaccaagattcgtgaccccttggccatggatacctctgtgctcagcgctattgaagttgacccctttgagaaccttgatgaaactcaaaccctatttgaggaaacctatggtctcaagaccaccgaagaagagcgtcaattcattcgtcgtgcatgcgaattgattggaactcgttctgcccgtctttctgcgtgtggtgtatgcgcccttgttcgtaaaatgaataagccatctatgattgtaggtactgatggtagtgtctacaacttataccctcgttttaaggatcgtcttgctcaagcatttaaggatatccttggtgaggaaattggcagcaaagttgttaccatccccgccgaagacggtagtggcgtaggtgctgcattggtcagtgctcttgaagccaaaggcaaggccctcacttctgatattcttgccgagcatcttaagaattaagtccactcattgtttttaggttttacggatactcatttgattttgtgtcactgaactccacgaagtgttcgacaaactgttttatactgcactttttatttgtttcatactccatctttttgcgtacaatttgttccagcaatttttatggttacacttttctttgtctactaatcacgtatcagggcgtttttacaaaaaggtgctccacctgataaaatattttcttttttgctctagtgtttctgtggatacgatatctgcctctgattgctagaatactttaaataaaggttagagttttgttataaaaaaaaaaaaaa

SEQ ID NO: 10264 - protein, 484 aa, Schizosaccharomyces pombe
MSLHDAYHWPSRTPSRKGSNIKLNKTLQDHLDELEEQFTIPTELLHRVTDRFVSELYKGLTTNPGDVPMVPTWIIGTPDGNEHGSYLALDLGGTNLRVCAVEVQGNGKFDITQSKYRLPQELKVGTREALFDYIADCIKKFVEEVHPGKSQNLEIGFTFSYPCVQRSINDASLVAWTKGFDIDGVEGESVGPLLSAALKRVGCNNVRLNAILSDTTGTLVASNYASPGTEIGVIFGTGCNACYIEKFSEIPKLHKYDFPEDMNMIINCEWCDFDNQHVVLPRTKYDVAIDEESPRPGLQTYEKMIAGCYLGDILRRILLDLYEQGALFNGQDVTKIRDPLAMDTSVLSAIEVDPFENLDETQTLFEETYGLKTTEEERQFIRRACELIGTRSARLSACGVCALVRKMNKPSMIVGTDGSVYNLYPRFKDRLAQAFKDILGEEIGSKVVTIPAEDGSGVGAALVSALEAKGKALTSDILAEHLKN

SEQ ID NO: 10265 - DNA, 1503 bp, Saccharomyces cerevisiae
  CDS (1)..(1503)
atgtcatttgaaaatttacataaagtcaatgctgaggcattggaagatgcagtggttgagatctgctcctcattgcaggttgatgcagcaaagttggacgaactaacagcgtacttcattgaatgtatggaaaaggggttgaataacacctctgtaggcgaagaaaagacggtggacaagggtctacccatgatccctacatatgtaaccagtttgcccaatgggacggaacgtggtgttttgctggctgcagatttaggtgggactcacttcagagtgtgttctgtgactttgaatggtgacggaacctttgatatgcagcaattgaagtctaagattccggaagaatatctaaatgacaaggatgtcaccagcgaggagctgtttagctacctgggtcgccgtacaagggccttcgttaggaagcatcatcctgagttgttgaagtccacgggggagaacataaaacctttgaaaatgggatttaccttctcatatcccgttgaccaaacctctttgagttccggtactttaatcagatggaccaaaagcttcaagattgaagacacggtcggcaaggatgtcgtgaggttataccaggagcaattagacattcaggggctctctatgattaatgtggtagctttgaccaacgacacggttggcactttcctatcccactgctacacttcaggctctcgtccatcgagtgctggtgagattagcgagcctgtcattggttgtatctttggtactggtactaacggttgctatatggaggatattgaaaacatcaagaagctaccagatgagctcagaacaagactgctgcatgaaggaaaaacccaaatgtgcatcaacatcgaatggggttctttcgacaatgaattgaaacatttgtctgctacaaagtatgacatcgatattgaccaaaaattttctccaaatccaggttaccatctatttgaaaaaagaatttccggcatgtacttgggtgagctgttaaggaacatcctggtggacttgcatgcaaggggcttaatcttgggacagtatcgtaattacgatcaattacctcaccgtttaaagactcctttccaattgtgcagtgaagttctttccaggattgaaatcgatgattcgacaaacttgcgtgaaactgaattgtcgtttttgcagagtttgaggctaccgaccacttttgaagaacgtaaagcaattcaaaatctggtccgttccattacgagaaggtctgcatatctagcagccgttccgattgccgccatcctaatcaagacaaacgctttgaacaaaagatatcacggtgaggtagaaattggttttgacggttatgtcatcgaatactatcctggattcagatccatgctgagacatgctttggcattaagtccaattggcactgagggtgaacgtaagatacatttgcgtctagccaaagatgggtccggtgttggcgcagctttgtgtgctctggtggcataa

SEQ ID NO: 10266 - protein, 500 aa, Saccharomyces cerevisiae
MSFENLHKVNAEALEDAVVEICSSLQVDAAKLDELTAYFIECMEKGLNNTSVGEEKTVDKGLPMIPTYVTSLPNGTERGVLLAADLGGTHFRVCSVTLNGDGTFDMQQLKSKIPEEYLNDKDVTSEELFSYLGRRTRAFVRKHHPELLKSTGENIKPLKMGFTFSYPVDQTSLSSGTLIRWTKSFKIEDTVGKDVVRLYQEQLDIQGLSMINVVALTNDTVGTFLSHCYTSGSRPSSAGEISEPVIGCIFGTGTNGCYMEDIENIKKLPDELRTRLLHEGKTQMCINIEWGSFDNELKHLSATKYDIDIDQKFSPNPGYHLFEKRISGMYLGELLRNILVDLHARGLILGQYRNYDQLPHRLKTPFQLCSEVLSRIEIDDSTNLRETELSFLQSLRLPTTFEERKAIQNLVRSITRRSAYLAAVPIAAILIKTNALNKRYHGEVEIGFDGYVIEYYPGFRSMLRHALALSPIGTEGERKIHLRLAKDGSGVGAALCALVA

SEQ ID NO: 10267 - DNA, 2023 bp, Arabidopsis thaliana (mouse-ear cress)
  CDS (198)..(1688)
cagtgtgagtaatttagatcggtattagatccatcttaggtttctctaatttctctcaattcactccaaaattttgattatttcttctttctggcttgtcaattttagtcatttgtaatccttgcttttgcgatcggaatcgtaaaaatccgatctttcttttagattcgttttgtttttgattccaaatcggaaaaatgggtaaagtagctgttggagcgactgttgtttgcacggcggcggtttgtgcggtggctgttttggttgttcgacgacggatgcagagctcagggaagtggggacgtgttttggctatcctcaaggcctttgaagaggattgtgcgactccgatctcgaaactgagacaagtggctgatgctatgaccgttgagatgcatgctggtcttgcatccgacggtggtagcaaactcaagatgcttatcagctacgttgataatcttccttccggggatgaaaagggtctcttttatgcattggacctaggggggacaaacttccgtgtcatgcgtgtgcttcttggcgggaagcaagagcgtgttgttaaacaagaattcgaagaagtttcgattcctcctcatttgatgactggtggttcagatgagttgttcaattttatagctgaagctcttgcgaagtttgtcgctacagaatgcgaagactttcatcttccagaaggtagacagagggaattaggtttcactttctcgtttcctgttaagcagacttctctgtcctctggtagtctcatcaaatggacaaaaggcttttccatcgaagaagcagttggacaagatgttgttggagcacttaataaggctctggaaagagttggtcttgacatgcgaatcgcagcacttgttaatgataccgttggaacactagccggtggtagatactataacccggatgttgttgctgctgttattttaggcactgggacaaacgcagcctatgttgagcgtgcaaccgcgatccctaaatggcatggtctgcttccaaaatcaggagaaatggttataaacatggaatggggaaacttcaggtcatcacatcttccattaaccgagtttgatcacacgctggatttcgagagtctgaatccaggcgaacagattcttgagaaaatcatttccggtatgtacttgggagagattttgcgaagagttcttctaaagatggctgaagatgctgctttctttggcgatacagtcccatctaagctgagaataccattcatcattaggactcctcacatgtcggctatgcacaacgacacttctccagacttgaagattgttgggagcaagattaaggatatattggaggtccctacaacttctctgaaaatgagaaaagttgtgatcagtctctgcaacatcatagcaacccgaggagctcgtctctctgctgctggaatctatggtattctgaagaaactgggaagagatactactaaagacgaggaggtgcagaaatcggttatagccatggatggtggattgtttgagcattacactcagtttagtgagtgtatggagagctcactaaaagagttgcttggagatgaagcttcaggaagcgttgaagtcactcactccaatgatggatcaggcattggagctgcgcttcttgctgcttctcactctctctaccttgaagactcttaaaacctacccaaagagcgccatttttcggtaatttactgaaagcttttcgctatcagaaaacgcctaagccaagttctaaggcgtcataaaagaaagcattccatgtttttactcttccccaagactttctttgtagcaaataagtttccttgggagaaatatttgttttcatgttcttcaaaaataaaagactcagttcttcagattctgggattttattataaccagatatgttgtaaaaactacaaattcaaagctcacttcactggagttctgagtatataaagatttcatttttcctaaaaaaaaaaaaaaaaactaaattactcacactc

SEQ ID NO: 10268 - protein, 496 aa, Arabidopsis thaliana (mouse-ear cress)
MGKVAVGATVVCTAAVCAVAVLVVRRRMQSSGKWGRVLAILKAFEEDCATPISKLRQVADAMTVEMHAGLASDGGSKLKMLISYVDNLPSGDEKGLFYALDLGGTNFRVMRVLLGGKQERVVKQEFEEVSIPPHLMTGGSDELFNFIAEALAKFVATECEDFHLPEGRQRELGFTFSFPVKQTSLSSGSLIKWTKGFSIEEAVGQDVVGALNKALERVGLDMRIAALVNDTVGTLAGGRYYNPDVVAAVILGTGTNAAYVERATAIPKWHGLLPKSGEMVINMEWGNFRSSHLPLTEFDHTLDFESLNPGEQILEKIISGMYLGEILRRVLLKMAEDAAFFGDTVPSKLRIPFIIRTPHMSAMHNDTSPDLKIVGSKIKDILEVPTTSLKMRKVVISLCNIIATRGARLSAAGIYGILKKLGRDTTKDEEVQKSVIAMDGGLFEHYTQFSECMESSLKELLGDEASGSVEVTHSNDGSGIGAALLAASHSLYLEDS

SEQ ID NO: 10269 - DNA, 1488 bp, Aspergillus niger
  CDS (1)..(1488)
atgtcatctgctctccttgacgaggctgcgcgcattgcccgccagttcgactaccccgctgctgaggtgcagcgtggagtgacggaatacattcgcgagatcgatgaaggtttgtccaaggagcacacgaccctcagtcagatccctacctatgtcacggcagtgcccaatggcacggaaaagggattgtacctggcagtagatctcggcggcaccaacttccgcgtgtgttcgatcgatctacatggagacactaccttctcccttacccagtccaagatcatgattcctcgtgagaccatggcgtccggtacggccaaggatctcttcttgttcttggcccgccaaatcgaatcgttcctgcgcattcaccacaacgaccacttcgaagctcacctgcgacgccgcaatgagaagaatggcaactgtgaagaggacctgttcgacttgggtttcaccttcagtttccccgtgcgtcagctgggcattaacaagggtaccctgattcgctggacgaagggcttcaacattcccgatgcggtgggtaaggatgtctgcgcattgctgcagaacgccatcgatgatctgggactcccagtgcgcgtggctgccttggtcaacgacactgtcggaaccctgatggctcgttcatacacctctcctggagagacgggcacgttcctgggtgctatctttggcacgggcaccaatggcgcctatgttgagaagctggaccggatcactaagctgcagaccattgaacactccgagtacgacaagaccaccggtgagatgattatcaacgccgagtggggcagcttcgacaaccacctgagtgtactgccgaacaccatctacgaccagcagctcgatgccgacagcaacaaccccggcattcaaatgttcgagaagcgtgtctcgggtatgttcctgggtgagatcttgcgccgcgtcatgctggacatgcagcgcaacgagtccctgggcttcctccgggctggcggcgcttccaccgtttctgttccccaggagtcttccctgtaccgtcagtggggtattgacaccagcttgttgagtctggtcgaggccgacaagactgagaatatggagcagatcaaggtcgctttgaaggatcacctcaagatcgaacgccccaccaccgacgactgcaaggccatccagaccgttgttcatgccattggcaagcgtgctgctcgtctgagtgccgtcccgctggctgccatcctcctctctactggcaagctgcagaaggatgacctcgtagacattggtgtggatggcagtctggtcgagttctaccccaacttcgaaggctacatgcgtgatgccctccgcgaagtgcccgaggttggagaagccggcaacaagaagattcgcattggtatctccaaggatggcagcggcgtgggtgctgctctaatcgccctcgttgctagcaaggaggagacccgcagaaagtcgcaatag

SEQ ID NO: 10270 - protein, 495 aa, Aspergillus niger
MSSALLDEAARIARQFDYPAAEVQRGVTEYIREIDEGLSKEHTTLSQIPTYVTAVPNGTEKGLYLAVDLGGTNFRVCSIDLHGDTTFSLTQSKIMIPRETMASGTAKDLFLFLARQIESFLRIHHNDHFEAHLRRRNEKNGNCEEDLFDLGFTFSFPVRQLGINKGTLIRWTKGFNIPDAVGKDVCALLQNAIDDLGLPVRVAALVNDTVGTLMARSYTSPGETGTFLGAIFGTGTNGAYVEKLDRITKLQTIEHSEYDKTTGEMIINAEWGSFDNHLSVLPNTIYDQQLDADSNNPGIQMFEKRVSGMFLGEILRRVMLDMQRNESLGFLRAGGASTVSVPQESSLYRQWGIDTSLLSLVEADKTENMEQIKVALKDHLKIERPTTDDCKAIQTVVHAIGKRAARLSAVPLAAILLSTGKLQKDDLVDIGVDGSLVEFYPNFEGYMRDALREVPEVGEAGNKKIRIGISKDGSGVGAALIALVASKEETRRKSQ

SEQ ID NO: 10271 - DNA, 1482 bp, Arabidopsis thaliana (mouse-ear cress)
  CDS (1)..(1482)
atgaccaggaaagaggtggttctggccgtgacggctgcaaccattacggcggttgcagcaggtgtactaatgggtcggtggatccggaggaaagagcggcggttgaaacatacgcagagaattttgaggaaattcgctagagaatgcgccacgccggtttcgaagctttgggcggtggcggacgccttggtcgccgacatgaccgcctctttaaccgccgagtgttgcggttccctcaacatgctcgtttcattcaccggttctctcccttccggtgatgagaaaggggtacactatggagtcaacttgagaggcaaggaactattactgttacgtgggacgctaggtggtaacgaagagcctatttccgatgtacagaagcatgagattccgatccctgacgatgttttaaatggttctttcaaggagttgtgcgatttcatatcattggagcttgttaaatttcttgcgatgaatcccggtggagaagcagaagaagtgaagaatctcgggtttacgttgacgcgctctgttgagcagattgggtcacattcaatctcgtcgatacataggaagagtttagcaaatgacgatgatgagaaggttttgaaagatttggtgaatgatatgaatgaatcactggaaacacacggtctgaaaattcggatgaacacagcgctggtggataatactataggagaattggctggaggaaggtattatcacaaggacactgtggctgcagtatcattaggtatgggaaccaacgctgcttacattgaacaagctcaagagatatcgaggtggaaatctgcgatacgtgagccacaagagatcgttgttagcacagagtggggagatttcagatcttgccatcttcctataaccgagttcgatgcttctcttgacgcggaaagcttgaatcccggacatcgaatatttgagaagatggtgtcaggaagatacttaggggagatagtaagaagagtgttactaaaaatgtctgaagaatctgctctctttggagatacactacctccaaaactcacaattccttacattttatggtctccagatatggctgcaatgcatcaagatatatccgaagaacgggagactgtaaacaaaaagctcaaggaagttttcggtataatggattcaactcttgcggcgagagaagttgtagttgaagtatgcgatgtagtcgcggaacgagcggctcgtttagcgggagcaggaatagttgggatgataaagaagcttggaagattagagaagaaaatgagcattgtgatagttgaaggaggattgtatgatcattatagggtatttagaaactatcttcatagcagcgtttgggaaatgcttggtgatgagttatcagatcacgtcgtcattgagcattctcacggtggatctgctgccggagctctcttccttgccgcatgtggcgacggtcatcaagattctgaaagcaagtga

SEQ ID NO: 10272 - protein, 493 aa, Arabidopsis thaliana (mouse-ear cress)
MTRKEVVLAVTAATITAVAAGVLMGRWIRRKERRLKHTQRILRKFARECATPVSKLWAVADALVADMTASLTAECCGSLNMLVSFTGSLPSGDEKGVHYGVNLRGKELLLLRGTLGGNEEPISDVQKHEIPIPDDVLNGSFKELCDFISLELVKFLAMNPGGEAEEVKNLGFTLTRSVEQIGSHSISSIHRKSLANDDDEKVLKDLVNDMNESLETHGLKIRMNTALVDNTIGELAGGRYYHKDTVAAVSLGMGTNAAYIEQAQEISRWKSAIREPQEIVVSTEWGDFRSCHLPITEFDASLDAESLNPGHRIFEKMVSGRYLGEIVRRVLLKMSEESALFGDTLPPKLTIPYILWSPDMAAMHQDISEERETVNKKLKEVFGIMDSTLAAREVVVEVCDVVAERAARLAGAGIVGMIKKLGRLEKKMSIVIVEGGLYDHYRVFRNYLHSSVWEMLGDELSDHVVIEHSHGGSAAGALFLAACGDGHQDSESK

SEQ ID NO: 10273 - DNA, 1619 bp, Solanum tuberosum (potato)
  CDS (19)..(1515)
taaattccggcaaaaaaaatgaagaaagtgacggtgggagccgccgtggttggtgcagctgcggtgtgtgcagtggcggcgttaatagtgaaccaccggatgcggaaatctagtaaatggggtcgtgctatggctattcttcgtgaatttgaggaaaagtgtaagactcaagatgcaaagcttaagcaagttgctgatgctatgactgttgagatgcacgccggacttgcttctgaaggcggccagagctcaagatgcttatcacctatgtcgataatctcccaactggtgatgaagctgggcgtcttttatgcattggatcttggtggaacaaattttcgagtattgcgagtgcaattgggtggaaaagatggtggtattattcatcaagaatttgctgaggcatcaattcctccaagtttgatggttgggacttcagatgcactttttgattatattgcggctgagcttgctaaatttgttgctgcggaagaggaaaaatttcatcaacctcctggtaagcagagagaactaggttttcaccttctcattcccagtaatgcagacttcaataactctgggactattatgcggtggacaaaaggcttctcaattgatgatgcggttggccaagatgttgttggagaactcacaaaagctatgaaagaaaaggtgctcgatatgcgggtctcagctctggtgaatgatactgttggaacattagctggtggtaaatatacgcaaaaggatgtagctgttgctgttatcttaggtacagggacgaatgcagcttatgtggagcgggtgcaggcaattccaaagtggcatggtcctgtgccaaaatctggtgaaatggttatcaatatggaatggggtaattttaggtcatcccatctgccgttgacagagtatgatcatgcgttggataacgagagtttaaatcctgctgaacagatatttgagaagatgacttctggcatgtacttgggagaaattttacgcagagttctcactagggtggctgaagaagtcctggcgtttttggcgatgaggtccctccaaagcctcaaggattcatttgtgttaaggacacctgatatgtctgctatgcatcatgacacatcccctgatctgaaagtggttggtgaaaagctgaaggatattttagagatatctaatacctccttgaagacaaggaaattagtgttgagcctgtgcaatatcgttgcaacacgtggggcaagacttgacgctgcaggggtattgggcatcttgaaaaagatgggaagagatacgcctaagcagggtggttcagaaaggacggttatagccatggatggcgggttgtatgagcactatacagaatatagaatgtgtttagagaactctttgaaggacttgctcggagaggaattggcaacgagcatcgtttttgtgcactccaatgatggttctggcattggtgctgctcttcttcgtgcctctcattcaatgtaccttgaagatcaagcttaggcgagtgtgatcaaatccataacttgctagaggggactacctttagactctatattttgctctcaagcgttttcggtattttctctcctttattgtaccatcaa

SEQ ID NO: 10274 - protein, 498 aa, Solanum tuberosum (potato)
MKKVTVGAAVVGAAAVCAVAALIVNHRMRKSSKWGRAMAILREFEEKCKTQDAKLKQVADAMTVEMHAGLASEGGQSSRCLSPMSIISQLVMKLGVFYALDLGGTNFRVLRVQLGGKDGGIIHQEFAEASIPPSLMVGTSDALFDYIAAELAKFVAAEEEKFHQPPGKQRELGFHLLIPSNADFNNSGTIMRWTKGFSIDDAVGQDVVGELTKAMKEKVLDMRVSALVNDTVGTLAGGKYTQKDVAVAVILGTGTNAAYVERVQAIPKWHGPVPKSGEMVINMEWGNFRSSHLPLTEYDHALDNESLNPAEQIFEKMTSGMYLGEILRRVLTRVAEEVLAFLAMRSLQSLKDSFVLRTPDMSAMHHDTSPDLKVVGEKLKDILEISNTSLKTRKLVLSLCNIVATRGARLDAAGVLGILKKMGRDTPKQGGSERTVIAMDGGLYEHYTEYRMCLENSLKDLLGEELATSIVFVHSNDGSGIGAALLRASHSMYLEDQA

SEQ ID NO: 10275 - DNA, 1503 bp, Caenorhabditis elegans
  CDS (1)..(1503)
atgtcatctatcgtatgccacccaatactcgactcacaaaacggaatcgccacagatgcggtcatcaaaaagcaacgtccaccaccacttgtcctttccagacccaaagacttgatccaggaagcatgccaacgtcttgttctgagcgatcagcagcttcgacgaatcatgcaatcgatggagaaaagcatggagcagggtcttgctacttctacgaagaaagtcgctgttaaaatgcttccaacctatgttgattctgtcccgaacggaactgagagtggcgattttcttgcacttgatcttggtggtaccaatttccgtgttctacacatcaaactacaaggaaaagagacaaaaatgactggaaaaatcttccgtgttcctgaaagtatcatgcgaggaaccggtgaagctctcttcgatcatatcgcaggttgtatggccaagtttatgggtgagaacgatttaaaggatgcccagaagttgccgctcggattcactttctcgtttccatgtgaacaggaaggattgacaaaaggaaaattggtcacctggacgaaaggattcaaagcatccggagtagagggtgttgatgttgtcactttgcttcacgaagcgtgccatagaagaaaggatattgatattgacgtagtggcactgctcaacgacacagtgggaacactgatggcttgtgcattccaagaaaactcttgtcaaatcggagtcattgtgggaacaggtaccaatgcatgctacatggaacgtttggatcgtatcccgaagttggctggatacgttgatgaacacggtgtgacaccggaggagatgatcatcaacactgaatggggagcatttggggacgatggagcactcgatttccttcgcaccgaatgggatgaagttgtggatcgtgagagcatcaacccaggacaacatctctatgagaagatgatctccggaatgtatatgggagagtgtgcccgagttgttctcgaagatttggcaaagcaaggattgctgttcggtggaaactcggatgctatttcggttcctcattgctttccaacaaagtttgtatcggaaattgatagtgatcttcttgaggatgatgatcgaacattccaaaagacttatcaaattctcgaggatattggtgttgagatgatcactgcgaatgattgtgccaatgtggcgtacgtgtgtagtttgatttcaactcgtgctgcccatctgacagccgctggaatcgctatgttgctcaatcgaatgaacaagaaacatgtgactgtcggagttgatggatctgtatatcgtttccatccaacttatccaacacttcttgatgccaaaattggagaattgattgttggagacattgagtataaattgatgctctctgaagatggatctggacgtggagctgctctcgttgctgctgttgccactcgactgaaagaggaaaagcttgccgcttctctttcatcgtcatcgtccaatcagtag

SEQ ID NO: 10276 - protein, 500 aa, Caenorhabditis elegans
MSSIVCHPILDSQNGIATDAVIKKQRPPPLVLSRPKDLIQEACQRLVLSDQQLRRIMQSMEKSMEQGLATSTKKVAVKMLPTYVDSVPNGTESGDFLALDLGGTNFRVLHIKLQGKETKMTGKIFRVPESIMRGTGEALFDHIAGCMAKFMGENDLKDAQKLPLGFTFSFPCEQEGLTKGKLVTWTKGFKASGVEGVDVVTLLHEACHRRKDIDIDVVALLNDTVGTLMACAFQENSCQIGVIVGTGTNACYMERLDRIPKLAGYVDEHGVTPEEMIINTEWGAFGDDGALDFLRTEWDEVVDRESINPGQHLYEKMISGMYMGECARVVLEDLAKQGLLFGGNSDAISVPHCFPTKFVSEIDSDLLEDDDRTFQKTYQILEDIGVEMITANDCANVAYVCSLISTRAAHLTAAGIAMLLNRMNKKHVTVGVDGSVYRFHPTYPTLLDAKIGELIVGDIEYKLMLSEDGSGRGAALVAAVATRLKEEKLAASLSSSSSNQ

SEQ ID NO: 10277 - DNA, 1659 bp, Caenorhabditis elegans
  CDS (1)..(1659)
atgctgggtatcatcgagctcggcattcaatatcggatatggcgttcacaagcccatggaaagggaaaaaagagcccgcggacgccgacgactccgctggcaaaaatggcgtcgaaactgaatgaagaatcgatttcgctggaatccgtgatggccgagtttaagctgtcaaatacgactctccgacgaatgatgtcccatttatcagataatatggatcgaggactggaatccggcttggaacggtccacaattgcaatgttaccatcttttgtgccagaattgccgaatggaaaagaacgtggaaaattcgttgcaatggacctcggaggcacaaatctacgtgtaatgttgatggaactggagcccggtgagccgatgagaactaaacaatttaatacaagaatgccaaatgccgcaatgcatggaaccggacaaaaacttttcgactacattgccaaagctctgtgcgattttcttgtcgaacgtgagctcgccgatgagcatttgcctgttggattcactttctcgtatccctgcgatcaaaccgggctccgatcggccacgctgctcagatggacaaaaggagtaacagcgacaggatgcgtgggcgaagacgtcgtacaactgttagaagatgcgattgcacgtgatggacgtgttaaagtgaatatagttgcattgattaatgatacagttggtacaatggttgcagctgcatatgaagctggcggtcactgtgatattggcgtaattattggaaccggaacaaatgcttcatatatggaagattccaggaagattgtgcacggattggccaacgctacggaggattataatcataaatcgatgataatcgatacggaatggggaggatttggtgataatggagaagctgattatattttcacaagatatgataaaattgttgactcaaaatccgatcatcctggcgttaattctctcgacaagctaatcgccggaatgtgcatgggagagctcgtccgtctggttttggagcgactctgtgagaataaagtgctctttaatggaattggctcgaaaatgctccgtactcgaaatacgtttccgacgaaatatatttccgaaattttgcacgacgattgcggtgtctacagtaatacccgacagatcatggacgagctcggcatcgaaggagccacttttagcgatatgcttctgctccgtgaagtttgtgtcgttgtgtcgaggcggagtgcgaatttggcggctgcagcaatcgcgtgtgtcctgaatcgtgtccgccggccgaatatgctcgttgcaatcgatggatccacgtataaataccatccattcttcaatcattgggtgtgcgagaagattcgagaacttctggatcctgggcttgatttcaaaatcgtccaaaccggtgatggctcaggccgtggagccgcactcatcgccgcaatcgtttcgagagtcaagcgagaagaggagaagcggctgaaggatctggaagcccaacggctccgcgacgcagaagccgaggagcggcgcctgctggaaattgagaaagagaaggaagaagccgaagagcgagcacaaaagatctcggaaatgatgagatatcagatcgagcgaggcgccgaagagtcattccaacgtcatgattaa

SEQ ID NO: 10278 - protein, 552 aa, Caenorhabditis elegans
MLGIIELGIQYRIWRSQAHGKGKKSPRTPTTPLAKMASKLNEESISLESVMAEFKLSNTTLRRMMSHLSDNMDRGLESGLERSTIAMLPSFVPELPNGKERGKFVAMDLGGTNLRVMLMELEPGEPMRTKQFNTRMPNAAMHGTGQKLFDYIAKALCDFLVERELADEHLPVGFTFSYPCDQTGLRSATLLRWTKGVTATGCVGEDVVQLLEDAIARDGRVKVNIVALINDTVGTMVAAAYEAGGHCDIGVIIGTGTNASYMEDSRKIVHGLANATEDYNHKSMIIDTEWGGFGDNGEADYIFTRYDKIVDSKSDHPGVNSLDKLIAGMCMGELVRLVLERLCENKVLFNGIGSKMLRTRNTFPTKYISEILHDDCGVYSNTRQIMDELGIEGATFSDMLLLREVCVVVSRRSANLAAAAIACVLNRVRRPNMLVAIDGSTYKYHPFFNHWVCEKIRELLDPGLDFKIVQTGDGSGRGAALIAAIVSRVKREEEKRLKDLEAQRLRDAEAEERRLLEIEKEKEEAEERAQKISEMMRYQIERGAEESFQRHD

SEQ ID NO: 10279 - DNA, 3669 bp, Homo sapiens
  CDS (106)..(2859)
ccacgcgtccggcctggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcatagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatccggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctgttaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcagstgttgatagttgttttaaggattgttaggtataggaaatccagtaaattaataaaaaaattttgattttccaataaaaaaaaaaaaaaaaaa

SEQ ID NO: 10280 - protein, 917 aa, Homo sapiens [sequence omitted]

SEQ ID NO: 10281 - DNA, 1362 bp, Entamoeba dispar
  CDS (1)..(1338)
atgcaagaaatcattgatcaatttgctattgataaagaaaaattagaaattattgttcaaagaatgagtgaagaattaactaatggacttcaagataaaccaagtactcttaaaatgcttccatcttatgcccctattcctactggtaaagaagttggtacttttatgggtattgatgttggtggaactaatctcagagttttattattagaaattcctgaacctggtgttcgtggagaacttaaatcagttgaatgtattatgccaaaaacatcaacaaccatagaccaattctttggatttattgcccaaaagattaaagagtttgttgaaaataacaatttaaaagaaaaagaaattaaagctggattgacattttcttttgctgttgaacaaattgctatagataaaggaattcaacaatcctggtcaaaaggatgggacattaaagaatccattggtaaagatattgttgaaattttccataaccaacttgcaaaagttaatgttaaaaatattaggatagtcgcatttatcaatgacactgtaggaacatttgctaatcttgcatatgatgatgcatcatgtggtatgggacttatttttggtacaggaactaatggatgttatattgagaaaacatctaacttcgcttcttctaaattaaaatcagtatgtaaagaagattatatgattgttaacacagaatggggagcattagatattccagaacttggatataacagatttgataagatgattgatgatgttagtgtcaacaaaggagaacactattttgaaaagatgatttcaggtatttacatgggatggttagcaagattagctattagagaattaattgagaaaaaggttatttttgaacgatatgctaatgctgatgttttttctaattcaccagatgatactgactgtgatcactcaaagaaatatacttcaagacatactggtattgttgaagatactactcctgaattgattcttgttgatgaaatgcttaaatcacttggagttaatgactctactttagaagaaagaaaggtccttaagaatataactgaggcagttgttaaaagagctgcctatcttgcagcagcagcaactgtatgtttatatcgtaaaatggttccatatatgaaagaaagaactactgctggagttgatggttcagtctttgagaaatccgttccatttaagaaattctatcttgaagcacttgaccttttacaacctgttgaaaaggttacttgtcagttatctaaagatggatctggacttggtgctgtcattgttgctgctgctgttgcatgcaaacaataaatttaaataaacacatttaaaaaa

SEQ ID NO: 10282 - protein, 445 aa, Entamoeba dispar
MQEIIDQFAIDKEKLEIIVQRMSEELTNGLQDKPSTLKMLPSYAPIPTGKEVGTFMGIDVGGTNLRVLLLEIPEPGVRGELKSVECIMPKTSTTIDQFFGFIAQKIKEFVENNNLKEKEIKAGLTFSFAVEQIAIDKGIQQSWSKGWDIKESIGKDIVEIFHNQLAKVNVKNIRIVAFINDTVGTFANLAYDDASCGMGLIFGTGTNGCYIEKTSNFASSKLKSVCKEDYMIVNTEWGALDIPELGYNRFDKMIDDVSVNKGEHYFEKMISGIYMGWLARLAIRELIEKKVIFERYANADVFSNSPDDTDCDHSKKYTSRHTGIVEDTTPELILVDEMLKSLGVNDSTLEERKVLKNITEAVVKRAAYLAAAATVCLYRKMVPYMKERTTAGVDGSVFEKSVPFKKFYLEALDLLQPVEKVTCQLSKDGSGLGAVIVAAAVACKQ

SEQ ID NO: 10283 - DNA, 2754 bp, Rattus norvegicus
  CDS (1)..(2754)
atgatcgcctcgcatatgatcgcctgcttattcacggagctcaaccaaaaccaagtgcagaaggttgaccaatttctctaccacatgcgtctctcagatgagacccttctggagatttctaggcggttccggaaggagatggagaaagggctaggagctaccacgcaccctacagcagctgtgaaaatgttgcctacctttgtgaggtcaactccggatgggacagaacatggggagttcctggctctggatcttggaggaaccaacttccgtgtgctccgagtaagggtgacggacaatggcctccagagagtggagatggagaaccagatctacgccatccttgaggacatcatgcggggcagtggaacccagctgtttgaccacatcgccgaatgcctggccaacttcatggacaagctacaaatcaaagagaagaagctccctctgggtttcaccttctcgttcccctgccaccagacaaaactggatgagagttttttggtctcgtggactaaggggttcaagtccagtggcgtggaaggcagagatgtggtggacctgatccggaaggttatccagcgcagaggggactttgacattgacattgtggccgtggtgaatgacacagttgggaccatgatgacttgtggctatgatgatcagaactgcgagattggtctcattgtgggcactggcagcaacgcctgctacatggaggaaatgcgtcatattgacatggtggagggagatgaggggcgcatgtgcatcaacatggagtggggagcctttggggacgacggtacactcaatgacatccgaaccgagtttgaccgagagatcgacatgggctcgctgaaccctgggaagcagctgtttgagaagatgattagcgggatgtacatgggggagctggtcaggctcatcctggtgaagatggccaaggcagagctgttgttccaagggaaactcagcccagaactccttaccactggctccttcgagaccaaagatgtctcggatattgaagaggataaggatggaatcgagaaggcctaccaaatcctgatgcgcctgggtctgaatccattgcaggaggattgtgtggccacgcaccgaatctgccagattgtgtccacgcgctcggccagtctgtgcgcagccaccctggccgcggtgctgtggcgaatcaaagagaacaagggcgaggagcgacttcgctccaccatcggtgtcgatggctccgtctacaagaaacatccccattttgccaagcgtctccataaggcagtgaggaggctggtgcccgactgtgatgtccgcttcctccgctctgaggatggcagcggcaagggggctgctatggtgacggcggtggcttaccgtctggctgaccaacaccgggcccgccagaagaccctggagtctctgaagctgagccacgagcagcttctggaggttaagagaagaatgaaggtggaaatggagcagggtctgagcaaggagacgcatgcggtcgcccctgtgaagatgctgcccacttacgtgtgtgccactccagatggcacagagaaaggagacttcttggccttggatcttggaggaacaaacttccgggtcctgctggtgcgtgtgcgtaatggcaagcggaggggcgtggagatgcataacaagatctactccatcccacaggaggttatgcatggcactggggaagagctcttcgaccacattgtccagtgcattgcggacttcctggagtacatgggcatgaagggcgtgtccctgcctttgggtttcacattctccttcccttgccagcagaacagcctagaccagagcatcctcctcaagtggacaaagggattcaaggcatctggctgcgagggtgaggatgtggtcaccttgctgaaggaagcgattcaccggcgagaggagtttgacctggatgtggttgccgtggtgaatgacacagttgggactatgatgacttgtggctacgaagaccctcactgtgaagttggcctcattgttggcaccggaagcaacgcctgctacatggaagagatgcgtaatgtggagctggtggacggagaggagggacggatgtgtgtcaacatggagtggggagcatttggggacaatggctgcctggatgacttgcggaccgtgtttgatgttgctgtggatgagctttctctcaaccctggcaaacagaggttcgagaagatgatcagcggcatgtacttgggagagattgtgcgcaacattctcatcgatttcacgaagcgggggctgctcttccgaggccgcatctcagagcgcctcaagacaaggggaatctctgaaactaagttcctgtctcagatagagagcgactgcctagccctgctacaggttcgtgccatcctgcgccacctagggctggagagcacgtgcgatgacagcatcatcgtgaaggaggtgtgcactgtggttgcccggcgcgctgcacagctctgtggcgcaggcatggccgccgtagtggacaagataagagagaaccgtgggctggacaaccccaaagtgacagtgggcgtggacgggactctgtataagcttcatcctcactttgccaaggtcatgcatgagacggtgagagatctggctccgaaatgtgacgtgtccttcctggaatccgaggacggcagtgggaagggagcagctctcatcactgccgtggcctgccgcatccgggaggctgggcagagatag

SEQ ID NO: 10284 - protein, 917 aa, Rattus norvegicus
MIASHMIACLFTELNQNQVQKVDQFLYHMRLSDETLLEISRRFRKEMEKGLGATTHPTAAVKMLPTFVRSTPDGTEHGEFLALDLGGTNFRVLRVRVTDNGLQRVEMENQIYAILEDIMRGSGTQLFDHIAECLANFMDKLQIKEKKLPLGFTFSFPCHQTKLDESFLVSWTKGFKSSGVEGRDVVDLIRKVIQRRGDFDIDIVAVVNDTVGTMMTCGYDDQNCEIGLIVGTGSNACYMEEMRHIDMVEGDEGRMCINMEWGAFGDDGTLNDIRTEFDREIDMGSLNPGKQLFEKMISGMYMGELVRLILVKMAKAELLFQGKLSPELLTTGSFETKDVSDIEEDKDGIEKAYQILMRLGLNPLQEDCVATHRICQIVSTRSASLCAATLAAVLWRIKENKGEERLRSTIGVDGSVYKKHPHFAKRLHKAVRRLVPDCDVRFLRSEDGSGKGAAMVTAVAYRLADQHRARQKTLESLKLSHEQLLEVKRRMKVEMEQGLSKETHAVAPVKMLPTYVCATPDGTEKGDFLALDLGGTNFRVLLVRVRNGKRRGVEMHNKIYSIPQEVMHGTGEELFDHIVQCIADFLEYMGMKGVSLPLGFTFSFPCQQNSLDQSILLKWTKGFKASGCEGEDVVTLLKEAIHRREEFDLDVVAVVNDTVGTMMTCGYEDPHCEVGLIVGTGSNACYMEEMRNVELVDGEEGRMCVNMEWGAFGDNGCLDDLRTVFDVAVDELSLNPGKQRFEKMISGMYLGEIVRNILIDFTKRGLLFRGRISERLKTRGISETKFLSQIESDCLALLQVRAILRHLGLESTCDDSIIVKEVCTVVARRAAQLCGAGMAAVVDKIRENRGLDNPKVTVGVDGTLYKLHPHFAKVMHETVRDLAPKCDVSFLESEDGSGKGAALITAVACRIREAGQR

SEQ ID NO: 10285 - DNA, 2643 bp, Oncorhynchus mykiss
  CDS (122)..(1537)
gtttacagttcactgactctgcatacacacacactcatgccaaacacacacttaccacacacctagatacacacgcgagtgatttagagagctagacaagatactgtgcgtcagctccttcatgggccagatggggaagatgccttgtagcctcagctctgtgctagagagagtcatcatggtggagcagatcctgtcggagttcaggctgaagaaggagcagttgaaggaggtgatgaagaggatgatgagggagatggaccggggactgcgtgtagagacgcaccaggaggccagtgtcaaaatgctgcccacctacgtctgttctacccctgaaggatcagaggtgggtgatttcctggccctggacctgggggggactaacttccgtgtgatgttggtgaaggtgggggaggatgaggagaggggatggaaggtggagaccaaacaccagatgtactccatctctgaggacgcaatgacaggcacggctgagatgctctttgactacattgctgagtgtatatcagacttcctgaacagacaacacatcaagcacaagaagcttcctctgggtttcaccttctcttttcctgtacgacacgagaacatagacaagggcatcctactgaactggaccaaagggttcaaggcgtctggagcagagggtaacaacgtggtgggactactgagagatgccatcaagaggagaggggactttgagatggacgtcgttgccatggtgaacgatacagttgccaccatgatatcctgttactatgaggaccgcagctgcgaagtgggaatgattgtgggtactgggtgtaacgcttgctacatggaggagatgcggacagtggagctggtggagggggaagaggggaggatgtgtgtgaacacagagtggggggcctttggagccaacggagagctggaggagtttagactggagtacgacagggtggtggacgagacatcactcaaccctggacaacaactctatgaaaagctgatcagtgggaagtacatgggagagctggtgcggctggtattgttgaagctggtgaacgaggagctgctgtttaacggagaagcttctgacctgctgaagactcgcggcagctttgagacgcgctacgtctcccagatagagggtgactctggagacaggaagcagatctacaacatcctgtctacgctgggcgtgttgccgtcggagctggactgtgacatagtgcgtctagcttgtgagagcgtgtccacgcgggcagcacacatgtgtggggcggggttagccggcgtcatcaaccgtatgagagaacgccgcagcccggcggtgttgaagatcactgtgggcatcgacggctccgtctacaaactccacccctgtttccaggacaggttccacaaagttgtgcgggagctgacgcctcactgtgacatcaccttcatccaatcagaggaagggagtggccggggggcggcacttatctcggcagtagcctgtaagatggcagcgtgcatgctgacaccctgagagtcgtaacagcctcccacctatagggggcgatgcaggtgaaccaggcttaactctgacctcatacagtaaattatgcctcatctagggtgatccagctctggcctcctcttgaagctttcacagagtaatctgtaactcctcattggtgagagaagcaatacgagtgtggataactcactgtacatacaaataaccccaccacacagcacacacaacatgggatacacagagacagattcaatcatcacttttcccagtgtacagtattatacagatgtgtttttgaactgatgagcctctgaaaattccctgcagtcccacaatgcataagtggtgagtcccagaaagtaacgaacccttgtttaaacatgttctcaagcttccactgattgcaggtatttaaagcttgattaataatgtaatataatgttaaagggaaaaagattggcattgatttatagcatcagtatgttttttagttggatgctgtctgtttaatccagagatgttaccgtatataaatttaaaactaagggattatccctttcaaatgtgttgcagtgcagtctttcacttactgttcgtgggaaattaaatatttatttgatagcatattgataaaagtgatgtatctgtgatgagcgtaaaggtcttaattcctatgatgtatatctaagaatgataatgtgctttgtaatgtgaccattttttatcgttgtaagtaaagttgctgtaacatacaaatatttttgttgtgtgcctatcgtcatttgaaattgaaggggccaaataactgaagtggctttagcgtacatgaccacatcctgtcacaaataactgtcaggtttctgtttctgttcagtaaagtgagcaactcacacaaagtttcccaggcaaacacccaatgcaactgaataggactgtaaactacagtcatactcagtggtgtaaagtacctcagtaaaaatgcttgaaagtactacttaagtcgttttttagggtatcggtactttactttacttatatatatttttgacaacttttacttttacttcactacattcctaataaaaatgatgtacttttacgaaaaaaaaaaaaaa

SEQ ID NO: 10286 - protein, 471 aa, Oncorhynchus mykiss
MGQMGKMPCSLSSVLERVIMVEQILSEFRLKKEQLKEVMKRMMREMDRGLRVETHQEASVKMLPTYVCSTPEGSEVGDFLALDLGGTNFRVMLVKVGEDEERGWKVETKHQMYSISEDAMTGTAEMLFDYIAECISDFLNRQHIKHKKLPLGFTFSFPVRHENIDKGILLNWTKGFKASGAEGNNVVGLLRDAIKRRGDFEMDVVAMVNDTVATMISCYYEDRSCEVGMIVGTGCNACYMEEMRTVELVEGEEGRMCVNTEWGAFGANGELEEFRLEYDRVVDETSLNPGQQLYEKLISGKYMGELVRLVLLKLVNEELLFNGEASDLLKTRGSFETRYVSQIEGDSGDRKQIYNILSTLGVLPSELDCDIVRLACESVSTRAAHMCGAGLAGVINRMRERRSPAVLKITVGIDGSVYKLHPCFQDRFHKVVRELTPHCDITFIQSEEGSGRGAALISAVACKMAACMLTP

SEQ ID NO: 10287 - DNA, 2047 bp, Cyprinus carpio
  CDS (64)..(1494)
ccacacattcaaactttagcaaatcaacactcatcatacaattgtttgaaaagacttgcaaagatgccgtgcctctcttcagctcgtaggcagaggacgccaagtgactttgagtcagtactggagagaattctcatggtggaccaaattctgtctgaatctctgctgagtaaagaagatttagaggaagtgatgaggaggataaggagagagatggagagaggactgcgagtggagacacatgatgaagccagtgtcaaaatgctgcccacttatgtccgctccacacctgaaggctctgaggttggtgatttcctggcactggatcttggagggacaaactttcgggtgatgctggtgaaagtgggtgaggatgaagagcgaggctggaaggtggagacgaagcatcacatgtactccatccctgaagatgccatgaccggcacagctgaaatgttgtttgactacattgccagctgcatatctgacttcctggacaaacataatctgaaacataagaagcttccactgggattcaccttctcttttccagtccgtcatgaggatttggataagggcattctgcttaactggactaaaggcttcaaggcctctggcgctgagggcaataatgttgttggtctactgagagatgccattaaaagaagaggggactttgaaatggatgtggttgctatggtgaatgacacagtagccaccatgatctcctgctactatgaagaccgcagctgtgaagtcggtatgatagtagggaccggctgtaatgcgtgttacatggaggagatgcgtaaggtggagctggtggagggagaggaggggaggatgtgtgtgaacacagagtggggagcgtttggggacaatggtgaactggaggacttccggctggagtacgaccgtgttattgatgagacttcactaaaccctggacatcagctgtatgagaagctgattggtggcaagtatatgggagagcttgcgcgtcttgtgctgctaaaacctgtgaatgaaaatctgctgtttaacggcgacgcctcagacctactgaaaacacgaggagcttttgaaactcgcttcgtctcccagattgagagtgacacgggggacagaaagcagatctacaacatcctgagctcactgggaatcttaccgtcggagctggactgtgacattgtgcgtctggtctgcgagagcgtgtctacgcgagccgctcacatgtgcggggccggcctcgctggcgtcatcaacctaatgagggaacgccgttgtcaagaggaactgaagatcactgtgggagtcgatggctctgtctacaaactacaccctcatttcaaggagcggttccataagcttgtgtgggaaatgactcctcactgcgaaattaccttcatccaatcagaggaggggagcggtcggggcgcggctctcatttctgctgtggcgtgcaagatggccgcgtgcatgctgacaccgtgataaaccacgattcggccgcgtcaggtggatctcatgaatcacagctgacccgcaatgtttgagcggcctttcatatggggaaagtgctttgctccttttcagcattgcattgcgtatgtgaagtggccggctgtggcgttgtttggcaacatctattaaccacatgcatacagcccattgaaatgtttaacagatgtattattttatgccgtaaaagtcagatgtttgcagttaaatatgcttttagacacaacatacatctttaattgttagcaaattgccctgagcacattcaggtaatgttacatattgcaccttcatggctgtttggaggttaggagagaaacggagggaactatgtagatgtgtttgtaaatatgaactggtaattgtgcactgtttatggctggttttatttattgacttttaaattatgtttatattcagtggaaatcagaactgttcagttatttaatgcaggacttggatatactttgtacatgtgattgatcgttgtaaataaagctgctgtactatcaaaaaaaaaaaaaaa

SEQ ID NO: 10288 - protein, 476 aa, Cyprinus carpio
MPCLSSARRQRTPSDFESVLERILMVDQILSESLLSKEDLEEVMRRIRREMERGLRVETHDEASVKMLPTYVRSTPEGSEVGDFLALDLGGTNFRVMLVKVGEDEERGWKVETKHHMYSIPEDAMTGTAEMLFDYIASCISDFLDKHNLKHKKLPLGFTFSFPVRHEDLDKGILLNWTKGFKASGAEGNNVVGLLRDAIKRRGDFEMDVVAMVNDTVATMISCYYEDRSCEVGMIVGTGCNACYMEEMRKVELVEGEEGRMCVNTEWGAFGDNGELEDFRLEYDRVIDETSLNPGHQLYEKLIGGKYMGELARLVLLKPVNENLLFNGDASDLLKTRGAFETRFVSQIESDTGDRKQIYNILSSLGILPSELDCDIVRLVCESVSTRAAHMCGAGLAGVINLMRERRCQEELKITVGVDGSVYKLHPHFKERFHKLVWEMTPHCEITFIQSEEGSGRGAALISAVACKMAACMLTP

SEQ ID NO: 10289 - DNA, 1473 bp, Aspergillus niger
  CDS (1)..(1473)
atggttggaatcggtcctaagcgtcccccctcccgcaagggttccatggccgatgttccccagaacctcttgcagcagatcaaggacttcgaggaccaattcaccgtcgatcgctccaagctcaagcagattgtcaaccactttgtcaaggaattggaaaagggtctctctgtcgagggtggaaacatccctatgaacgtcacctgggttctgggattccccgatggcgacgaacagggtactttcctcgccctcgacatgggtggcaccaacctgcgtgtttgtgagatcaccctgacccaggagaagggtgccttcgacatcacccagtccaagtaccgcatgcccgaggaattgaagaccggtaccgccgaggagctgtgggaatacatcgccgactgcctgcagcaattcatcgagtcccaccacgagaacgagaagatctccaagctgcccctgggtttcaccttctcctaccccgccacccaggattacatcgaccacggtgtcctgcagcgctggaccaagggtttcgacattgatggtgtcgagggccacgacgtcgtcccgccgttggaggccatcctgcagaagcgcggcctgcccatcaaggtggctgcactgatcaacgacaccaccggaaccctcatcgcctcttcttacaccgactccgacatgaagatcggctgcatcttcggtaccggtgtcaacgccgcctacatggagaacgccggctccatccccaagctggctcacatgaacctgcccgccgacatgcccgtggctatcaactgcgagtacggtgctttcgacaacgagcacatcgtgctgcctctgaccaagtacgaccacatcatcgaccgcgactcgccccgtcccggtcagcaggccttcgagaagatgaccgccggtctgtacctgggtgagatcttccgtctggccctgatggacctggtggagaaccgccccggcctcatcttcaacggccaggacaccaccaagctgcgcaagccctacatcctggatgcctccttcctggcagccatcgaggaggacccctacgagaacctggaggagaccgaggagctcatggagcgcgagctcaacatcaaggccaccccggcggagctggagatgatccgccgcctggccgagctgatcggtacgcgtgccgctcgcctgtcggcctgcggtgttgccgccatttgcacgaagaagaagatcgactcgtgccacgttggtgccgacggctccgtcttcaccaagtaccctcacttcaaggcgcgcggagccaaggctctgcgcgagatcctggactgggctccggaggagcaggacaaggtgaccatcatggcggccgaggatggatctggtgtgggagctgcgctgattgcggcgctgaccctgaagcgggtcaaggccggcaacctggccggtatccgaaacatggctgacatgaagaccctgctataa

SEQ ID NO: 10290 - protein, 490 aa, Aspergillus niger
MVGIGPKRPPSRKGSMADVPQNLLQQIKDFEDQFTVDRSKLKQIVNHFVKELEKGLSVEGGNIPMNVTWVLGFPDGDEQGTFLALDMGGTNLRVCEITLTQEKGAFDITQSKYRMPEELKTGTAEELWEYIADCLQQFIESHHENEKISKLPLGFTFSYPATQDYIDHGVLQRWTKGFDIDGVEGHDVVPPLEAILQKRGLPIKVAALINDTTGTLIASSYTDSDMKIGCIFGTGVNAAYMENAGSIPKLAHMNLPADMPVAINCEYGAFDNEHIVLPLTKYDHIIDRDSPRPGQQAFEKMTAGLYLGEIFRLALMDLVENRPGLIFNGQDTTKLRKPYILDASFLAAIEEDPYENLEETEELMERELNIKATPAELEMIRRLAELIGTRAARLSACGVAAICTKKKIDSCHVGADGSVFTKYPHFKARGAKALREILDWAPEEQDKVTIMAAEDGSGVGAALIAALTLKRVKAGNLAGIRNMADMKTLL

SEQ ID NO: 10291 - DNA, 2781 bp, Saccharomyces cerevisiae
  CDS (718)..(2178)
gatccaatcttaaaaagaaccatcatttccaaaagaaaggtcaccaagtaataacgaggatgaggagattgtcaagacacccagaaaattagtcaattacgtacctttaaaaatttctcaatctaggtgatagcttcgacgatacgatctcagtatagcagtgacgcgtgggtttcaggaagaatggcagtccccttttgtttttccgcatttgtgtgagcttcttatgcccctgaacccactattctgcccctttgaaactcccgcacgtgtgccccgtttgttggaagatagcgaaataccttactggagcaaccaggaaaaatactctggttgcaaaaaccaacaaaagaaaaaatgggaagacctaagactatgcattttttaagggttgatgaaagaaaagttacttctcccggattttggtaccttaggaccgttgagaggaatagtaacaagtgaacgcaacaaagattgttctcaactgcttctgtttcctccttttctttaaagaggaatatttcgtatataagcaatcggtttcacttccttgggaatattctaccgttccttcatcttgtattcttctctttctcttagcgcaatatatagcagaagagcaataagaaacaattgtggcttgcaatactcaattagaattcttttcttttaatcaaactcacccaaacaactcaattagaatactgaaaaaataagatggttcatttaggtccaaaaaaaccacaagccagaaagggttccatggccgatgtgccaaaggaattgatgcaacaaattgagaattttgaaaaaaatttcactgttccaactgaaactttacaagccgttaccaagcatttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcaccaagaggaatatccatattgaagttgttgctttgataaacgacactaccggtactttggttgcttcttactacactgaccctgaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacatcgctgcagacggttccgtttcaacgagatacccaggtttcaaagaaaaggctgccaatgctttgaaggacatttacggctggactcaacctcatctagacgactacccaatcaaggttgttcctgctgaagatggttccggtcctggtgccgctgttattgctgctttggcccaaaaaagaattgctgaaggtaagtccgttggtatcatcggtgcttaaacttaatttgtaaattaagtttgaatgtgtttttccctcccttaatattattattcttatgagtgatgcccttatgttttttttgcggtctagtatatgtaaatatagacacacacatatatatatatttatgtgtataatcctagctaataaacatttttagattgttattagtataatttttccacttactttgttctccgggagagaaaaagttgtttattttgtagtaattttgtgcacatattatatatacaaatattacacaatattttcaatacttatggcataatccattgctttttcgataatgtttgtcttttggtcttcttcatgcatcatttcatcttcgtaatcagctttctcctttgattggttattgaagtaaactttcgagttgacaataggccagtttctctctagtgcaaatttttcagtttctttttcgttgttgaaaaagagcaaagcctttatgttggagagagggagaaagtcgtaggatagctcggtatttttagcaatttcgtctcttatagctgattttaggatatcggtaaaagagtcgaattctgatatattctgcgacccagattgcagaagatc

SEQ ID NO: 10292 - protein, 486 aa, Saccharomyces cerevisiae
MVHLGPKKPQARKGSMADVPKELMQQIENFEKNFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIHIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVSTRYPGFKEKAANALKDIYGWTQPHLDDYPIKVVPAEDGSGPGAAVIAALAQKRIAEGKSVGIIGA

SEQ ID NO: 10293 - DNA, 1372 bp, Entamoeba histolytica
  CDS (14)..(1351)
taaataaaacacaatgcaagaaatcattgatcaatttgctattgataaagaaaagatggaaattattgtttctaaactcttagaagagatggaaaatggacttcaagacaaaccaagtactcttcaaatgcttccaacgtatgctcctattcctactggaaaagaagttggtacttttatgggtattgatgttggtggaactaatcttagagtcttattattagaaatccctgaacctggtgttcgtggagaacttaaatcagttgaatgtattatgccaaaaacatcaacaaccgttgatcaattctttgggtttattgctcaaaagattaaagaatttgttgaaaataacaatttaaaagaaaaagaaattaaagctggattaacattttcttttgctgttgaacaaattgctatagacaaaggaattcaacaatcatggtcaaaaggatgggatgttaaggagtctattggaaaagacattgttgaaattttccataaccaacttgcaaaaatcaatgttaacaatattagaatagttgcatttatcaatgatacagtaggaacatttgccaatcttgcatatgatgatgcatcatgtggtatgggacttatttttggtacaggaactaatggatgttatattgagaaaacatcaaattttgctgcttctaaattgaaatcagtttataaagaagattatatgattgttaacaccgaatggggaggattacaatttccagaacttggactcaacagatttgatgatatgattaatgatgttagcgttaataaagaccaacaacgatatgaaaagatgatttcaggtatttacatgggatggttagcaagattagctattagagaattaattgagaaaaaagttatttttgaacgatatgctgatgctgaagttttttctaattcaccagatgacactcaatttaatgataaaaagaaatattcatcaagacatactgaaatagttgaagacacttctcctgaactttctcgtgttgacaccattttaaagtcacttggagttaatgactctactttagaagaaagaaagatccttaaggctataactgaggcagttgttaaaagagctgcttatctttctgcagctgcaacagttgccttataccgtaagatggttccatatatgaaagaaagaactactgctggtattgatggtactgtttatgaaaagtctgttccatttaagagattctatcttgaagcaatccgtcttttacaaccaaaagaaaactttacttgtcagttatctaaagatggatctggacttggtgctgtcattgttgctgctgctgttgcatgtaaacactaattgacaacttaaaaagaaaaa

SEQ ID NO: 10294 - protein, 445 aa, Entamoeba histolytica
MQEIIDQFAIDKEKMEIIVSKLLEEMENGLQDKPSTLQMLPTYAPIPTGKEVGTFMGIDVGGTNLRVLLLEIPEPGVRGELKSVECIMPKTSTTVDQFFGFIAQKIKEFVENNNLKEKEIKAGLTFSFAVEQIAIDKGIQQSWSKGWDVKESIGKDIVEIFHNQLAKINVNNIRIVAFINDTVGTFANLAYDDASCGMGLIFGTGTNGCYIEKTSNFAASKLKSVYKEDYMIVNTEWGGLQFPELGLNRFDDMINDVSVNKDQQRYEKMISGIYMGWLARLAIRELIEKKVIFERYADAEVFSNSPDDTQFNDKKKYSSRHTEIVEDTSPELSRVDTILKSLGVNDSTLEERKILKAITEAVVKRAAYLSAAATVALYRKMVPYMKERTTAGIDGTVYEKSVPFKRFYLEAIRLLQPKENFTCQLSKDGSGLGAVIVAAAVACKH

SEQ ID NO: 10295 - DNA, 1485 bp, Plasmodium yoelii yoelii
  CDS (1)..(1485)
atgagtgaatataatttaaagaaagatgatgattctccgttttataaattggatacaataaaatgtgaagttccaataaattctgaatttaacgataggattaataagtttgttaatcaattacgaatatcttatggaacattagaagagtttgttgataattttgtttatgaattaaaaaaaggtttagaagcacatcgtagacatccaaatttatggatcccacatgaatgtagttttaaaatgttagattcatgtatttctgatataccaacagggcaagaaagaggaacttattatgctattgattttggaggtacaaattttcgagcagtaagagcatcattagatggaaatggaaaaataaaaagagatcaagaaacttatagtttaaaatttactggtacattttcacatgaaaagggtttattagataaacatgcaactgcttctcaattatttgaccattttgctgaaaggataaaatatattatgggtgaatttaatgatttggatgataataatgaaaagagtgttggatttacattttcatttccatgtacttcaccatctattaactgttctattttaattgattggacaaaaggttttgaaacaggaagagcaactaacgacccagtcgaaggtcgagatgtttgcaaattaatgaatgatgcttttattcgatctagtgttcctgcaaaagtttcatgtgttgtgaatgatgcagtaggaacactaatgtcatgtgcatatcaaaaaggtaaatctgctccaccatgttatatcggaattattttaggaacaggttctaatggttgttattatgaaccagattggaagaaatataaatattcaggtaaaattattaatatagaattaggaaattttgataaagatttaccattatctccaatagatttagtcatggattggtattcagctaatagaagcagacaattatttgaaaaaatgatatctggagcatatttaggtgaaattgttcgaagatttatggttaatgttttacaaagcgcatcatctaaaaagatgtggcaatctgatagttttaattctgaatcaggtagtgttgttttaaatgatacaactcctgattttcgtgaatgtaaaaaaatagctaaacaaacatgggatatggattttacagatgaacaaatttatgcattaagaaaaatatgtgaagctgtttataatcgatcagcagcattagcagctgctgctatagctgccatagcaaaaagaatcaaaattattgaacactcaaaattctcatgtggtgttgatggctcattatttgtaaaaaacgcatggtattgtaatagattaaaagaacatttaagagttattttagctgacaaagctgaaaatcttattatcataccagcggatgatggttctggtaaaggagcagctatcactgcagctgtcgtttcgctgtctagcaacatgaagcagctcccataa

SEQ ID NO: 10296 - protein, 494 aa, Plasmodium yoelii yoelii
MSEYNLKKDDDSPFYKLDTIKCEVPINSEFNDRINKFVNQLRISYGTLEEFVDNFVYELKKGLEAHRRHPNLWIPHECSFKMLDSCISDIPTGQERGTYYAIDFGGTNFRAVRASLDGNGKIKRDQETYSLKFTGTFSHEKGLLDKHATASQLFDHFAERIKYIMGEFNDLDDNNEKSVGFTFSFPCTSPSINCSILIDWTKGFETGRATNDPVEGRDVCKLMNDAFIRSSVPAKVSCVVNDAVGTLMSCAYQKGKSAPPCYIGIILGTGSNGCYYEPDWKKYKYSGKIINIELGNFDKDLPLSPIDLVMDWYSANRSRQLFEKMISGAYLGEIVRRFMVNVLQSASSKKMWQSDSFNSESGSVVLNDTTPDFRECKKIAKQTWDMDFTDEQIYALRKICEAVYNRSAALAAAAIAAIAKRIKIIEHSKFSCGVDGSLFVKNAWYCNRLKEHLRVILADKAENLIIIPADDGSGKGAAITAAVVSLSSNMKQLP

SEQ ID NO: 10297 - DNA, 1698 bp, Neurospora crassa
  CDS (1)..(1698)
atggcatccctcaagctattaatcataaacgccctcaaatcgctctcgcgaggcaggtccttcctgcaagctttacttgccctttggatcagccccaagtccaaccccaacaaactcaaaaagatcaaagtatttcgaaggaccagggaggagtttcttaaagaggccaagaagctccttctcggaccgatcggcagcaatcacttcatcaaaaacagcggcccaaccccagacgaccctcttttgttactctccaagaagctcgaggcacaattcagacaaggcttacagaccagcccagcatgtatgcttccctcatacaaccaccaactacctggcggacacgaaagtggccagtatctggcggtcgacattggtggctcgacacttcgcgtgggtgtggtggacctgaagggccgacaaaccacagatgatgacgacagcaccattgtccatatggacagctacaaaatcgacaggaacgtccgattgcttcgaggggcatttttcttcaagtggatggctcggaaagtagagacaagcttgaagaaagcaattgacgctgggcacatttcgaaagcggaatatgagttgggaaacccaatgccaatgggtttggcgtggagcttccctctagagcaaacatcgcccaatggaggaaacatctgtcccatgggcaagagttttcttgcatgcgacggactgatgggacaggacttgggtgccacctgtaacaagattctccaagaactccgagtaaacgtcgaggttgtctcgatagtcaacgattccaacgccactttgctttcgtcggcatattccagcccatcggcacgcttcggactgattcttggaactggcgtcaacattgctgcccaccttccggtaaatctgattggaaaatccaaatttggggaacgacccgacagttggtatgagcaagcgagccatgtcatggtcaacaccgagttgggcatgtttggccgtgacattttgcccctgacgcgatgggacaagatactcaaagccggacacgaaaggcccgacttccagccgcttgagcatctggtaagtgggtactacctcggtgaggtgttccgaattgccttattggaggcgatcaagacgacgggtctgttgggaggaaagattccaccactgttgttggatgcgtattcgatggatacgggaaccatgtcattaatcatcaatggacgagatgccagaggaaaagccgaagcggtcttttcacagctctaccacctaccagccggttatcccagcaccgaggacatgcggttcatgcagcaactagcgggttatatcgcccagcgatcggcttccatcgtcgctgcctcggtgtttgcgttgtgggagctaaagaatgaggccgaacaaaacgttctgaacaaccttgagcccgagtcaccatttagcgaggagacagcattagagttaatgatggagcagaccacggtagggtataccggatcggttctggaatgttttccgggttacaaggagacactgcaaagatatttggaccagctgatgatgtcttcggggcacgatttgaaggggcggaggatagacttggttccggcaaaggagagttcactgcttggagcggccgtgtcgttggcgggtgttgtggaggaggagaggatggggttgaatgagaagaagggcatagcgtag

SEQ ID NO: 10298 - protein, 565 aa, Neurospora crassa
MASLKLLIINALKSLSRGRSFLQALLALWISPKSNPNKLKKIKVFRRTREEFLKEAKKLLLGPIGSNHFIKNSGPTPDDPLLLLSKKLEAQFRQGLQTSPACMLPSYNHQLPGGHESGQYLAVDIGGSTLRVGVVDLKGRQTTDDDDSTIVHMDSYKIDRNVRLLRGAFFFKWMARKVETSLKKAIDAGHISKAEYELGNPMPMGLAWSFPLEQTSPNGGNICPMGKSFLACDGLMGQDLGATCNKILQELRVNVEVVSIVNDSNATLLSSAYSSPSARFGLILGTGVNIAAHLPVNLIGKSKFGERPDSWYEQASHVMVNTELGMFGRDILPLTRWDKILKAGHERPDFQPLEHLVSGYYLGEVFRIALLEAIKTTGLLGGKIPPLLLDAYSMDTGTMSLIINGRDARGKAEAVFSQLYHLPAGYPSTEDMRFMQQLAGYIAQRSASIVAASVFALWELKNEAEQNVLNNLEPESPFSEETALELMMEQTTVGYTGSVLECFPGYKETLQRYLDQLMMSSGHDLKGRRIDLVPAKESSLLGAAVSLAGVVEEERMGLNEKKGIA

SEQ ID NO: 10299 - DNA, 1554 bp, Neurospora crassa
  CDS (1)..(1554)
atgtcgcactcggctgtgactaccatcggccagttcttgacgcccttggctctggacaatgccgttgctttgaaactctccagggaattctattccaacttcaaacacttgtgtaccgaatcgctgaatcagttcctaccaactcccatttccatgtccatcttgaggcctgtgggacgccaaagcaccggtcgtgttcatggtttccactccacccggtacttgatattgactttcgactttagtggtggttcaaacttgagagtgggcttcgtggaactcctatccgagggccaagatcgccgcctaaatcgtctcctcgagcagtcatggccgatcctggatcacctcaaacacgagaactcagaacatctctttggatgggttggagagcacattgcacaggtggttcggaaagggtgtgaaacttgggggttatcttcggacgaagagctgcccatgggcgtcaccttcagcttccccatgaagcagacctcgctttccgaagctactttgatggctatgggcaagggcttcgccatcacatcagatctagacctgggcggtcacctgatcaagggttacgaacagcacaggacagccggcttacctcctttaaaaatcgccgccatcaccaacgatgctgtggctacattggtatcctttgtatatcaatacccagccgcgcccaatcagaaagcagccatgggcctcattgtcggtactggatgcaacgctacgatccccctccagttcagcaaactgcacaaaaataaattcccgggtctgatcagtgttcagcaggactgggaccttttggacgtcgggattgcggtaaacacagaatggagcatcaacgggtcagcatcgccgctacgcatgcttgggttgattagtcgctgggacgacgagctggacaaggcatgcgaagcccctggtttccagccattagagtacatgaccgctggtcgctatctgggcgagttggcgaggctcatatttgtggactttttgaccactgtccaaggcgtcccgcctgaggatctgccccaggggcttcaccagcgctttggtctctccacaaccttcctcagtcatttctacccgggtagcgacaagggtgatattctggagcagttacagaaagagttcgacttgtccacggattcgacatttacatggacatccgatcatgcggacaccctgtatcacatagccaaggctatccaaactcgagcagcaggcattgtcgcggcggccactatcggacttttgcgctgcgctgacgagcttcctgacccgtcagaaccagttcgagttggcgtcgctaatggtgacaatgttgaagagcttgtagtgggatatactggcggctgtatacagcacttccaggattacttgaaagacacgcaagccttcttggattttatcacgcaggaagagttcgcagcccaagggaaaaggatacgtgtgaaactagagccctgccatgatgggggaatcacaggggcggggatcttggtgcctgctgctttggcaagcacccaggcgtag

SEQ ID NO: 10300 - protein, 517 aa, Neurospora crassa
MSHSAVTTIGQFLTPLALDNAVALKLSREFYSNFKHLCTESLNQFLPTPISMSILRPVGRQSTGRVHGFHSTRYLILTFDFSGGSNLRVGFVELLSEGQDRRLNRLLEQSWPILDHLKHENSEHLFGWVGEHIAQVVRKGCETWGLSSDEELPMGVTFSFPMKQTSLSEATLMAMGKGFAITSDLDLGGHLIKGYEQHRTAGLPPLKIAAITNDAVATLVSFVYQYPAAPNQKAAMGLIVGTGCNATIPLQFSKLHKNKFPGLISVQQDWDLLDVGIAVNTEWSINGSASPLRMLGLISRWDDELDKACEAPGFQPLEYMTAGRYLGELARLIFVDFLTTVQGVPPEDLPQGLHQRFGLSTTFLSHFYPGSDKGDILEQLQKEFDLSTDSTFTWTSDHADTLYHIAKAIQTRAAGIVAAATIGLLRCADELPDPSEPVRVGVANGDNVEELVVGYTGGCIQHFQDYLKDTQAFLDFITQEEFAAQGKRIRVKLEPCHDGGITGAGILVPAALASTQA

SEQ ID NO: 10301 - DNA, 1593 bp, Neurospora crassa
  CDS (1)..(1593)
atggccctcgagacccagacaaagaccgttgtcggtcagttcgactattcggacgaagatgtcaataagggcgtcgtagagttccttcgtcaaatggccgaaggtctcgagaaggatggcgctagcatgagccagattcccacatatgtcaccgccgtccccaatggcactgaaaagggtctttacatggctgtcgatctcggtggcaccaacttccgcgtttgctcaatccagctcaacggcgacaccacctttcgtctgacgtacaccaaggtcgctatccccagagagctcatggttgccaagaccgccgaggagctgttcgctttcttggcgaagcaggtcgaaatcttcctcaggacacatcatggagagcacttcgaggcacatatccgcagacgcatgaccatgagctcccccgagggcttcaaggacgagaacgtcttccgtctcggcttcacattcagtttccccgtccaacaattgggtatcaataagggtacgctcattcgctggaccaagggtttcgatatcccagacgccgttggaaaggacgtttgtgccctcctgcaaacggagattgacaagctccatctccccgtcaaggtcgctgctctcgtcaacgacactgttggcactttgatggctcgttcctactcttcccctggcaagagcggtgctattctcggtgctatcttcggtactggcaccaacggagcttatgtcgagaagctttccaacatcaagaagcccctagccggcgagtacgataaatctaccggagagatggtcatcaacactgagtggggttcgtttgacaaccagctcaaggtccttcctaacacaccatgggatgtccagctcgacctggccacccccaaccccggtattcagatgtacgagaagcgtgtctcgggcatgtacctcggcgagatcttgcgattgacggtcattgatctgcttaagaacccagacgttgctctcttcaaggacgataactcgagctacaatgactggaagtcaactaccaacattgccgaacactcccccatctacaagcagtggggtcttgatacctcggtcctctctgtcgctgccgctgacagtacccccgagttgtcgatcctccgtcaggagctcgaggccaacctccacatttatgccccctctttggaggacgctcaggctttcaaggccattgctggtgctatcggtcgtcgtgctgctcgtctttcggctgttgctattgctgccattgttttgcagaccggcaaactcaacgaccccgagcaggatgagcctatcgacattggtgttgacggaagcttggtcgagcactatccctacttccgtgacatgatctacgaggctctccgtgtcatcaaaggcattggtgaggagggtgccaagcggatccgtatcggtattgccaaggatggatccggtgttggtgccgcgttgattgctctcgtcgccgcccgcatggagaagagcacttccacagccgacttcatcagcgacctgcgtctcaacgccaagaagaccgacttgaccgctgtgcctgaggatagcgagcttgccgccggggaatag

SEQ ID NO: 10302 - protein, 530 aa, Neurospora crassa
MALETQTKTVVGQFDYSDEDVNKGVVEFLRQMAEGLEKDGASMSQIPTYVTAVPNGTEKGLYMAVDLGGTNFRVCSIQLNGDTTFRLTYTKVAIPRELMVAKTAEELFAFLAKQVEIFLRTHHGEHFEAHIRRRMTMSSPEGFKDENVFRLGFTFSFPVQQLGINKGTLIRWTKGFDIPDAVGKDVCALLQTEIDKLHLPVKVAALVNDTVGTLMARSYSSPGKSGAILGAIFGTGTNGAYVEKLSNIKKPLAGEYDKSTGEMVINTEWGSFDNQLKVLPNTPWDVQLDLATPNPGIQMYEKRVSGMYLGEILRLTVIDLLKNPDVALFKDDNSSYNDWKSTTNIAEHSPIYKQWGLDTSVLSVAAADSTPELSILRQELEANLHIYAPSLEDAQAFKAIAGAIGRRAARLSAVAIAAIVLQTGKLNDPEQDEPIDIGVDGSLVEHYPYFRDMIYEALRVIKGIGEEGAKRIRIGIAKDGSGVGAALIALVAARMEKSTSTADFISDLRLNAKKTDLTAVPEDSELAAGE

SEQ ID NO: 10303 - DNA, 1263 bp, Neurospora crassa
  CDS (1)..(1263)
atgaaccctacctgggttatgtccttccccgacggcaacgaaaccggtacttatctggctttggacatgggtggtacaaacctacgtgtctgccaagtcactttgaccgaaacaaagtccgaattcgacatcatccagtccaagtaccgcatgcccgaggagctcaagacgggcgacgccgaggagctgtgggagtacattgccgactgcctcatgcaattcattgaaacgcaccacggagacccaaccaagctcgatgcgcttccactcggttttactttctcctatccggcgacacagaactatatcgacgagggcattctgcaacgctggacgaagggcttcgatatcgctggcgtagagggccataatgttgtccccatgtttgaggctgccctccagcgccgggtaggttgcaccctgattgcctcggcatacactgatcctaagatgagaattggatgcatttttggcacaggttgcaatgctgcgtacatggagaactgtggctcgattcccaagctcgctcatatgaatctcccaccggatatgccaatggccatcaactgcgaatggggagcttttgacaacgagcataaggtcttgcctcgtactccttacgatgtcattattgacaaggattcgccgcgtcccggtcagcagtccttcgagaagatggtcgcagggttgtatctgggtgaaatcttccgcctggttttggttgacctccatgacaaccaggagatcaagatcttccctggccaggatatcgccaagcttcggaaagcttataactggcaactaacgaacacttgcagggatccgttcgagaacctttccgaaacctttgagctgtttcagaccaagctggggcttacacccaccggccccgaattggagctgattcgtcgcaccgccgagctaatcggtacccgcgccgctcgcctctccgcctgcggcgttgctgccatcagcaagaagaaaggatataagcagtgccacgttggtgctgatggatccgttttcaacaagtatcccaacttcaaggctcgtggcgcgcaagcactccgtgagatcctggactggcctgagaaggcggaccccaaggaagatgatccgattgagattctcgccgccgaggacggaagcggtgttggtgctgctttgatcgctgccctgacgatgcaacggatcaagcaaggaaatatgcacggtatcctgcacccagagaacttcagaactaccgagcctcttcctgcgtga

SEQ ID NO: 10304 - protein, 420 aa, Neurospora crassa
MNPTWVMSFPDGNETGTYLALDMGGTNLRVCQVTLTETKSEFDIIQSKYRMPEELKTGDAEELWEYIADCLMQFIETHHGDPTKLDALPLGFTFSYPATQNYIDEGILQRWTKGFDIAGVEGHNVVPMFEAALQRRVGCTLIASAYTDPKMRIGCIFGTGCNAAYMENCGSIPKLAHMNLPPDMPMAINCEWGAFDNEHKVLPRTPYDVIIDKDSPRPGQQSFEKMVAGLYLGEIFRLVLVDLHDNQEIKIFPGQDIAKLRKAYNWQLTNTCRDPFENLSETFELFQTKLGLTPTGPELELIRRTAELIGTRAARLSACGVAAISKKKGYKQCHVGADGSVFNKYPNFKARGAQALREILDWPEKADPKEDDPIEILAAEDGSGVGAALIAALTMQRIKQGNMHGILHPENFRTTEPLPA

SEQ ID NO: 10305 - DNA, 1557 bp, Cryptosporidium parvum
  CDS (1)..(1557)
atggaagaggaaaatcaagccaagaggctgtttgatttatatgaagaatattttttcctttcaaatttaaagctgctggagttggttgatgattttcacaaatctttagaagacggacttgaaaatcacgcaaatcgactaaaaattgacaaataccattccaattacaagccttttaaaatgttagactcttgtgttgatagacttccaactgggaaggaaaaaggagtttattatgctattgatatgggtggcactaatttacgatgtgttagagtaaatttacttggtaatggccaaagtgaaacaaaatttaaaaaggttaaattgtcagaaatgaaagtgtcttctactgggaaggttgtaaatagcaacaaaatttccaaagttgatcaagaagtcaatatttttgataaaactgtatcttcagaaacaatgtttaattcaattgcagttttctttaatgagtttttggatgaatgtggcgacttaaatgatttgaccaatgataataatgtaggcaatctcccattagaagttggcttcaccttttcttttcctatcgtgcaatctaaaattgcaagtgcaaaactggtaatatggacaaaagaaattgaaacaggtagattaactgatgatcctgttgaaggaaaagatattggtgatttattgaatttagcctttaaaagaaatggagtaccagctcaatgtaaatgcgttttaaatgatacagttggaacccttatatcagcaatgtatgatttaaatattaataattattgcgacaataaccactctttaaaagttaattttccaaataatatatctgaaaatcaaccattaattggaattgtggttggaactggagtaaatgcttgctaccttgaaccaaattcttcaaattttggttataaaggagttattattaatacagagtgtggagacttttattcaaccaaattacccataactgattgtgattactctatggattggtttagtgataatagaggagaacagatatttgaaaaaatgattagtggaacttatttaggagaaatctctcggttattaattatcaattttttaaaaaacaaaactccagagattttcttccaaaagaattcattaaaaactgaacatattgccaaaattattagccatttcaatgataatcatcaaaaatataaccaaaaccatgatttaaagtctattgaaaattatttaaaggaaacattttcttcaaatcttgatcataattccacttatattattgcaaaaatatcacagatggtactcatgagagcagcatctcttgtctcagccattattgctgcatttttcaaaaggtttaataagccacgcaatcaaattaccattgccatagatggatcagtttggactaaaatacccaaattccaaaaatacgttaaagattcactctcatctttgattcaagagagcggatatcttggctcaatacatttttatgaatcagatgatggatctggaagaggtgctgctattcttgctagcactacagtcaatacacattga

SEQ ID NO: 10306 - protein, 518 aa, Cryptosporidium parvum
MEEENQAKRLFDLYEEYFFLSNLKLLELVDDFHKSLEDGLENHANRLKIDKYHSNYKPFKMLDSCVDRLPTGKEKGVYYAIDMGGTNLRCVRVNLLGNGQSETKFKKVKLSEMKVSSTGKVVNSNKISKVDQEVNIFDKTVSSETMFNSIAVFFNEFLDECGDLNDLTNDNNVGNLPLEVGFTFSFPIVQSKIASAKLVIWTKEIETGRLTDDPVEGKDIGDLLNLAFKRNGVPAQCKCVLNDTVGTLISAMYDLNINNYCDNNHSLKVNFPNNISENQPLIGIVVGTGVNACYLEPNSSNFGYKGVIINTECGDFYSTKLPITDCDYSMDWFSDNRGEQIFEKMISGTYLGEISRLLIINFLKNKTPEIFFQKNSLKTEHIAKIISHFNDNHQKYNQNHDLKSIENYLKETFSSNLDHNSTYIIAKISQMVLMRAASLVSAIIAAFFKRFNKPRNQITIAIDGSVWTKIPKFQKYVKDSLSSLIQESGYLGSIHFYESDDGSGRGAAILASTTVNTH

SEQ ID NO: 10307 - DNA, 3213 bp, Brachydanio rerio
  CDS (99)..(2858)
gaagaacatgagcacgcgccctaagtgacttccaagcacttcagatcccattcaacccgcttaagaacttaaacagacccaaagtttacagaagaaagatgatcgccactcaattactagcgtactacttcactgagcttcaccatgaccacgtccagaaagtggacaagtacctgtatcacatgcgactgtccaatgagaacctgatggatgtgtccaagcgctttaggaaggagatggataaaggactgggtagagacacaaatccaaccgcagctgtcaagatgcttcccacctttgtacgctccacacctgatggcacagaaactggtgacttccttgccctggacctgggaggaaccaattttcgggttctgcttgtcaaggtgtccagtaatggaatgcagaaagtggagatggagaaccagatctatgccatttcagagaacatcatgaggggctgtgggtctgagctcttcgatcacatagccgaatgtttggccaatttccttgaaaaactgggcatcaaagagaagaagctgcctcttggcttcaccttttcatttccttgccagcagaccaaactagatgagagttttctggtgtcatggaccaaaggtttcaaggcaagtggagtggaggggaaagatgtcgtgagcctgttaagaaaagccatcaggaagagaggggactttgacattgacattgtagcagtgatcaatgacaccgttggcaccatgatgacctgcggttacgatgaccatcactgcgaaattggcctcattgtcgggacaggcaccaacgcgtgctacatggaggagatgcggcacttggagctggtggatggtgatgagggccgcatgtgtgtgaacatggagtggggcgcgttcggagatgacggtgccctggatgacctccgcaccgagttcgaccgggagatcgacgctggctctctcaaccccggcaaacagctattcgagaagatgattagtgggatgtacatgggcgagctggtcagactcatcctggtgaagatggccaaagatgggctgctcttccagggtcacaccacgccagatctgctcaccaccggacacttccagacttccttcgtctctgccattgaaaataggaaggatgatgagggtatagtgagtgcagagcaggtgttgagagggcttggactggacccgacacctgaagactgtgtagccacccagcgagtgtgtcagattgtgtccacgcgagctgctcatctctgtgctgcttcactagcggctgtgctacggcagatccgtgataacaaagcctcagacagattgcgcacctctatcggcgtggatggatcagtctacaaaaaccacccagagtttgctcggcgtctgaataagatggtgaggtctttggttccagactgtgacgtgcgtttcttgcgctctgaggatggcagcggtaaaggggctgccatggtcactgcagtggcataccgcttggcgaagcagcatgcagaacgtcagcgtgttctggacacactgcgtctcggtcgagatcagctcctggaggtgaagaaaaggatggaggaggaaatgaaacgaggcctggctaaaaaaacacacaacaacgccaccgtcaaaatgctgcccacctttgtgcgctccacaccagatggaacagagcgtggtgatttcttggcattggatctgggcggcacaaacttcagggtgctcttggtgcgcgttcgaggtgggaaaagacgaaacgtggagatgaataataagatctacaccatccctcaagacattacgcaaggcacaggcgaggagttgtttgatcacatagtgcactgtatcgctgacttcttggagtacatggggatgaagggggcttcacttcctcttggatttaccttctcatttccctgccatcaggacaaacttgaccagggtatcctgataaagtggacaaagggcttcaaggcctcgggttgtgaaggagaagatgtggcatccttgctgaaagatgccattcatcgctgtgaggagtttgatttggacgtagtggctgtggtgaatgacactgtgggcacgatgatgacctgtgggtacgaggacccgcaatgtgaagttggacttattgtgggtacgggaactaatgcgtgctacatggaggagatgtcaaacgttgagctggtggatggagatgaaggccgcatgtgtgtgaacatggagtggggggcattcggggaccaaggggagctggatgacatttggacagagtttgatcgagctgtcgatgaccagtctacttacccagggagacaacgatatgagaagatgatcagtgggatgtatcttggagagattgtcagaaatgtcctgttgcactttactgccaagggtctgcttttccgaggcaaactttcagagagactgaaaactcgcgggatcttcgagaccaagttcttgtcgcagattgaaagtgatcgtttggcattgaggcaggtccgctccatcctgcagcatctgggtttgaccagcagtacatgtgacgacagtattcttgtgaaggaggtttgcagcgtcgtgtccaaacgggcagcacagttgtgtggagctggtctggcagccgtggtggataaaatccgtctgaaccgtggcctcaatcagctcagcatcacagttggagtggacggcacgctctacaaacttcacccacactttgccaccatcatgcgggagacccttagagacctggcacccaattgtgaggtcagtctcgtccagtcagaagacggcagtggaaaaggtgctgccctcatcacagcggtggcctgtcgattaagagatgcggggaagtagtgactgagtgaaatgatctaaagggcaaaagataatgaggaggaaagaaaaagtgatgttctgagcttcctaagatttttagtgtatgtgtgtgtttgtgtgtgtgcgccacaatgtgaccttactgaaccaacactcctgttttgtccaagaatgtatcttatttatttttctccattttatgcttttgatcacactttgcaaagactcagcgtgtgctggtgggggggttatatgaagacaagggaaaaaaggaaagcaaataactagactacatcctttcatggttatattatatatttgtatagttactggtttgaatcattgtactttctataaaaaaaaaaaaaaaaaa

SEQ ID NO: 10308 - protein, 919 aa, Brachydanio rerio
MIATQLLAYYFTELHHDHVQKVDKYLYHMRLSNENLMDVSKRFRKEMDKGLGRDTNPTAAVKMLPTFVRSTPDGTETGDFLALDLGGTNFRVLLVKVSSNGMQKVEMENQIYAISENIMRGCGSELFDHIAECLANFLEKLGIKEKKLPLGFTFSFPCQQTKLDESFLVSWTKGFKASGVEGKDVVSLLRKAIRKRGDFDIDIVAVINDTVGTMMTCGYDDHHCEIGLIVGTGTNACYMEEMRHLELVDGDEGRMCVNMEWGAFGDDGALDDLRTEFDREIDAGSLNPGKQLFEKMISGMYMGELVRLILVKMAKDGLLFQGHTTPDLLTTGHFQTSFVSAIENRKDDEGIVSAEQVLRGLGLDPTPEDCVATQRVCQIVSTRAAHLCAASLAAVLRQIRDNKASDRLRTSIGVDGSVYKNHPEFARRLNKMVRSLVPDCDVRFLRSEDGSGKGAAMVTAVAYRLAKQHAERQRVLDTLRLGRDQLLEVKKRMEEEMKRGLAKKTHNNATVKMLPTFVRSTPDGTERGDFLALDLGGTNFRVLLVRVRGGKRRNVEMNNKIYTIPQDITQGTGEELFDHIVHCIADFLEYMGMKGASLPLGFTFSFPCHQDKLDQGILIKWTKGFKASGCEGEDVASLLKDAIHRCEEFDLDVVAVVNDTVGTMMTCGYEDPQCEVGLIVGTGTNACYMEEMSNVELVDGDEGRMCVNMEWGAFGDQGELDDIWTEFDRAVDDQSTYPGRQRYEKMISGMYLGEIVRNVLLHFTAKGLLFRGKLSERLKTRGIFETKFLSQIESDRLALRQVRSILQHLGLTSSTCDDSILVKEVCSVVSKRAAQLCGAGLAAVVDKIRLNRGLNQLSITVGVDGTLYKLHPHFATIMRETLRDLAPNCEVSLVQSEDGSGKGAALITAVACRLRDAGK

SEQ ID NO: 10309 - DNA, 1509 bp, Arabidopsis thaliana
  CDS (1)..(1509)
atgggtaaagtggcagttgcaacgacggtagtgtgttcggtggcggtatgtgcggcggcggcgttgatagtacggaggagaatgaaaagcgcagggaaatgggcaagagtgatagagatattgaaagcctttgaagaagattgtgcaacgccaattgccaaattgagacaagtggctgatgctatgactgttgagatgcatgctggtcttgcttctgaaggtggcagcaagcttaagatgcttattagctacgttgataatcttccttctggggatgagactggttttttctatgcgttggatctaggcggaacaaacttccgtgttatgcgtgtgcttcttggtgggaagcacgaccgtgttgttaaacgagaattcaaagaagaatctattcctcctcatttgatgaccgggaagtcacatgaattattcgattttatcgttgatgttcttgccaagtttgtcgctacagaaggcgaggactttcatctcccacctggtagacaacgggaactaggttttactttctcatttccggttaagcagctatctttatcctctggcactctcatcaactggacgaagggcttttccattgacgatacagttgataaagatgttgttggagaacttgttaaagctatggaaagagttgggctggacatgcttgtcgcagcgcttgttaatgataccattggaacacttgcgggtggtagatacactagcccggatgtcgttgtcgcagttattttgggcaccggcacaaatgcagcctatgtcgaacgtgcacatgcaattcccaaatggcatggtttgctacccaaatcaggagaaatggtgatcaacatggaatggggaaacttcaggtcatcacatcttccattgacagagtacgaccactctctagatgtcgatagtttgaatcctggtgaacagattcttgagaaaatcatttccggaatgtatctgggagaaatcttgcgtagagttcttctgaagatggctgaagaagctgccttctttggcgatatcgtcccacctaagctgaaaataccattcatcataaggaccccgaacatgtctgctatgcacagtgatacttccccggatttgaaggttgtaggaagcaagttaaaagacatattggaggtccagactagttctctgaagatgaggaaagttgtgatcagcctatgtaacatcattgcaagccgaggagctcgtttatctgctgcggggatctatggaatcctcaagaaaataggaagagacgcaacaaaagatggagaagctcagaaatctgtgatagcgatggacggtgggctattcgagcattacactcagttcagtgagtcgatgaagagttcattgaaagagttgcttggagatgaagtttcagagagtgttgaagtgatactgtcgaatgatggttcaggtgttggagctgcattacttgctgcttctcactctcagtatctcgaacttgaagatgactctgaaacaagttaa

SEQ ID NO: 10310 - protein, 502 aa, Arabidopsis thaliana
MGKVAVATTVVCSVAVCAAAALIVRRRMKSAGKWARVIEILKAFEEDCATPIAKLRQVADAMTVEMHAGLASEGGSKLKMLISYVDNLPSGDETGFFYALDLGGTNFRVMRVLLGGKHDRVVKREFKEESIPPHLMTGKSHELFDFIVDVLAKFVATEGEDFHLPPGRQRELGFTFSFPVKQLSLSSGTLINWTKGFSIDDTVDKDVVGELVKAMERVGLDMLVAALVNDTIGTLAGGRYTSPDVVVAVILGTGTNAAYVERAHAIPKWHGLLPKSGEMVINMEWGNFRSSHLPLTEYDHSLDVDSLNPGEQILEKIISGMYLGEILRRVLLKMAEEAAFFGDIVPPKLKIPFIIRTPNMSAMHSDTSPDLKVVGSKLKDILEVQTSSLKMRKVVISLCNIIASRGARLSAAGIYGILKKIGRDATKDGEAQKSVIAMDGGLFEHYTQFSESMKSSLKELLGDEVSESVEVILSNDGSGVGAALLAASHSQYLELEDDSETS

SEQ ID NO: 10311 - DNA, 1209 bp, Bacteroides thetaiotaomicron
  CDS (1)..(1209)
atggaaaaaaacatttttaagttagataatgaacagctcaaagcaattgtatgctcatttcgggataaaacagaagaagggttaaaaacggaaaatgcagagatacaatgcattcctaccttcattgctccaaaaacaacccatattaaaggaaagtcactggtacttgacctgggaggaaccaattatcgggtggcaatcgtagatttcgacaaagcaacaccaaccgttcacccgaacaatggctggaaaaaagacatgtcaattatgaagtccgtcggatatacccgcgaagagttattcaaagaattggccgatatgattataggaatcaaacgtgaggaagaaatgcctatcggttattgtttttcttatccggccgagtccgtaccgggtggagacgccaaactgttacgctggacaaaaggagtagatattaaagaaatggttggagaatttatcggaaaacctttactcgactatctgaatgaaagaaacaaaattaagtttacaggcatcaaggtagtaaacgatactatagccagtttattcgccggtctcacagataatagttatgatgcatatatcggcctcatcgtagggacaggaaccaatatggcaacttttatccctgccgataaaattgaaaaactggatcagtcatgcaatgcacatggattgattcctgtcaatttggaatcaggcaatttccatccgccctttctgactgcggtagatgataccgttgacgctatttccggtaatccgggaaagcaacgttttgagaaagcggtatccggtatgtatctgggagacatactgaaaacagcctttccgctggaagagttcgaagagaaattcgacgcacagaaactgacttccattatgaattacccggacatctacaaggatgtatatgtacaggtagcacaatggatttatggcagatccgcacaattggttgccgcctcacttacggggcttatcatgttactgaaatcctataataaagatatacgaaaagtttgcctggtagccgaaggcagtcttttctggagtgaaaacaggaaggataaaaactataacattctcgttatggaaaaactaagagaactccttcaattattcggcctggaagatattgaagtggatataaaaagtatgaataacgcaaacctgatagggacaggcattgcggcattatcataa

SEQ ID NO: 10312 - protein, 402 aa, Bacteroides thetaiotaomicron
MEKNIFKLDNEQLKAIVCSFRDKTEEGLKTENAEIQCIPTFIAPKTTHIKGKSLVLDLGGTNYRVAIVDFDKATPTVHPNNGWKKDMSIMKSVGYTREELFKELADMIIGIKREEEMPIGYCFSYPAESVPGGDAKLLRWTKGVDIKEMVGEFIGKPLLDYLNERNKIKFTGIKVVNDTIASLFAGLTDNSYDAYIGLIVGTGTNMATFIPADKIEKLDQSCNAHGLIPVNLESGNFHPPFLTAVDDTVDAISGNPGKQRFEKAVSGMYLGDILKTAFPLEEFEEKFDAQKLTSIMNYPDIYKDVYVQVAQWIYGRSAQLVAASLTGLIMLLKSYNKDIRKVCLVAEGSLFWSENRKDKNYNILVMEKLRELLQLFGLEDIEVDIKSMNNANLIGTGIAALS

SEQ ID NO: 10313 - DNA, 2751 bp, Gallus gallus
  CDS (1)..(2751)
atgatcgcgtcccatctgctcgcctatttcttcacggagctcaaccatgaccaggcgcagaaggtggacaaatacctgtaccacatgcggctctccgaggacacactgcaggaggtgtccgagcgcttccgcaaggagatggagaaggggctgggagccgacaccaaccccaccgcctccgtcaagatgctgccctccttcgtcaggtccaccccggacgggacagaggacggagacttcttggcactggacctgggcggcaccaactttcgtgtgctgagggtgaaggtgtccgacaacggcctgcagaaggtggagatggagagccagatctacgagatccacgaggacctcatgcgaggcagtgggatgcagctctttgaccacatcgccgagtgcctgggcaacttcatggagaagctgaaaatcaaggacaagaagctgccccttggcttcaccttctccttcccgtgtcaccagaccaagctggatgagagcatcctcgtcaactggacaaagggattcaagtgcagcagcgtggaggggaaggacgtggtgtccctgctgcgcagggccatcaaaaagcgcggggacttcgacatcgacatcgtggcggtggtaaacgacaccgttggcaccatgatgtcctgtggctatgatgaccagaactgtgaagtcggactcatcgtggggacgggcaccaacgcctgctacatggaggagatgaggcacatcgacctggtggagggggacgagggccggatgtgcatcaacatggagtggggcgccttcggggacgacggcgcgctcaacgacatcaggaccgagttcgaccatgagatagacatgggctcgctcaaccccggcaagcagctgttcgagaagatgatcagcgggatgtacatgggcgagctggtgcgcctcatcctggtgaagatggccaaggaggggctcctcttccaagggaagctctcttcggatctgcgcaccaccggacacttcgagaccagatttgtctccgctattgagaaggagaaagaggggctgcagaaagcccacgagatcctcaccaagctgggcctggagccatcccacgaggactgcctggccacccaccgcatctgccagatcgtctccacccgctcggccaacctctgtggggccacgctggccgcccgtctgcgccgcatcaaggagtataagggggtggacccgctgcgctccaccgtcggcgtggatggctccgtctacaagaagtacccgcactttgcccgacgcctccataagacagtgaggaagctgctgcccgactgcgagatccgattcgtgaggtcggaagatggcagtggtaaaggggcggccatggtgacggcggtggcctaccggctggcggcccagcacaaggcccggcagaagatcctggaggcgctgaagctgagccacgagcagctcctggaggtgaagcggaggatgagggttgaaatggagaaggggttgggcaaggagacgcacgcggaggccacggtgaagatgctgcccacatacgtgtgctcaactccagacgggacagaaaaaggagatttcctcgctctggacctgggggggacgaacttccgtgtgctgctggtgcgggtgcggaacgggatgcggcgcggcgtggagatgcacaacaagatctactccatccccctggaggtgatgcaggggacaggcgaggagctcttcgaccacatcgtccactgcatctccgacttcctggaatacatggggatgaagggagtgtcgctcccgctgggcttcaccttctccttcccatgcaagcagaccaacctggatgaggggattctcctcaagtggacgaagggtttcaaagccacgggctgcgaaggggaggacgtggtgagcctgctgaaggaggcaatccaccgcagagaggagtttgacctggacgtggtggcagtggtgaacgacacggtgggcaccatgatgacctgtggctacgaagacccctactgtgaagtcgggctgatagttggcacaggcagcaacgcctgctacatggaggagatgcggaacgtggagctggtggagggcgacgagggccgcatgtgtgtcaacatggagtggggtgcgtttggggacaacggctgcttggatgacatccagaccgagttcgatttggccgtagatgagctgtccctcaaccctgggaagcagagatttgagaagatgatcagcgggatgtacctgggggagatcgtccgcaacatcctgatggacttcaccaagcgagggctgctcttccgcggccgcatctcagagcggctcaagaccagagggatcttcgagacaaagttcctgtcccagatagaaagcgactgcctggccctgctgcaggtgcgctccatcctccagcacctgggcttggagagcacgtgtgatgacagcatcatcgtcaaggaggtgtgcaccgtggtggcccggcgtgccgcgcagctctgcggggccggaatggccgccgtggtggataagatccgcgagaaccgtgggctggacttcctcaaggtgacggtcggagtggatgggacgctctacaaactgcacccacacttctcggccatcatgcaggacacggtgaggcagctgtccccgtgctgcgaggtgacgttcctgcagtcggaggacggcagcggtaaaggcgcggcgctcatcacggccgtggcgtgccggatccgtgaggccggtcagtga

SEQ ID NO: 10314 - protein, 916 aa, Gallus gallus
MIASHLLAYFFTELNHDQAQKVDKYLYHMRLSEDTLQEVSERFRKEMEKGLGADTNPTASVKMLPSFVRSTPDGTEDGDFLALDLGGTNFRVLRVKVSDNGLQKVEMESQIYEIHEDLMRGSGMQLFDHIAECLGNFMEKLKIKDKKLPLGFTFSFPCHQTKLDESILVNWTKGFKCSSVEGKDVVSLLRRAIKKRGDFDIDIVAVVNDTVGTMMSCGYDDQNCEVGLIVGTGTNACYMEEMRHIDLVEGDEGRMCINMEWGAFGDDGALNDIRTEFDHEIDMGSLNPGKQLFEKMISGMYMGELVRLILVKMAKEGLLFQGKLSSDLRTTGHFETRFVSAIEKEKEGLQKAHEILTKLGLEPSHEDCLATHRICQIVSTRSANLCGATLAARLRRIKEYKGVDPLRSTVGVDGSVYKKYPHFARRLHKTVRKLLPDCEIRFVRSEDGSGKGAAMVTAVAYRLAAQHKARQKILEALKLSHEQLLEVKRRMRVEMEKGLGKETHAEATVKMLPTYVCSTPDGTEKGDFLALDLGGTNFRVLLVRVRNGMRRGVEMHNKIYSIPLEVMQGTGEELFDHIVHCISDFLEYMGMKGVSLPLGFTFSFPCKQTNLDEGILLKWTKGFKATGCEGEDVVSLLKEAIHRREEFDLDVVAVVNDTVGTMMTCGYEDPYCEVGLIVGTGSNACYMEEMRNVELVEGDEGRMCVNMEWGAFGDNGCLDDIQTEFDLAVDELSLNPGKQRFEKMISGMYLGEIVRNILMDFTKRGLLFRGRISERLKTRGIFETKFLSQIESDCLALLQVRSILQHLGLESTCDDSIIVKEVCTVVARRAAQLCGAGMAAVVDKIRENRGLDFLKVTVGVDGTLYKLHPHFSAIMQDTVRQLSPCCEVTFLQSEDGSGKGAALITAVACRIREAGQ

SEQ ID NO: 10315 - DNA, 2814 bp, Gallus gallus
  CDS (1)..(2754)
atgatcgccgcccagctcctggcctactacttcaccgagctcaaggaggatcaggtcaaaaagatcgataaatacctttacgccatgcggctctctgatgaaactctgatagacatcatggctcgcttccggagagaaatgaagaatggcctctccagagattttaacccaacagcgacagtgaaaatgctccctacctttgtgaggtccattcctgatggctcagagaaaggagatttcatcgctctggatctcggtggttcttactttcgaattctgcgggtgaaagtatcgcatgaaaagaagcagacggtacaaatggaaagtgaaatttataatacacctgaagatatcattcatggcagtgggacacggctttttgatcatgttgccgaatgcctgggagactttatggagaaacaacaaatcaaagacaagaaattaccggttgggtttaccttctctttcccgtgccgacaatctaagctggatgagggcattctgataacctggacgaagcgcttcaaagcgagcggagtggagggagcagacgttgtgaagctgcttaacaaggccatcaagaaacgtggggactatgatgcagatatcatggctgttgtgaacgataccgttggcactatgatgacctgtggttttgatgaccaacgttgtgaagttggcttgatcattggcactggtaccaatgcctgttacatggaggagatgcggcacattgacctggtggaaggggacgagggcaggatgtgcataaacacagagtggggggcctttggggatgacggctcactagaagacatcaggacagagtttgatagagagatcgaccgtggatccctaaatcctggcaagcaactgtttgagaagatggtcagcgggatgtacatgggggagctggtgaggctcatcctggtgaagatggccaaggagggactgctctttgaggggagaatcacccctgagcttcccaccaaaggaaagtttgagacaaagcatgtttctgccatagaaaagagcaaagaaggtttgaacaaagccaaagaaatcttaacccgcctgggggtggagccgtcccacgaggactgcatcgcagtccagcacgtctgcaccatcgtgtccttccgctcggccaacctggcggcctccacgctgggtgccatcctcaaccagctgcgggataacaaaggggtcggccgcctccgcaccaccgtgggtgtcgatggctccctctacaagatgcatccacagtatgctcggcgcttgcacaaaaccacccggcgcctggtgcctgactcggatgtgcggttcctgctgtcggagagcggcagtgggaaaggggcggcgatggtgacggcggtggcgtaccggctgtcggagcagcaccggctcatcgacgagacgctggctgagttcaagctcacccacgagcagctgctgcaggtgaagaagaggatgaggacagagatggaagcaggcctgaagaagaagagtcacgagactgccaaagtgaaaatgctgcccacctttgtccgcagcacgccggatggcacagagaacggagactttctggcgcttgaccttggagggacaaacttcagagtgttgctggtgaaaattcgcagtggtaaaaggagaacggttgaaatgcacaacaagatctatgcaattcctatagaggtgatgcagggaacgggagaagagctgtttgaccacatcgttacctgcatttcggacttcctggattatatgggaataagaggtgcacggcttcctcttggcttcacattctccttcccttgcaagcagaccagtctggacgctggtatccttctcaactggacaaaaggattcaaagctacagactgtgagggtgaagacgtggtgtatttgctaagagaaggaattaaaagaagagaggagtttgacttggatgtggtagctgtagtgaacgatacggtgggcacgatgatgacctgtgcttatgaagacccaaactgtgaaattggactcattgtgggaactggcagcaatgcctgttacatggaggagatgagaaacatagagatggtggatggtgagcaaggacggatgtgtgtgaacatggagtggggagctttcggggataatggatgcctggacgatatcaggacaatatatgacaaagcagttgatgactattcactaaatgctggaaagcaaaggtatgagaagatgatcagtgggatgtacctgggggaaatagtccgcaatattttgattgacttcaccaaacgagggttcctgttcagaggacagatctcagagactctgaaaaccaggcatatctttgaaaccaagttcctttcacagattgagagcgacaggttagccttgcttcaggtgcgaaccattctccagcagctggggctcaacagcacgtgcgatgacagtatcattgtcaagacagtgtgcggaggggtgtcaaagcgagcagctcagttatgtggtgccggaatggctgccgttgtagataaaattagggagaacagaggcttagagcacctggagataacggttggtgtggatgggactctgtacaaactacacccacacttttcgaggattatgcaccaaacagtcaaagacctggcacccaagtgtgatgtgaccttcctgctctcggaggacggcagtgggaaaggggcagcgctcatcacggcggtgggatgcagggttcgcgatgctgagcagaactgaactccacaaccctggccccgagtctgtcttgtgagcaccttctcctaaagacctgcccgg

SEQ ID NO: 10316 - protein, 917 aa, Gallus gallus
MIAAQLLAYYFTELKEDQVKKIDKYLYAMRLSDETLIDIMARFRREMKNGLSRDFNPTATVKMLPTFVRSIPDGSEKGDFIALDLGGSYFRILRVKVSHEKKQTVQMESEIYNTPEDIIHGSGTRLFDHVAECLGDFMEKQQIKDKKLPVGFTFSFPCRQSKLDEGILITWTKRFKASGVEGADVVKLLNKAIKKRGDYDADIMAVVNDTVGTMMTCGFDDQRCEVGLIIGTGTNACYMEEMRHIDLVEGDEGRMCINTEWGAFGDDGSLEDIRTEFDREIDRGSLNPGKQLFEKMVSGMYMGELVRLILVKMAKEGLLFEGRITPELPTKGKFETKHVSAIEKSKEGLNKAKEILTRLGVEPSHEDCIAVQHVCTIVSFRSANLAASTLGAILNQLRDNKGVGRLRTTVGVDGSLYKMHPQYARRLHKTTRRLVPDSDVRFLLSESGSGKGAAMVTAVAYRLSEQHRLIDETLAEFKLTHEQLLQVKKRMRTEMEAGLKKKSHETAKVKMLPTFVRSTPDGTENGDFLALDLGGTNFRVLLVKIRSGKRRTVEMHNKIYAIPIEVMQGTGEELFDHIVTCISDFLDYMGIRGARLPLGFTFSFPCKQTSLDAGILLNWTKGFKATDCEGEDVVYLLREGIKRREEFDLDVVAVVNDTVGTMMTCAYEDPNCEIGLIVGTGSNACYMEEMRNIEMVDGEQGRMCVNMEWGAFGDNGCLDDIRTIYDKAVDDYSLNAGKQRYEKMISGMYLGEIVRNILIDFTKRGFLFRGQISETLKTRHIFETKFLSQIESDRLALLQVRTILQQLGLNSTCDDSIIVKTVCGGVSKRAAQLCGAGMAAVVDKIRENRGLEHLEITVGVDGTLYKLHPHFSRIMHQTVKDLAPKCDVTFLLSEDGSGKGAALITAVGCRVRDAEQN

SEQ ID NO: 10317 - DNA, 1862 bp, Lycopersicon esculentum
  CDS (139)..(1635)
gaattcggcaccagctttgatccgatctcctctctgtaatttttattatttctccttaaaaaatcacaaatctttactttactcatttcatttttttctcagtggaccaactttttgccaacctcaaattccggcaaaatgaagaaagtgacggtgggagtcgccgtggttggtgcagctgcggtgtgtgcagtggcggtgttaatagtgaatcaccggatgcggaaatctagtaaatggggtcgtgctatggctattcttcgtgaatttgaagaaaagtgtaagactcaagatgcaaagcttaagcaagttgctgatgctatgactgttgagatgcacgccggacttgcttctgaaggcggcagtaagctcaagatgcttatcacttatgtggataatctacccactggtgatgaagctggcgtcttctatgcgttggatcttggtggaacaaattttcgagtattgcgagtgcaattgggtggaaaagatggtggtattattcatcaagaatttgctgaggcatcaattcctccaagtttgatggttgggacttcagatgaactttttgattatattgcggctgagcttgcaaaatttgttgctgcggaagaggaaaaatttcatcaacctcctggtaagcagagagaactaggtttcaccttctcattcccagtaatgcagacttcaatcaactccgggaatattatgcggtggacaaaaggcttctctattgatgatgcggttggtcaagatgttgttggagaactcacaaaagctatgaaaagaaaaggtgtcgatatgcgtgtctcagctctggtgaatgataccgttggaacgttagctggtggtaaatatacgcaaaaggatgtagctgttgctgttatcttaggtacagggaccaatgcagcttatgtggaacgggtgcaggcaattccaaagtggcatggtcctgtgccaaaatctggtgaaatggttatcaatatggaatggggtaattttaggtcatcccatctgccgttgacagagtatgatcatgcattggataatgagagtttaaatcctggtgaacagatatttgagaagatgacttctggcatgtacttgggagaaattttacgcagagttctacttagggtggctgaagaagctggcgtttttggtgatgaggtccctccaaagctcaaggaaccatttgtgttaaggacacctgatatgtctgctatgcatcatgacacatcctctgatctgaaagtggttggtgaaaagctgaaggatattttagagatatctaatacctccttgaagacgagaaaactagtggttgagctgtgcaatatcgttgccacacgtggggcaagacttgcagctgcaggtgtattgggcatcttgaaaaagatgggaagagatacgcctaagcagggtggttcagaaaggacggttatagccatggatggcgggttgtatgagcactatacagaatacaggatgtgtttagagaactctttgaaggacttgctgggagaggagttagcaacgagcatcgtttttgtgcactccaatgatggttctggcattggtgctgctcttcttgctgcctctcattcaatgtaccttgaagatcaagatgcttaggagtgtgacaaaagccatatcttgctagagggaactacctttagactcctctctagcgttttcggtattttctctcctttatgtaccatcaaaatgaaattaataatatctccagcagatacatttaacttttatctctaggagagttttcctaagagtgccttcataaacacacaattttcatggataaagagtccttttactacctgaaaaaaaaaaaaaaaaaa

SEQ ID NO: 10318 - protein, 498 aa, Lycopersicon esculentum
MKKVTVGVAVVGAAAVCAVAVLIVNHRMRKSSKWGRAMAILREFEEKCKTQDAKLKQVADAMTVEMHAGLASEGGSKLKMLITYVDNLPTGDEAGVFYALDLGGTNFRVLRVQLGGKDGGIIHQEFAEASIPPSLMVGTSDELFDYIAAELAKFVAAEEEKFHQPPGKQRELGFTFSFPVMQTSINSGNIMRWTKGFSIDDAVGQDVVGELTKAMKRKGVDMRVSALVNDTVGTLAGGKYTQKDVAVAVILGTGTNAAYVERVQAIPKWHGPVPKSGEMVINMEWGNFRSSHLPLTEYDHALDNESLNPGEQIFEKMTSGMYLGEILRRVLLRVAEEAGVFGDEVPPKLKEPFVLRTPDMSAMHHDTSSDLKVVGEKLKDILEISNTSLKTRKLVVELCNIVATRGARLAAAGVLGILKKMGRDTPKQGGSERTVIAMDGGLYEHYTEYRMCLENSLKDLLGEELATSIVFVHSNDGSGIGAALLAASHSMYLEDQDA

SEQ ID NO: 10319 - DNA, 1893 bp, Zea mays
  CDS (1)..(1530): n means a or g or c or t/u
atggtgaaggccgtggtggtgggcgcggcggtcgtggcgtgtgcggcggtcggggtggcggtggtgctggagcgccgccggcggaagcgagacgccgacctcctggggtccgcggaggcggagaggaggaggcgcgcggccgccgtcatcgaggaggtcgagagcagcctcgccacgcccacggcgctgctgcggggcatcgcggacgccatggtcgccgagatggagcgcggcctgcgcggggacatccacgcgcagctcaagatgctcattagctacgtcgacagcctccccaccggagatgaacatgggctgttttatgcactggatcttggagggaccaacttccgtgtgctgcgagtccagctaggaggaaaggagaaacgtgttgtcaaacaacagtatgaggaggtttccattccaccacatttgatggtcgggacttccatggaactatttgatttcattgctgctgcattggctaaatttgttggtactgaaggtgaagatttccaactcccagagggtaggcagagagaacttggtttcactttttccttcccggcgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacagagtgggggagcttcaaatccaacaaacttcctctttcagaatatgacaaagccatggactttgaaagtttgaaccctggagagcagatatacgaaaaaatgatttctggtatgtatctcggagagattgttcgaagaattttactgaagttagcacatgaagcttctctatttggggatgttgttccacctaagctggagctgccatttatattgaggacgccagatatggcagccatgcatcatgactcctcacatgacctcaaaactcttggagctaaactgaaggacatagtcggggtcgcggacacttccctggaagtaaggtacatcactcgtcacatctgtgaccttgtcgcagagcgtgcagcacgcctggccgccgcaggcgtgtacagcatcctgaagaagataggccgggacaaagtaccaagcggtggcggtaaaatgccgaggaccgtagttgccttggacggtgggctctacgaacactacaagaagttcagcagttgcgtagaagcgactctcacagacttgctcggcgaggaggcttcttcctccgtggtcgccaagctggccaacgacggctctggcattggagctgcgcttctcgcagcctcacactcccagtatcagtatggcgcgagtgactagtagtcctgaaatgggcgcggatcgagattttgagtgtagctctcatttatcttttcttttttcccttttcaaaacatctttttggggatttttttcggcttccttttgttggctattccgtggatgcacttacggctntgcattgggatgtagctagtatagagccaatgagtttggaggttatctaatggcacaaggcaggagcatggnaatggaagcagagcantnccattcatgctgtgcccattcttttgttccccttgtatggtgtaatctgnatnngtcgacgagcntctngagcgnaggntagctctagcncgcncgtgtggggggccnagntggcggccgncgagnatcncatac

SEQ ID NO: 10320 - protein, 509 aa, Zea mays
MVKAVVVGAAVVACAAVGVAVVLERRRRKRDADLLGSAEAERRRRAAAVIEEVESSLATPTALLRGIADAMVAEMERGLRGDIHAQLKMLISYVDSLPTGDEHGLFYALDLGGTNFRVLRVQLGGKEKRVVKQQYEEVSIPPHLMVGTSMELFDFIAAALAKFVGTEGEDFQLPEGRQRELGFTFSFPANQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSNKLPLSEYDKAMDFESLNPGEQIYEKMISGMYLGEIVRRILLKLAHEASLFGDVVPPKLELPFILRTPDMAAMHHDSSHDLKTLGAKLKDIVGVADTSLEVRYITRHICDLVAERAARLAAAGVYSILKKIGRDKVPSGGGKMPRTVVALDGGLYEHYKKFSSCVEATLTDLLGEEASSSVVAKLANDGSGIGAALLAASHSQYQYGASD

SEQ ID NO: 10321 - DNA, 1497 bp, Oryza sativa
  CDS (1)..(1497)
atggcggcggcggcggtggcggcagatcagaaggtggtgacgatgacgagcctccgggagggctgcgcttgcgcggcgcctcctgctgcagctgcgccgccgatgccgaagatggcggcggcgcagagggtggtggcggagctgagagaagcgtgcgcgacgccggcggcgaggctggcggaggtggccgcggcgatggccggcgagatggaggccgggctggcggtggagggcggcagcagcgagatgaagatgatcgtgtcgtacgtcgacagcctccccaccggcggcgaggaggggtcgtactacgcgctcgacctcggcggcaccaacttccgcgtcctccgcgtgcggcttgccggcggcggcgtcgccgagcgcgtggcgagggaggtcccgatccctcccggcctcatgtccggcggcggcgccacctcggagtgcctcttcggcttcatcgcctccgcgctagccgagttcgtcggcgaggaggaagaagaaggcggcctcgacggcggcgagagggagcttgggttcaccttctccttccccgtgcaccaaacctccatcgcgtcggggacgctcatccggtggacgaaggcgttcgccgtcgacgacgcgatcggcgaggacgtcgtggcggcgctgcaggcggccatgtcggagcgggggctcgacatgcgcgtgtcggcgctcatcaacgacaccgtcgggacgctcgccgcgggcagctactacgacgaggacgtcgtggccgccgtcatcctcggcaccggcacgaacgccgcctacgtcgaggacgccaccgccatcgccaagctacacccatcgcagctgccagcatcgaacaccatggtgatcaacaccgagtggggcagcttcgcctcgccgtgcctcccattgacggagttcgacgaagcactcgatcaggagagcctcaaccccggcgagcagacctacgagaagctcatctccgggatgtacctcggcgagatcgtcaggagggtcctcctcaagatctcctcccggtgcccctccctcctcggcggcgccggcgagctcgcgacgccgttcgtcctcaggacacccgacgtgtccgcgatgcaccacgacgagacgcccgacctgagcatcgtcggcgagaagctggaacgcacgctgggcatccgcggcacgtcgccggaggcgaggaggatggtcgtcgaggtgtgcgacatcgtcgccacgagggccgcccggctggccgcggcggggatcgtcgggatcctgaagaagatcgggagggtcgacggcggcgaggggcggaggaggaggtcggtggtcgccgtggacggcgggctgttcgagcactacggcaagttccggcggtgcatggagagcgcggtgagggagctgctcggagaggcggcggcggagagggtggtcgtcaagctcgccagcgacggctccgggctcggcgccgccctggttgcagctgctcactcgcagagagcataa

SEQ ID NO: 10322 - protein, 498 aa, Oryza sativa
MAAAAVAADQKVVTMTSLREGCACAAPPAAAAPPMPKMAAAQRVVAELREACATPAARLAEVAAAMAGEMEAGLAVEGGSSEMKMIVSYVDSLPTGGEEGSYYALDLGGTNFRVLRVRLAGGGVAERVAREVPIPPGLMSGGGATSECLFGFIASALAEFVGEEEEEGGLDGGERELGFTFSFPVHQTSIASGTLIRWTKAFAVDDAIGEDVVAALQAAMSERGLDMRVSALINDTVGTLAAGSYYDEDVVAAVILGTGTNAAYVEDATAIAKLHPSQLPASNTMVINTEWGSFASPCLPLTEFDEALDQESLNPGEQTYEKLISGMYLGEIVRRVLLKISSRCPSLLGGAGELATPFVLRTPDVSAMHHDETPDLSIVGEKLERTLGIRGTSPEARRMVVEVCDIVATRAARLAAAGIVGILKKIGRVDGGEGRRRRSVVAVDGGLFEHYGKFRRCMESAVRELLGEAAAERVVVKLASDGSGLGAALVAAAHSQRA

SEQ ID NO: 10323 - DNA, 1521 bp, Oryza sativa
  CDS (1)..(1521)
atggggaaggggacggtagtggggacggcggtggtggtgtgcgctgcagcggccgcggcggttggggtggcggtggtggtgtcgcggaggaggaggagcaagcgggaggcggaggaggagcggcggaggagggccgccgctgtgatcgaggaggtggagcagaggttctcgacgcccacggcgctgctgcgcggcatcgcggacgccatggtggaggagatggagcgcggcctccgcgccgaccctcacgccccgctcaagatgctcatcagctacgtcgacaacctccccaccggggatgagcacggactgttctatgctctcgatcttgggggcaccaatttccgtgttatacgtgttcagcttggaggaagggaaaagcgtgttgttagtcaacagtacgaagaggttgccattccacctcacctgatggttgggacttctatggaactgtttgacttcattgcggctgagttggaaagttttgtcaagaccgagggagaggatttccacttgccagagggcaggcagagagagttaggcttcaccttttctttcccagtgcaccaaacatcaatatcatcaggcactcttattaagtggacaaagggattttccatcaatggcacggtgggggaagatgttgtggctgaattgagcagggctatggaaaggcaagggcttgatatgaaagttacagctcttgttaatgacactgtaggcacattggctggcggaagatatgttgataatgacgttgctgctgctgtaatattaggcactggcacaaacgcagcctacgtggagcatgcaaatgcaattccaaaatggactggattactacctagatcaggaaatatggtgattaacatggaatggggaaacttcaagtcagaaaggcttcctcgttcagattacgataatgccttggactttgaaagtttaaacccaggcgagcagatatatgaaaagatgatttccggcatgtatcttggagagattgtgcgcagaatcttgcttaagcttgctcatgatgcttccttgtttggagatgttgttccaacaaagctggagcagcgctttatactgaggacgccggacatgtcagcgatgcatcatgatacctcacatgatctgaaacacctgggagctaagctgaaggatatcctgggggtcgctgatacttccctggaagcacgatacatcacccttcatgtctgcgacctcgttgcagagagaggtgcacgcttagctgctgctggtatatatggcattctaaagaagctgggcagggacagagtgccaagtgacggtagtcaaaagcagaggactgtcattgctctggatggtggtctctatgagcattacaagaagttcagaacctgcctagaagcaacgcttgcagacctgcttggagaggaggctgcctcatcagttgttgtcaagttggcaaacgatggctctggcatcggagctgcacttcttgcagcatctcactcccagtatgctagcgtcgagtag

SEQ ID NO: 10324 - protein, 506 aa, Oryza sativa
MGKGTVVGTAVVVCAAAAAAVGVAVVVSRRRRSKREAEEERRRRAAAVIEEVEQRFSTPTALLRGIADAMVEEMERGLRADPHAPLKMLISYVDNLPTGDEHGLFYALDLGGTNFRVIRVQLGGREKRVVSQQYEEVAIPPHLMVGTSMELFDFIAAELESFVKTEGEDFHLPEGRQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWTGLLPRSGNMVINMEWGNFKSERLPRSDYDNALDFESLNPGEQIYEKMISGMYLGEIVRRILLKLAHDASLFGDVVPTKLEQRFILRTPDMSAMHHDTSHDLKHLGAKLKDILGVADTSLEARYITLHVCDLVAERGARLAAAGIYGILKKLGRDRVPSDGSQKQRTVIALDGGLYEHYKKFRTCLEATLADLLGEEAASSVVVKLANDGSGIGAALLAASHSQYASVE

SEQ ID NO: 10325 - DNA, 1527 bp, Oryza sativa
  CDS (1)..(1527)
atggggagggtggggctcggcgtggcggtggggtgcgcggcggtgacctgcgcgatcgccgcggcgctcgtggcgcgcagggcgtcggcgcgggcgcggtggcggcgggcggtggcgctgctgcgggagttcgaggaggggtgtgccacgccgcccgcgaggctgcgccaggtcgtggacgccatggtcgtcgagatgcacgccggcctcgcgtccgatggcggcagcaagctcaagatgctgctcaccttcgtcgacgcgctccccagcgggagtgaagaaggtgtatattattctattgatcttggaggaacaaacttcagagtcttgagggtacaagttggtgcgggatctgtgatcgtcaaccaaaaggttgaacagcaacccatccctgaggaactgaccaaaggcactactgagggtttattcaactttgttgccctggcactaaagaattttcttgaaggagaagatgaccaagatggaaaaatggcacttggttttacattttctttccctgttagacaaatttcagtgtcttcagggtcattaattaggtggacaaaaggattttccatcagagacacggttggcagagatgttgctcagtgcttaaatgaagcgcttgccaattgtgggctaaatgtgcgggtcactgcattggtgaatgatacagtggggacattagctctagggcattactatgatgaagacacagtggctgctgtgataattgggtctggcaccaacgcttgctacattgaacgcactgatgcaattatcaagtgccagggtcttctaacgaactctggaggcatggtagtaaacatggagtgggggaatttctggtcatcacatttgccaaggacgccatatgacatcttgctggatgatgaaacacacaatcgcaatgatcagggctttgagaaaatgatatcaggaatgtatcttggggaaattgcaagattggtatttcatagaatggcccaggaatcagatgtttttggtgatgctgctgatagtctatccaaccctttcattttgagcacaccgtttctggccgcaattcgcgaggacgattcaccagatctgagcgaagtcagaaggatacttcgagaacatctgaagttgtctgatgattctctcttccagattcccgatgctcctctgaaaactcgacggctggtcgtgaaagtctgcgacattgtgactcgcagagccgcccgtctagccgctgcaggcatcgtggggatactgaagaagctggggagggatgggagcggcgcggcgtcgagcgggagaggtagagggcagccgaggaggacggtggtggcgatcgagggcgggctgtaccagggttacccggtgttcagggagtacctggacgaggccctggtggagatcctgggggaggaggtggcgcggaacgtgacgctgagggtgacggaggatgggtcgggggtcggggctgccctcctcgccgccgtacattcgtcgaatagacagcaacaaggaggtcccatatag

SEQ ID NO: 10326 - protein, 508 aa, Oryza sativa
MGRVGLGVAVGCAAVTCAIAAALVARRASARARWRRAVALLREFEEGCATPPARLRQVVDAMVVEMHAGLASDGGSKLKMLLTFVDALPSGSEEGVYYSIDLGGTNFRVLRVQVGAGSVIVNQKVEQQPIPEELTKGTTEGLFNFVALALKNFLEGEDDQDGKMALGFTFSFPVRQISVSSGSLIRWTKGFSIRDTVGRDVAQCLNEALANCGLNVRVTALVNDTVGTLALGHYYDEDTVAAVIIGSGTNACYIERTDAIIKCQGLLTNSGGMVVNMEWGNFWSSHLPRTPYDILLDDETHNRNDQGFEKMISGMYLGEIARLVFHRMAQESDVFGDAADSLSNPFILSTPFLAAIREDDSPDLSEVRRILREHLKLSDDSLFQIPDAPLKTRRLVVKVCDIVTRRAARLAAAGIVGILKKLGRDGSGAASSGRGRGQPRRTVVAIEGGLYQGYPVFREYLDEALVEILGEEVARNVTLRVTEDGSGVGAALLAAVHSSNRQQQGGPI

SEQ ID NO: 10327 - DNA, 1416 bp, Trypanosoma cruzi
  CDS (1)..(1416)
atgtccgctcgcctgaacaacctgctgcagcacattgctgtgaaagacaaagacagcgacacaatgcggcacctgaaacagcgcatggcgctggcgtccctcgcgaaccaattcacggtgggcaaggaccacctcaagcagctgatgttgtacatggtacaccagatgattgagggactggagggacgcgagagcactttgcgtatgctgccttcttacgtgtacaaaaccgatcccagcaaggcgacaggcgtcttctacgcacttgacctcgggggcacgaactttcgagtgctgcgtgtaacgtgcaaggaaggaagagtagcggaccgtgtggacgccaagtttgtgattccgcagcaggcactgcaaggaacggcagaggatttgtttggctttattgcgcagagtgtgaagaaaatgatggagcagaaagcaccggaggacttgaaccgcaccgtgccgcttggcttcacatttagctttccaacagagcagaaaggcgtcgatcacggtttcctgataaaatggacgaagggcttctcgacacggggtgtggaggggaaggacgtggtggaacttctgcagaaggcattgaaacgcatggaagtgaaggtgaaagtggtggcactctgcaacgacactgtcggtacgcttatcacgaactacttctttgaccccgacacgcaggttggcgtaatcatcggcaccggctccaacgcgtgctacttcgaggatgcctacgccgtgacgaaggagccctcagtggccgcgcgcggtacgacacagacaccaatcaacatggagtgcgggaactttgactccaagtacaagtttgtgctgccggtcaccgcgtacgacgaggcgatggatgccgttacgccgaaccgcaacttccagacgcaagagaagatggtctccggcatgtatcttggggaaatcagtcgccgcatgatagcgcaccttgccgagttgcattgcctcccaagtgctcttgcatccaagatggccaagccgtggagctttgagacgaaatttatgggcatgatatccgcagaccgcatgccgggtctgcagttcacgcggcaagtgttccaagagcttttccaagtcgacgtgacggatgttgcagacctgcacgtgatccgtgatgtgtgctgcctggtgcgcggccgcgctgcgcagatcagtgccatgttctgcagtgcgccacttgtgaagacaaggaaagagggccgtgcgacggtcgcgatcgatggctccgtgtttgagaagacaccctcattccgccgcctgctgcagcaaaacatgaacgccattctcggtcctgggtgtgatgtcacgacggcactcgcaagggacggcagcggcattggcgccgcttttatctccgcgctggttgtgaacgacaaataa

SEQ ID NO: 10328 - protein, 471 aa, Trypanosoma cruzi
MSARLNNLLQHIAVKDKDSDTMRHLKQRMALASLANQFTVGKDHLKQLMLYMVHQMIEGLEGRESTLRMLPSYVYKTDPSKATGVFYALDLGGTNFRVLRVTCKEGRVADRVDAKFVIPQQALQGTAEDLFGFIAQSVKKMMEQKAPEDLNRTVPLGFTFSFPTEQKGVDHGFLIKWTKGFSTRGVEGKDVVELLQKALKRMEVKVKVVALCNDTVGTLITNYFFDPDTQVGVIIGTGSNACYFEDAYAVTKEPSVAARGTTQTPINMECGNFDSKYKFVLPVTAYDEAMDAVTPNRNFQTQEKMVSGMYLGEISRRMIAHLAELHCLPSALASKMAKPWSFETKFMGMISADRMPGLQFTRQVFQELFQVDVTDVADLHVIRDVCCLVRGRAAQISAMFCSAPLVKTRKEGRATVAIDGSVFEKTPSFRRLLQQNMNAILGPGCDVTTALARDGSGIGAAFISALVVNDK

SEQ ID NO: 10329 - DNA, 1428 bp, Encephalitozoon cuniculi
  CDS (1)..(1428)
atgtttactatgcatttagctaaagtatttgctgctttcatagctgggacacttggtatgtggcctgcgctagctgtaagtacggaggaggctgttaaggccagcttatttcccatggaggacttcgagatcatggagataagaaaagcctttattgaaaggatcacaagggtacgggaagatgcttctagtggagattttctggattcccatatcgatcttagtaaagcaaggatgccatatcaggagagccgctcagtactagttatagatgtcggaggaacaagtctgaagataagtgaggttgtcatcgaccttggttctgacgaaaagggaaactctccgtctttccacgacatagtggaatgtagcccatctttctacagatatcctgacacctcgggtgtttcgggccaagacaggataagctggaacgagtgggttgcagaccaggttgttgaattctatggcagaaaccctccaagaagtaaggttaatgcatctctgacattctcctatcctcttatccagacatctgttaataacgcacaaataaaaaagacaacaaagaacttctgcttcagagaggacgaggccacgtttaccacggacatagtcgaggccctcaactcctcgctgaggagcaggaagatcaacgtctgtgtcaactgcgtcttaaatgactccacagcaacatacatggcaggagtgctcaggggatataagaacataatcgggattgttcttgggacagggacaaactcgtccttctgtgtgaagaagggcagaagcaatgaggtggtactatacaactccgaatggggatccacaagagttccaaggagcatgttaacagaagcagaccttgccgttgttgtggacctggaaatgagaaagatttcgcataacatcattgacgtcttagcaggcggctgtaaacttggtgacatcgttcttcacaaacttagaaatacgtatcctgaaatttatgaggaatacgcagagagggaagaggtgctccattcgatgatccactcagccatcaccggatctggaaacggcgcactggctaaaagccccaaactacgcaacgcactgatgcccatagttcgtgactttagggccaggggaatgaagatattggcatccttaataggtgctgtggtcgaatccaccatggataatgcaaacacaatcacgctcgttctgaacggaacaaccttctcgaatgcaggcctcagagatgctcttggaatggaggtaaaaaggatgcatccggatatcgagatcaaccttgtcttccttagtaatgcctctctggaaggatctgcacttgtatcccttatgtattccgagtaccccaaggtagaatgtgacttggcaccacttgccgctccagtcctttcatttgccgatcagactccttag

SEQ ID NO: 10330 - protein, 475 aa, Encephalitozoon cuniculi
MFTMHLAKVFAAFIAGTLGMWPALAVSTEEAVKASLFPMEDFEIMEIRKAFIERITRVREDASSGDFLDSHIDLSKARMPYQESRSVLVIDVGGTSLKISEVVIDLGSDEKGNSPSFHDIVECSPSFYRYPDTSGVSGQDRISWNEWVADQVVEFYGRNPPRSKVNASLTFSYPLIQTSVNNAQIKKTTKNFCFREDEATFTTDIVEALNSSLRSRKINVCVNCVLNDSTATYMAGVLRGYKNIIGIVLGTGTNSSFCVKKGRSNEVVLYNSEWGSTRVPRSMLTEADLAVVVDLEMRKISHNIIDVLAGGCKLGDIVLHKLRNTYPEIYEEYAEREEVLHSMIHSAITGSGNGALAKSPKLRNALMPIVRDFRARGMKILASLIGAVVESTMDNANTITLVLNGTTFSNAGLRDALGMEVKRMHPDIEINLVFLSNASLEGSALVSLMYSEYPKVECDLAPLAAPVLSFADQTP

SEQ ID NO: 10331 - DNA, 1907 bp, Solanum tuberosum
  CDS (57)..(1556)
gccgctcccctttttttctccgtcacacaattgaattgatctcactgttacccaaaatgtcggtcaccgttagctcgccggccgtccgatccttccatgtttcacgatcacctcataaaacgatctataggccacgtgtcattatgtctgccgtccgatctagtgatagcttaggagtagcaccaattttgactaagttgcagaaagactgtgctactcctctcccagttttgcgccacgtggcggatgcaatggccgatgatatgcgggccgggcttgccgtcgatggcggcagtgatctgaagatgatccttagttatgtcgacactctaccaactgggaatgagaaaggcttgttttatgcgttggaccttggtggtacaaatttccgagtgctaagggtgcagctaggtggtaaagaagagcgtgtagtcgccactgagtttgagcaagtctctatacccccagaattgatgtttgctacctccgaggagctgttcgatttcatagcttctgcgctaggaaaatttgcacaaaaggaaggtggtaattttgagttgcaacagggacggacaagggaaataggattcacgttttcttttccagtgaaacagacttcaataagaactggaatcctaatcaaatggacaaaaggttttgctgtctctggaactgcaggaaaagatgttgttgcttgtttaaatgaagccatggagaggcggggaatggatatgcaagtgtctgccctggtcaatgacactgtgggaacacttgccggagcaagatactgggatgatgatgccatggttgctgtcattcttgggactggaaccaatgcttgctatgtagaacgtgtggatgctattcctaagctgacaaaaaggatgtccaagtctccaataacgattgtgaatactgaatggggagctttctcaaatggccttcctttaactgagtttgatagagaaatggatgccgagagcattaaccctggtgagcagatttttgaaaagaccatctccggtatgtaccttggggaaattgtgagacgggtgctggtcaaaatgtccaaggttgggggcttatttggtggcagctatgttccggaaaagttagtcactccatttgtgctgaggacacctgatatatgtgccatgcagcaggatacatcaagagatcttgaagctgttgaatctgtcctctatgatgtagctggggtaaaatccgatctaagtgcaaggaaaacagtcgtggacatttgcgatactattgcaaaacgagggggtcgtctggctggtgcaggaattgttgggattctacagaaaatggaggaggattctaaaggcctcatctttggtaaaagagcagttgtagcaatggatggaggcttatacgagcactatcctcagtacagaggatacctccaagaagctgtcacagagttactaggctcggaaatttcgaaaaatgtagtgatagaacattcaaaagatggttctggaattggagctgcattattagctgctgcaaactcaaagtatgaacatgattattaaggagaatgctaaatttcatgtctttcaaaggtttgcttgaggaaaaattacatgagcatttgtaattttcttgtaatttagaatgttctaagaaggattgatcattggacttctcattctttaagtagaggctcttgtttgtgatgccatttttgtactcccattagtgatgtacgaagaagtgaggattcatatagccaaccccaatttgtttgggaccgaggcatagttgttgttgtattatgcagcagtgacttatttatgtgataaaagcagatgtatcagtaaatatagaacatcttgtttgtttataattatgaaataagcacatttctttggtgttttagcggc

SEQ ID NO: 10332 - protein, 499 aa, Solanum tuberosum
MSVTVSSPAVRSFHVSRSPHKTIYRPRVIMSAVRSSDSLGVAPILTKLQKDCATPLPVLRHVADAMADDMRAGLAVDGGSDLKMILSYVDTLPTGNEKGLFYALDLGGTNFRVLRVQLGGKEERVVATEFEQVSIPPELMFATSEELFDFIASALGKFAQKEGGNFELQQGRTREIGFTFSFPVKQTSIRTGILIKWTKGFAVSGTAGKDVVACLNEAMERRGMDMQVSALVNDTVGTLAGARYWDDDAMVAVILGTGTNACYVERVDAIPKLTKRMSKSPITIVNTEWGAFSNGLPLTEFDREMDAESINPGEQIFEKTISGMYLGEIVRRVLVKMSKVGGLFGGSYVPEKLVTPFVLRTPDICAMQQDTSRDLEAVESVLYDVAGVKSDLSARKTVVDICDTIAKRGGRLAGAGIVGILQKMEEDSKGLIFGKRAVVAMDGGLYEHYPQYRGYLQEAVTELLGSEISKNVVIEHSKDGSGIGAALLAAANSKYEHDY

SEQ ID NO: 10333 - DNA, 1509 bp, Oryza sativa
  CDS (1)..(1509)
atgaggaaggcggcggcgctggcgtccgcggcgatggccgcagcagcagtagcggtagtctccacggtgttgcaccagaggcaacgtcgggcggcgaagcggtcagagcgcgcggaggccgtgctgctgcgggacctgcaggagcggtgcgccgcgccggtggagctgctgcggcaggtggcggacgcgatggccgcggagatgcgcgcggggctcgccgccgagggcgggagcgacctccagatgctcgtcacctacgttgactccctcccctccgggggtgagaaagggatgttttatgcacttgaccttggaggaacaaatttccgtgttttacgagttcaattaggaggcaaagaacgtcgaattatcaagcaagactcagaagggatatccattccacaacatttaatgtccagcagttcacatgagttgtttgattttgttgctgtggctttagcaaaatttgttgcctctgaaggtgaagactgccatcttcctgagggtacccaaagagaactaggttttacattctcctttccagtgaaacaaaaatcattggcatctggcactcttatcaagtggacgaagagttttgcaattgatgaaatggtcggcaaggatgttgtggctgaattaaacatggctatcagaagtcaaggacttgatatgaaagtcacagcattggttaatgatacagtagggacattagctgctgggagatatgtgaatcatgatactattgctgctgttatactgggaacaggtagtaatgcagcgtacatagatcatgcagatgcaattccaaaatggcatggatccctgcccaagtctggaaatatggtaataaacatggaatggggtaactttaagtcctcacatcttccacttactgaatttgatcaagagttggatgcagaaagtttgaaccctggcaaacaggtttacgagaaatcgatttctggtatgtatatgggggaacttgttcgaagaatcttactaaagatggctcaagaaactcgcatttttggtgataatatacctccaaaacttgagagaccatacatcttaaggacacttgacatgctgatcatgcatcatgatacatcatctgatctcagaacagttgccaacaagttgaaagaagtcttggggatcgaatatacctctttcacgacgaggaaactggttttggatgtttgtgaggccattgcgacacgcggtgcacggcttgctgctgctgggatatatggcattatccaaaagcttggtcagcattctgacagccccagtacgagaaggtccgtgattgctgtggatggaggggtctataaatactacactttcttcagccagtgcatggagagcactctgagtgacatgcttgggcaggagctggccccctctgttatgatcaagcatgtcaatgatggctcaggcgttggggcagctctcctggcagcctcttattctcaataccaccaggctgaatctgcagatagttcataa

SEQ ID NO: 10334 - protein, 502 aa, Oryza sativa
MRKAAALASAAMAAAAVAVVSTVLHQRQRRAAKRSERAEAVLLRDLQERCAAPVELLRQVADAMAAEMRAGLAAEGGSDLQMLVTYVDSLPSGGEKGMFYALDLGGTNFRVLRVQLGGKERRIIKQDSEGISIPQHLMSSSSHELFDFVAVALAKFVASEGEDCHLPEGTQRELGFTFSFPVKQKSLASGTLIKWTKSFAIDEMVGKDVVAELNMAIRSQGLDMKVTALVNDTVGTLAAGRYVNHDTIAAVILGTGSNAAYIDHADAIPKWHGSLPKSGNMVINMEWGNFKSSHLPLTEFDQELDAESLNPGKQVYEKSISGMYMGELVRRILLKMAQETRIFGDNIPPKLERPYILRTLDMLIMHHDTSSDLRTVANKLKEVLGIEYTSFTTRKLVLDVCEAIATRGARLAAAGIYGIIQKLGQHSDSPSTRRSVIAVDGGVYKYYTFFSQCMESTLSDMLGQELAPSVMIKHVNDGSGVGAALLAASYSQYHQAESADSS

SEQ ID NO: 10335 - DNA, 1768 bp, Brassica oleracea
  CDS (29)..(1528)
tgtccttttgtcttagagatcgaatcttatgggtaaagtggctgttggtgcgacggtcgtgtgcgctgcggcggtttgcgcggcgtctgtgtacatcgtgcggcggcggatgcaaagctccgggaaatgggcgcgtgtgatagagatcctgagggttctcgaggaggattgcgcgacgccaatcgggaaactgagacaagtggcggatgcgatgacggttgagatgcacgcgggtctcgcttccgaaggtggaagcaagcttaagatgcttatcagctacgtcgataatcttccttctggggaagaacatggtttcttttatgcgctggacctaggaggaacgaacttccgtgtgatgcgtgtgcttcttggtggcaaacaaggccgtgttgtcaaacaagaagccaaagaagtctctattcctcctcatttgatgaccagcggttcagatgagctgttcaattttatcgctgaagcgcttgcaaatttcgtggctacagaaggagaggactttcatctcccagagggtagacaaagggagctaggtttcactttctcgtttccggttaagcagacatctttgtcttctggcactctcatcaagtggaccaaaggcttctccatcgaagatacagttggacaagatgtggttggtgcgcttgttaaagctatggaaagagttgggcttgacatgaatgtcacagcccttgttaatgataccgttggaacacttgctggtggtagatactataaccctgatgttgtcgccgctgttattctaggcactggcacaaacgcagcttatgttgaacgtgcacatgccattcccaaatggcacggcttacttcccaaatctggagaaatggtgatcaacatggagtggggaaacttcaggtcatcacatcttccattgacggagtacgaccacttgctggatttcgatagtctgaatcctggtgaacagattcttgagaaaatcatttctggtatgtatttgggagagatcttgcgtagagtccttctgaaaatggctgacgaggctgctttctttggcgactctgtcccacctaagctgagaataccattcataataaggacaccaaacatgtctgctatgcacagcgacacttctccggatttgaaggttgttggaagcaagttaaaggacatattggaggtccctaccacttctctgaagatgagaaaagttgtggtcagtctgtgtgacatcatagcttgccgcggagctcgtctatcagctgcagggatctacggaatcctcaagaaactaggaagagacgcaccgaaagacggagagacgcagaaatctgtgatagccatggacggtggactgtttgagcactacactcagttcagcgagtgtatggagagctcgttgaaagagttgcttggagatgaagcatcagacagcgtggaggtgattcattcgaatgatggatctggcgttggagctgcattactcgctgcctcgcactctcagtacctcgatgactctcaaacaagttaagttaaagaaggtttggactttcaatggactctttgtttgcctttagggtttaaacaaataaaagagagaaaaaaaaggtaagcccttccttttgaggaaagtttttttttttatatttttgttatcaaagtacgagaacagtaataaaccatggatggtttcgtctccagggtatggcaaatttcaagaatcagccaaaatgttgtagaactatatatttctgagttctatatataaaaa

SEQ ID NO: 10336 - protein, 499 aa, Brassica oleracea
MGKVAVGATVVCAAAVCAASVYIVRRRMQSSGKWARVIEILRVLEEDCATPIGKLRQVADAMTVEMHAGLASEGGSKLKMLISYVDNLPSGEEHGFFYALDLGGTNFRVMRVLLGGKQGRVVKQEAKEVSIPPHLMTSGSDELFNFIAEALANFVATEGEDFHLPEGRQRELGFTFSFPVKQTSLSSGTLIKWTKGFSIEDTVGQDVVGALVKAMERVGLDMNVTALVNDTVGTLAGGRYYNPDVVAAVILGTGTNAAYVERAHAIPKWHGLLPKSGEMVINMEWGNFRSSHLPLTEYDHLLDFDSLNPGEQILEKIISGMYLGEILRRVLLKMADEAAFFGDSVPPKLRIPFIIRTPNMSAMHSDTSPDLKVVGSKLKDILEVPTTSLKMRKVVVSLCDIIACRGARLSAAGIYGILKKLGRDAPKDGETQKSVIAMDGGLFEHYTQFSECMESSLKELLGDEASDSVEVIHSNDGSGVGAALLAASHSQYLDDSQTS

SEQ ID NO: 10337 - DNA, 1500 bp, Brassica oleracea
  CDS (1)..(1500)
atgggtaaagtggctgtcggtgcgacggttgtttgcgctgcggcggtttgcgcggcgacggtgtatgtggtgaggcggcggatgaaaagctgcgggaaatgggggcgcgtgatagagatcctgaaggtgttcgaggaggattgcgcgacgccgatagggaagctgagacaagtggcggatgcgatgacggttgagatgcacgcgggtctcgcatcggaaggtggaagcaagcttaagatgctcatcagctacgtcgacaatctcccttctggggatgaacaaggtttcttttacgcgctggacctaggaggaacaaacttccgtgtcatgcgtgtgcttctcggtggcaaacaagaccgtgttgtcaaacaagaattcgaagaagtctctatccctcctcctttgatgaccggtgcttcagatgaattgttcaattttatcgctgaagcgcttgcaaagttcgtcgctacggaaggagaggactttcatctcccagcgggtagacaaagggagttaggtttcactttctcgtttcctgttaagcagacgtctttgtgctctggcactctcatcagctggactaaaggcttctccatcgaagatgcacttggacaagatgttgtgggagagcttattaaagctatggaaagagttgggctcgacatgaatgtcacagcgcttgttaatgatacggttggaacacttgctggtggtagatactataactctgatgttgtagccgctgttattctaggcactggcactaatgcagcttatgtcgaacgcgcaaatgccattccaaaatggcagggcttacttcccaaatctggagaaatggtgatcaacatggagtggggaaacttcaggtcatcacatcttcccttgaccgagtacgaccacttgctggatttcgatagtttgaatcctggtgaacagattcttgagaaaataatttccggtatgtatttgggagagatcttgcgtagagttcttctgaagatggctgaagaggctgctttctttggcgactccatcccacctaagctgaaagtaccattcatcataaggactccgaccatgtctgctatgcacagcgacacttctccggatttgaaggttgttggaagcaagttaaaggacatactggaggtccctactactctgaagatgagaaaagttgtgatcagtctctgtaacatcatagccacccgaggagctcgtctctctgcagctgggatctacggaatcctcaagaaactaggaagagacgcacctaaagatggagaaacaacgcagaaatctgtgattgccatggacggtggactgttcgagcactacactcagttcagtgagtgtatggagagctcattgaaagagttgcttggagatgaagcatcagagagcgtcgaggtgattcattcgaatgacgggtccggcgttggcgctgcattgctcgctgcctcgcactctcagtacctcgaggactctgaaacaagttaa

SEQ ID NO: 10338 - protein, 499 aa, Brassica oleracea
MGKVAVGATVVCAAAVCAATVYVVRRRMKSCGKWGRVIEILKVFEEDCATPIGKLRQVADAMTVEMHAGLASEGGSKLKMLISYVDNLPSGDEQGFFYALDLGGTNFRVMRVLLGGKQDRVVKQEFEEVSIPPPLMTGASDELFNFIAEALAKFVATEGEDFHLPAGRQRELGFTFSFPVKQTSLCSGTLISWTKGFSIEDALGQDVVGELIKAMERVGLDMNVTALVNDTVGTLAGGRYYNSDVVAAVILGTGTNAAYVERANAIPKWQGLLPKSGEMVINMEWGNFRSSHLPLTEYDHLLDFDSLNPGEQILEKIISGMYLGEILRRVLLKMAEEAAFFGDSIPPKLKVPFIIRTPTMSAMHSDTSPDLKVVGSKLKDILEVPTTLKMRKVVISLCNIIATRGARLSAAGIYGILKKLGRDAPKDGETTQKSVIAMDGGLFEHYTQFSECMESSLKELLGDEASESVEVIHSNDGSGVGAALLAASHSQYLEDSETS

SEQ ID NO: 10339 - DNA, 3476 bp, Homo sapiens
  CDS (450)..(3203)
gttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggcattcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttag

SEQ ID NO: 10340 - protein, 917 aa, Homo sapiens
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 10341 - DNA, 1377 bp, Xenopus laevis
  CDS (1)..(1377)
atggaaacatttgaccagaatgaggtggatcagatcctgtctgagttccatctgcaggaggaagatttgcatgttctgatgtgcaggatgcaggctgagatggagaggggtcttcacctggaaaccaatgaggaggccagtgttaaaatgctgcccacctatgttcgctcaacacctgatggctctgaggtgggtgacttcctagccctggaccttgggggcaccaacttccgtgtcatgttggtaaaggttggggaggatttggaagggcagtggaaagtggagacaaaacacaaaatgtattcaattccagtggatgccatgactggaacagcagagatgctatttgactacattgcagaatgcatttctgattacctggaccagcaaaacatgaagcacaagaaactgcccttgggatttactttctctttcccggttagacatgaggatatcgacaagggtattcttctcaattggaccaaaggattcaaagcatctggagcagaaggaaacaatgttgttggacttctcagagatgcaatcaagagacgtggtgattttgaaatggatgtggttgccatggtaaatgatacagtggctactatgatatcttgttactatgaagaccatcactgtgaggttggcttgatcgtagggactggctgcaacgcttgctacatggaggagatgagtaatgtggagctggtggaaggagaggagggacgtatgtgtgtgaacacggagtggggagcatttggagacacgggggagctggaggatttccgactagagtacgaccgagtggtggatgaggcatctcttaatcctggtcagcaactctacgaaaagatgattggtggaaaatacatgggggagctggtcagactggtcctgataaagatggtgaatgagaatctgttatttggaggagaatcttctgaaaagctgaagacccgaggagccttcgaaacacaatttgtgtcccagatagaggcggacacctccgattttaaacagactctcaacatcctgcggactctaggagtacaggccacaattggagactgtcatgctgtgcgcttagcatgtgagagtgtatctactcgagctgccatcatgtgttctgctggccttgctgggatactaaaccgcatgcggcaaagcaggagagaggagctacttcgaattactgtgggagtggatggatctgtgtacaaactacaccctagttttaaggacaagttccatgccactgtgctcaaactgacttcaggctgtgaaattaccttcattcagtcagaggaaggaagtggacgtggagctgccctaatatcagcagtggcgtataagatggctgtcatgattggtcactag

SEQ ID NO: 10342 - protein, 458 aa, Xenopus laevis
METFDQNEVDQILSEFHLQEEDLHVLMCRMQAEMERGLHLETNEEASVKMLPTYVRSTPDGSEVGDFLALDLGGTNFRVMLVKVGEDLEGQWKVETKHKMYSIPVDAMTGTAEMLFDYIAECISDYLDQQNMKHKKLPLGFTFSFPVRHEDIDKGILLNWTKGFKASGAEGNNVVGLLRDAIKRRGDFEMDVVAMVNDTVATMISCYYEDHHCEVGLIVGTGCNACYMEEMSNVELVEGEEGRMCVNTEWGAFGDTGELEDFRLEYDRVVDEASLNPGQQLYEKMIGGKYMGELVRLVLIKMVNENLLFGGESSEKLKTRGAFETQFVSQIEADTSDFKQTLNILRTLGVQATIGDCHAVRLACESVSTRAAIMCSAGLAGILNRMRQSRREELLRITVGVDGSVYKLHPSFKDKFHATVLKLTSGCEITFIQSEEGSGRGAALISAVAYKMAVMIGH

SEQ ID NO: 10343 - DNA, 3497 bp, Mus musculus
  CDS (98)..(2845)
cacccacctccccgcccaaactagaggcgtgcagcactccgcagacagagagtgtactgaagactcggcgctctcgggaacaaccgcacttgggaacatgtttgcagtacacttggtggcgttttacttcaccaagctgaaggaggaccagatcaagaaggtggacaggttcctgtatcacatgcggctctcggatgagaccctggtggacatcatggcccgcttccaggccgagatggagaaaggcttggggaaggacaccaaccccactgcctctgtgaagatgctgcccacattcgtcagggccattccagatggctcagaaaacggggaattcctttccctggatctcggaggatccaagtttcgggtcttgaaggtgcaagtctcccaagagggccagcaaaatgttcagatggagagccagttctacccaatgcccaatgaaatcacccgtgggaatggcacggagctttttgactacgtagccgactgcctggcagatttcatgaagaccaaaaatctgacacataagaagctgcctctgggcttcaccttttcttttccctgcagacagaataagttggaggagggtgttctgctttcgtggaccaagaagttcaaggcccggggagttcaggacacagacgtggtgaaccgcctggccactgccatgaagaagcacaaggacctggacgtggacatcctggctttggttaacgacactgtggggaccatgatgacttgtgcttatgatgatcccaactgtgaagtcggcgttatcatcggaacaggcaccaacgcgtgttacatggaggacatgagcaacatcgacctcgtggaaggggacgagggaaggatgtgtatcaacacggagtggggggcctttggggacgatggggctttggaggacatccgcaccgagtttgacagagagctggacctgggctcgctcaaccccgggaagcagctgttcgagaagatgatcagcgggctgtacatgggggagctggtcaggcttatcttgctgaagatggccaaagttggtctcctgtttgggggtgcaaaatcctctgctctccatacaaagggcaagatcgaaacacagcacgtggctgccatggagatgagtaaagaaggcctggccaacactcgagagatcctggtggatttgggcctggagccctctgagtcagactgcatcgctgtccagcacgtgtgcaccatcgtctcttttcgctcagccaatctctgcgcagcggctctggcaaccatcctgactcgactccgagagaacaagaagctggcccggctccgcaccacagtgggcatggatggaactctctacaaaacacaccctcagtaccccaaacgcctacacaaggtggtgaggagactggtcccaaactgtgatgtccgcttcctcctgtcagagagtggaagcaccaagggggccgccatggtgaccgcagtggcctctcgggtacaggcccagcgcaagcagatcgacaaggtgctggctttgttccagttgacccgagagcaactcctgggtgtgcgggacaagatgcgggctgaactagagtacgggctgaagaaaaagacccactctctggctaccgtgaagatgcttcccacctatgtctatgggatgccggatggcacagagaaaggaaagttccttgccctggatttggggggaaccaacttccgagtcctcctggtaaagatcaggcggaggtctgtgcgcatgtacaacaagatcttcgccatccctctggagatcatgcagggcactggggaggagctctttgaccacatcgtacagtgcatcgctgacttcctggactacatgggcctcaagggcgcccagctgcctttgggcttcaccttctccttcccctgcagacagacatgcatcgacaaggggactctagtagggtggaccaaaggcttcaaggccaccgactgtgaaggggaggacgtggtggacatgctcagagaagccatcaagaggagaaacgagtttgacctggacattgttgcaatcgtgaacgacacagtggggaccatgatgacctgtggctatgaagatcccaggtgtgagattggcttgattgcagggacaggaagcaacgtgtgctacatggaggaaatgaggaacatcgagctggtggatggggacgaaggccggatgtgcgtcaacacggagtggggcgggtttggtgacaatggctgcatcgatgacatccgcacccagtatgacaaggaggtggatgagggctccctgaacgccggcaagcagagatacgagaaaatgaccagtggaatgtacctgggggagattgtgaggcggatcctgatcgacctcacccggcaggggctcctcttccgagggcagatttcagagcgactccggaccaggggcatctttgaaaccaaattcctgtcccagattgaaagtgaccggctggccctcctgcaggtcaggaggatcctgcagcagctgggcctggacagcacgtgcgaagacagtattgtggtgaaggaggtgtgtggggctgtgtctcggagggccgcccagatgtgtggtgccggcatggctgccatcgtggagaagaggagagaagaccaaggcctccagcacttcaaggtcaccgtgggcgtggatggcacactgtacaagctgcacccgcacttctcccggatactgcaggagacggtgaaagagctggcccctcagtgtgatgtgacatttatgttgtcagaagacggcagcgggaagggagcagctctgatcacagctgtagccaagaggttacagcagccacggaaggacatctaggtggcccagccgggtgatgaccagggaccaccagacgacctcctggctcaccttcctctctccgtactctaagcatcctggtgcttgcttggcagtgacactgggtggcacctccatttggcatattttagccaaagatgggctgactttcaaaatcaaaggatctggccccaaagatcccccttttggcaagtcacttgagctgtgagcgttcagtagtatcaggtcttgggttgctggagtgtccctttcaggccttatgctacctctggtgggagattgggtctgaacccttgagagggagaaaggcttagtgaactaggggatctaggttaacatggcctcacttgtcatgttgactttataggcaccagggaagccagggcattggcccctgcatctctgagtgtggaggagcccactgccctggagccaggaggaatctcacccactcagggcgctctgtgagcatctggggtgtcacccccccatgtttgtatcatggggcgggacaccatcccaggtactgtttatcattcatgtgacacagtaggtgtcgctgttttctgcatttctttcaaggactgttaggtatacaaatattgtccatgaataaaagaaacttgagtttccaggaaaaaaaaaaaaaaaa

SEQ ID NO: 10344 - protein, 915 aa, Mus musculus
MFAVHLVAFYFTKLKEDQIKKVDRFLYHMRLSDETLVDIMARFQAEMEKGLGKDTNPTASVKMLPTFVRAIPDGSENGEFLSLDLGGSKFRVLKVQVSQEGQQNVQMESQFYPMPNEITRGNGTELFDYVADCLADFMKTKNLTHKKLPLGFTFSFPCRQNKLEEGVLLSWTKKFKARGVQDTDVVNRLATAMKKHKDLDVDILALVNDTVGTMMTCAYDDPNCEVGVIIGTGTNACYMEDMSNIDLVEGDEGRMCINTEWGAFGDDGALEDIRTEFDRELDLGSLNPGKQLFEKMISGLYMGELVRLILLKMAKVGLLFGGAKSSALHTKGKIETQHVAAMEMSKEGLANTREILVDLGLEPSESDCIAVQHVCTIVSFRSANLCAAALATILTRLRENKKLARLRTTVGMDGTLYKTHPQYPKRLHKVVRRLVPNCDVRFLLSESGSTKGAAMVTAVASRVQAQRKQIDKVLALFQLTREQLLGVRDKMRAELEYGLKKKTHSLATVKMLPTYVYGMPDGTEKGKFLALDLGGTNFRVLLVKIRRRSVRMYNKIFAIPLEIMQGTGEELFDHIVQCIADFLDYMGLKGAQLPLGFTFSFPCRQTCIDKGTLVGWTKGFKATDCEGEDVVDMLREAIKRRNEFDLDIVAIVNDTVGTMMTCGYEDPRCEIGLIAGTGSNVCYMEEMRNIELVDGDEGRMCVNTEWGGFGDNGCIDDIRTQYDKEVDEGSLNAGKQRYEKMTSGMYLGEIVRRILIDLTRQGLLFRGQISERLRTRGIFETKFLSQIESDRLALLQVRRILQQLGLDSTCEDSIVVKEVCGAVSRRAAQMCGAGMAAIVEKRREDQGLQHFKVTVGVDGTLYKLHPHFSRILQETVKELAPQCDVTFMLSEDGSGKGAALITAVAKRLQQPRKDI

SEQ ID NO: 10345 - DNA, 1904 bp, Oryza sativa
  CDS (51)..(1580)
atcactcctccccctaccaacgatcagctcagcttcagcttctcctcggcatgtccgccgccgccgccatcgcgtcgccgatcccggcggcgatcgccgtcgtgcagcagcagaggcgggggaggagccgcggcggcggctccggcgctgccgccgtccgctgctccgcggtggccccgacgtccgcgatcgcgcccatccttgccgacctgaggctgcggtgcgccgccccgctccccgtgctgcggcgcgtggcggacgccatggcctccgggatgcgcgccgggctggccgacgacggcgccggcgagctcaagatgatccccagccacgtctactcactccccactgggaatgaaacaggactgttttatgctctggaccttggaggcaccaactttagagtgctgagggtacaattgggaggaaaagataagcgcattatagataccgagtttgagcaagtctcgatcccaagagaaatcatgcatggtataaccgaggatttgtttgatttcatcgcgagtggcctgtcgagatttgtagcaacggagggtgataagtttcatttgccacaagggagaaagagagagttaggcttcacattctcctttccggtgaatcagacttctattgattctggcattctgatcaagtggacaaaaggttttgctgtctctggaactgctgggaaagatgttgttgcttgtctgaatgctgcaatggagaggcaaggccttgatatgcgtgtctctgccttggtaaatgatactgtgggaaccttagctggagcacgttattgggacgatgacgtaatggtcgcggtgattttgggcactggcaccaatgcatgctacattcaacgaactgaagctattccaaaattgcaacaccttaagcttgaaacaggaaacacgattattaacactgagtggggagctttctcagatggacttccattgactgaatttgacagagaaatggatgatgagagcataaatcctggtgaacagatattcgagaagacgatttccgggatgtatctaggtgaaattgtccgtagggtgctggtcaagatggctgaagtatctgatctctttggtcattccttccccaagaaacttgctgaaccatttgttctaaggacaccacatctatgcgctatgcaacaagacacctctgacaatcttggagaagttgagtccatcttgagtgatgtcatcggcgtgtcccaagcttctctgctggcacggagagtcactgtagaagtctccgactgcatcatcaggagaggaggccggttggccggggcaggaatcgtagggatccttgagaagatggagaatgactccagagggcacattttcggacgaagaacagtggtcgcgatggacggtggtctatatgagaagtaccctcagtacaggaggtacatgaaggaggctgtggctgagctactgggacccgagcgatcgaatcgtatcgccatcgagcacacgaaagacggatcagggatcggcgctgcgctgttggcagctgcaaactcaaagtatgctgctgctcaaatctctacaaggtgatcgcaattgttataattgttgagttactgggccgaattaattctctacaaggtgatctcaattgttatcattgttgagctactgggacctgaacaatccaagcatatcatcatatggtggcctcttatctgaagtatggaggggcttcatatatgctattcttctgtactactagtctactatactatataacgcatttgaggaaaagaaacaccagaaatttatcaacttatgttttgtataattcatcaacttatgtgtttgtatagttacagttcaccagaaattcatcagcttatgtatttgtataaaaaaaaaaaaaaa

SEQ ID NO: 10346 - protein, 509 aa, Oryza sativa
MSAAAAIASPIPAAIAVVQQQRRGRSRGGGSGAAAVRCSAVAPTSAIAPILADLRLRCAAPLPVLRRVADAMASGMRAGLADDGAGELKMIPSHVYSLPTGNETGLFYALDLGGTNFRVLRVQLGGKDKRIIDTEFEQVSIPREIMHGITEDLFDFIASGLSRFVATEGDKFHLPQGRKRELGFTFSFPVNQTSIDSGILIKWTKGFAVSGTAGKDVVACLNAAMERQGLDMRVSALVNDTVGTLAGARYWDDDVMVAVILGTGTNACYIQRTEAIPKLQHLKLETGNTIINTEWGAFSDGLPLTEFDREMDDESINPGEQIFEKTISGMYLGEIVRRVLVKMAEVSDLFGHSFPKKLAEPFVLRTPHLCAMQQDTSDNLGEVESILSDVIGVSQASLLARRVTVEVSDCIIRRGGRLAGAGIVGILEKMENDSRGHIFGRRTVVAMDGGLYEKYPQYRRYMKEAVAELLGPERSNRIAIEHTKDGSGIGAALLAAANSKYAAAQISTR

SEQ ID NO: 10347 - DNA, 1965 bp, Oryza sativa
  CDS (32)..(1555)
gatcggaggaagggaaggcggagcagcggtgatggggaaggcggcggcggtggggacggcggtggtggtggccgcggcggtcggggtggcggtggtgctggcgcggaggcggaggaggagggacctggagctggtggagggagccgcggcggagaggaagaggaaggtggcggcggtgatcgaggacgtggagcacgcgctgtcgaccccgacggcgctgctgcggggcatctcggacgccatggtcaccgagatggagcgaggcctgcgcggggacagccacgccatggttaagatgctcatcacctacgtcgacaacctccccaccggaaatgaacaggggttgttttatgcattggatcttggaggaaccaacttccgcgtcctgcgagtccaactcggtggcaaggagaaacgtgtcgtccaacaacagtacgaggaagtctcaattccaccacatctgatggttggaacttccatggaactgtttgattttattgcttctgcattgtcaaaatttgttgatactgaaggtgatgatttccacctcccagaagggagacagagagagctgggcttcaccttttccttcccagtgagccagacatcaatatcgtcaggaacgctcatcaagtggacaaagggtttctccatcaatgacgcggttggcgaagatgttgtatctgagttgggcaaggccatggagaggcagggattagatatgaaaattgcagcattggttaatgacactgtcggcacattggctggtgggaggtatgcggataacagtgttgttgctgctataatattgggcactggtacaaatgcagcatatgttgagaatgctaatgcaattcctaaatggaccggtttactgcctaggtccggaaatatggtaatcaacacagaatgggggagctttaaatcagataagcttcctctttcagaattcgataaagcaatggattttgaaagcttgaatcctggagagcagatatatgaaaagttgatttctggcatgtatcttggagagatagtgcgaagaatcttgctgaagcttgctcatgatgcagctttgtttggggatgttgttccatctaagctagagcaaccgtttgtactaaggacaccggatatgtcagccatgcatcatgactcgtcacatgaccttaaaactgttggagctaagctaaaggatatcgtcggggtcccagatacttccctggaagtaagatacattaccagtcacatttgtgacatagttgcagagcgtgctgcacgcttggctgctgctggcatatatggggtcctaaagaagctaggtcgggacaagatgccaaaagacggcagtaagatgcctaggactgtcattgccttggatggtgggctctatgaacattacaagaagttcagcagttgcttagaatcaactctaacagaccttcttggggatgatgtctcgtcttcggtggttaccaagctggccaacgatggttctggcattggagctgctcttctcgcagcctcgcactcccagtatgccgagatcgactagctttaaggatgatcttgatgaatgatgaatcaaactccgtttgtaggttctcatttcccccttcaaaatccacataatactcctggctccccccttgaaatcttaccatctttttttggctattctgagggcaaacataagtgcctctgcagcgggatatagctagtatagcgccaatgagtttggaggttttctaatggcataaaacgttggatggcagtagcagactaacagggaaatggaggcacaggcaatttccattcctgttctgtcagattcttttcccccttaattgatgttgagaaccaagatttttttgctctgtattttctcttcgtaataaagaaggggacataatctaattgctcttgtttgatctcataaaaaaaaaaaaaaaaaaaaaaaaaaaa

SEQ ID NO: 10348 - protein, 507 aa, Oryza sativa
MGKAAAVGTAVVVAAAVGVAVVLARRRRRRDLELVEGAAAERKRKVAAVIEDVEHALSTPTALLRGISDAMVTEMERGLRGDSHAMVKMLITYVDNLPTGNEQGLFYALDLGGTNFRVLRVQLGGKEKRVVQQQYEEVSIPPHLMVGTSMELFDFIASALSKFVDTEGDDFHLPEGRQRELGFTFSFPVSQTSISSGTLIKWTKGFSINDAVGEDVVSELGKAMERQGLDMKIAALVNDTVGTLAGGRYADNSVVAAIILGTGTNAAYVENANAIPKWTGLLPRSGNMVINTEWGSFKSDKLPLSEFDKAMDFESLNPGEQIYEKLISGMYLGEIVRRILLKLAHDAALFGDVVPSKLEQPFVLRTPDMSAMHHDSSHDLKTVGAKLKDIVGVPDTSLEVRYITSHICDIVAERAARLAAAGIYGVLKKLGRDKMPKDGSKMPRTVIALDGGLYEHYKKFSSCLESTLTDLLGDDVSSSVVTKLANDGSGIGAALLAASHSQYAEID

SEQ ID NO: 10349 - DNA, 1416 bp, Trypanosoma brucei
  CDS (1)..(1416)
atgtctagacgcctaaacaatatcctcgaacacatctcgatccagggaaatgatggtgagactgtgcgtgccgttaagcgtgatgttgcaatggcagcgctgaccaaccaattcacaatgagtgtggagtctatgcgacagatcatgacatacctcctgtacgagatggtggagggtcttgagggtcgtgaaagcaccgtccgcatgttaccatcttatgtgtacaaggcggaccctaagcgtgctactggcgtcttctacgcacttgacctcgggggtaccaacttccgtgtgctgcgcgttgcatgcaaggagggtgccgtggtggattcctctacttctgcattcaagattcccaaatatgcccttgagggtaacgccaccgatctgtttgacttcattgcatccaatgtgaagaaaaccatggaaactcgtgcacctgaggacctcaatcgcacagttcctcttgggtttaccttcagtttccccgtggagcagacgaaggttaaccgtggtgtgcttatccggtggacgaagggcttcagcacgaaaggtgttcaaggaaatgatgtgattgcccttcttcaggctgcttttgggcgagtgagcctgaaggtgaatgttgtggcgttgtgcaacgacaccgttggaacattaatttcgcattactttaaggaccctgaggtacaggttggtgtgattatcggcactggttccaatgcgtgctactttgagacggcgtctgctgtgacgaaggaccctgccgttgctgctcgtgggtcagcacttactcccatcaatatggaaagcggcaactttgactccaagtaccggtttgtcctccctacgacgaagttcgacttggatattgacgatgcgtcgttgaacaaaggtcaacaggcgctggagaaaatgatatccggcatgtacctcggtgaaatcgcccgccgcgttattgtgcacctgtcgtctattaactgccttcctgcggcactgcagactgctttgggcaaccgggggtcgtttgagtcccgatttgccgggatgatcagtgctgaccgtatgcccggacttcagttcactcgcagcacgatccagaaggtgtgtggtgttgacgtgcagtcaattgaagaccttcgcatcattcgcgatgtgtgccgccttgtccgtgggagggctgcgcaactctctgcttccttctgctgcgctccactggttaagactcaaacacagggccgtgcaactattgcaattgacggctccgtgtttgagaagattccgtcattccgccgcgtcttgcaggacaacatcaaccgtatccttggccctgagtgcgatgtcagggccgttctcgcaaaggatggcagtggaattggtgctgcatttatttccgcaatggtggtgaacgacaagtaa

SEQ ID NO: 10350 - protein, 471 aa, Trypanosoma brucei
MSRRLNNILEHISIQGNDGETVRAVKRDVAMAALTNQFTMSVESMRQIMTYLLYEMVEGLEGRESTVRMLPSYVYKADPKRATGVFYALDLGGTNFRVLRVACKEGAVVDSSTSAFKIPKYALEGNATDLFDFIASNVKKTMETRAPEDLNRTVPLGFTFSFPVEQTKVNRGVLIRWTKGFSTKGVQGNDVIALLQAAFGRVSLKVNVVALCNDTVGTLISHYFKDPEVQVGVIIGTGSNACYFETASAVTKDPAVAARGSALTPINMESGNFDSKYRFVLPTTKFDLDIDDASLNKGQQALEKMISGMYLGEIARRVIVHLSSINCLPAALQTALGNRGSFESRFAGMISADRMPGLQFTRSTIQKVCGVDVQSIEDLRIIRDVCRLVRGRAAQLSASFCCAPLVKTQTQGRATIAIDGSVFEKIPSFRRVLQDNINRILGPECDVRAVLAKDGSGIGAAFISAMVVNDK

SEQ ID NO: 10351 - DNA, 2372 bp, Pichia angusta
  CDS (639)..(2054)
taatacactagtttttttttaggatagtagttaattccttgttacggccggcactccagaatgaaaacccgtctgcaataaaattcatgacacctcacactcatttgtatgtagtttttttatcaacaagtattccagggggatctgggttggcaagcaagcctacaagcttaggacgtctagccaacaaagctgcctttgcctgaatttcatcagtgaagcgtttggcaatcttggaggccagaatggtttttgctggtgacatgtcaagataagaattaattaaccttatattatttatttattcaagtcagaaaataaaaaaaaagtttatgcggtgcagaggtgtgctaccgggaaagatttcggaaaaatacgcaggtctaaaagaatttgagacgaggatcagccgacgtgtgaatacctccgaactgaatgtaccgttccggaacggattattcacatagtcattgaaggggaaatagaacccaacatatgcagctccgcatttccccggtctccccataattagaaagatcatcccatcccaagtcgtgcgcccgctaatcgtttgacatccttccgtgatatttaacaccaccaaagtccgtgaaaatacataatctgctagaataaatatgagtttggatactgaagtcgataagattgtgtcggagtttgccgtcacccaggagacactccaaaagggtgtggagcgtttcattgagcttgcaactgccggactgaatagtgatgaggacaagtatggtctgccaatgatcccaacttttgttacctccatcccaaccggtaaagagaagggcattctttttgccgcagacttgggaggaaccaatttcagagtttgctctgttgccttgaacggagatcacactttcaaactgatccagcagaagtcacatattcctgccgaactgatgacctccacctcggacgaattgttttcgtatcttgcaagcaaggtcaagaatttcttagagactcatcatgaaggggctgttacttctacaggaagccagaaattcaagatgggtttcactttcagtttccctgtctcgcagaccgccttaaacgccggtactttgctaagatggaccaagggattcaatattccggatactgttggtcaagaggttgtttctctattccaaatgcatttagacgcccaggaaattcctgttactgtgtctgccctgtccaacgatactgtgggaacccttcttgcaagatcctacacgggttccaataaggagggcactactgttctaggatgcatcttcggaacgggaacaaacggtgcttacaacgagaagctcgagaatatcaagaagcttccggccgaggtgagagagaagctgaaggctcaaggtgtcacccacatggtcattaatactgaatggggttccttcgataaccagctcaaggttttgccaaatacgaagtatgacgctcaagttgacgaacttaccggcaataagggcttccacatgtttgaaaagcgtgtttccggaatgttcttgggtgagattctgagacatattttggtcgaccttcactctaagggagtgctatttactcagtacgccagctacgaatccctgccccacagattgaggacgccgtgggatctggactctgaggttctctcactgattgagatcgacgaatccaccaatttgcaggccactgagctgtctttgaaacaggcattgagactgccaactactactgaggagagacttgctattcaaaaacttactcgtgctgtggccaagagatctgcctatcttgctgctattcctattgctgctattctacacatgaccgagtcttttaagggccacaacgttgaggtggacgttggagcagacgggtctgtggttgagttctaccctggattcagaactatgatgagagacgccattgcgcagacgcagataggtgccaaaggagagagaagactgcacattaacattgccaaagacggctcatctgtgggcgctgcattgtgcgcattaagcgagaaagactaagtatacgattataaaccggactccgagtataatgatataaattagagatttgctaccaaaaaaaaaatgtcccttttcctcgtaatttttcaccagcctgctccccgcacggcaattaaaacatgaatataaaaacatttgttcattaagggtaacgtaattcgtatcgtctggtttttggtatgtggcattttgacggctaaaatcgcggggagcctttatcgactagttgaatctagatatatagaagaattttgtacccggtttccttatcttgaaataaattgacccaagcgatacatcttgtcaattctggtg

SEQ ID NO: 10352 - protein, 471 aa, Pichia angusta
MSLDTEVDKIVSEFAVTQETLQKGVERFIELATAGLNSDEDKYGLPMIPTFVTSIPTGKEKGILFAADLGGTNFRVCSVALNGDHTFKLIQQKSHIPAELMTSTSDELFSYLASKVKNFLETHHEGAVTSTGSQKFKMGFTFSFPVSQTALNAGTLLRWTKGFNIPDTVGQEVVSLFQMHLDAQEIPVTVSALSNDTVGTLLARSYTGSNKEGTTVLGCIFGTGTNGAYNEKLENIKKLPAEVREKLKAQGVTHMVINTEWGSFDNQLKVLPNTKYDAQVDELTGNKGFHMFEKRVSGMFLGEILRHILVDLHSKGVLFTQYASYESLPHRLRTPWDLDSEVLSLIEIDESTNLQATELSLKQALRLPTTTEERLAIQKLTRAVAKRSAYLAAIPIAAILHMTESFKGHNVEVDVGADGSVVEFYPGFRTMMRDAIAQTQIGAKGERRLHINIAKDGSSVGAALCALSEKD

SEQ ID NO: 10353 - DNA, 1482 bp, Candida albicans
  CDS (1)..(1482)
atgactgagactagcattagtgggttgcgtggccccaagtccatgtattttatggagattgttgatgtgtcgtcgcaagaatccagtgtgttgtcgagtattgttgaatcgtttacgtctgcggtatctgcatcgaacttgggggtatactctgaagaagtgctttgtgatatcaaactgtcgttgaaagagaattccccaattactatgttgcctaactataatgtctcccctacaggcaacgagcatggacagtatttggttattgatttaggagggtcgacattgagaatagcagtggtagacatttccaagccacacccaaatttgtcgagaagtgagaggataactatagttgtggaaaagagttggattattggcaacgactttaagaggattgatggtgagtttttcaagtatattgggtccaagattaacgagatattggtgggacagaatgttattgatgtaaagtcggttatcaatactggtataacctggtcgttcccgttggaaacaaccgactacaatagaggcaagatcaagcatgtttccaaagggtatactgtgggagaggatatttacgacaaggatttaaagatggttttggaagacacgttgagacaagagtacgggttgacacttgacgtgcagtctatattgaacgactcgttggcggtgtattctgctgggtgctttattgattcgaagatgaagttggccatggtgttggggacagggattaacatgtgctgttccctaaaaaggtcaagtgatatccacccctccaagatgttggctgatgctacgttgtttaattgtgagctctcgttgtttggccagaatctatgtaaagactttgctacgaaatatgatatcattatagacaagaggtttgctggtttcctgcaccactttaagacgtttatggagcctgaccctattacaaaaacgcttttccagccgcacgagttgatgactagtgggaggtacttgccggaattgacgaggttggtggtggtagatttgattgaggctggcgagatttttcaaaatgttgaccaccaacagatgtaccaagagtatggtgggtttagtggggagttgatgtgttttgtgcatgagaatgacgattatgatgatatacatgacaagttgtgcaaggcctacggctggacgacggttgggttgagtgacattgtcagcttgaaagaagttgtatcgtgcattatcaagcgggcggcgtttattgttgccaatgcgattattgcgtttttcaaattgttgggcagtgacgagttgggcggtgatgtgacgattgggtatgtggggtcggtcttgaactactttcacaagtatagacggttgattgttgagtatgtgaataacgcagaggaggccaaggggataaaggttgacttgaagttgattgaaaatagctcgattataggtgctgccataggtgctgcctatcataagtag

SEQ ID NO: 10354 - protein, 493 aa, Candida albicans
MTETSISGLRGPKSMYFMEIVDVSSQESSVLSSIVESFTSAVSASNLGVYSEEVLCDIKSSLKENSPITMLPNYNVSPTGNEHGQYLVIDLGGSTLRIAVVDISKPHPNLSRSERITIVVEKSWIIGNDFKRIDGEFFKYIGSKINEILVGQNVIDVKSVINTGITWSFPLETTDYNRGKIKHVSKGYTVGEDIYDKDLKMVLEDTLRQEYGLTLDVQSILNDSLAVYSAGCFIDSKMKLAMVLGTGINMCCSLKRSSDIHPSKMLADATLFNCELSLFGQNLCKDFATKYDIIIDKRFAGFSHHFKTFMEPDPITKTLFQPHELMTSGRYLPELTRLVVVDLIEAGEIFQNVDHQQMYQEYGGFSGELMCFVHENDDYDDIHDKLCKAYGWTTVGLSDIVSLKEVVSCIIKRAAFIVANAIIAFFKLLGSDELGGDVTIGYVGSVLNYFHKYRRLIVEYVNNAEEAKGIKVDLKLIENSSIIGAAIGAAYHK

SEQ ID NO: 10355 - DNA, 2097 bp, Citrus sinensis
  CDS (233)..(1729)
ctcgagactagttctctgaaatattttataattctataaataaaaaaattaatataaaaaattaatactctcgttcagctccaatattcagctcgatctaggattgacaaaacctttaaatttgaatcaaaaagcgaaggggagggttggagttctgtttctaataaaagtccaagtcaaagagtaagttacttcttctttttttgtttctaattattttcgcgcgggggtgatggggaaagtgacggtagcggcgacggtggtgtgcgcggcggcggtgtgtgcggcggcggcgctggtggtgaggcgtaggatgaagagcacggggaggtgggccagggcggttgctatattgaaggagatggaggagaagtgtgggacccccatagggaagctgaggcaggtagctgatgcgatgacggtggagatgcacgccggcctcgcgtcggagggcggcagcaagctcaagatgctcatcagctatgtcgataatctccccactggggatgagaagggattgttttatgcattggacctgggcggcacaaacttccgtgtcctgcgagtacagttgggtggaagagaaggccgtgttgttaaacaagaatttgaggaagtttcaattcctccacatttgatgactgggagttcgcatgaattatttgactatattgctgcagcactcgcaaaatttgttgctactgaaggtgaaggatttcatgtttcaccaggtagacaaagagagttgggttttaccttctcatttcctgttaggcaaacatcaatagcatcaggggatcttataaagtggaccaagggcttctctattgaggatacggttggagaagatgtagtcggagaattgactaaagccatggaaagaatcgggcttgatatgcgtgtggcagctttggtgaatgacaccatcggaacattagctggtggtagataccacaacaaggatgccattgctgctgtaatcttgggcactggaactaatgcagcatatgtagagcgagcacatgcaattcccaagtggcatggtcttctgcctaaatcaggggaaatggttatcaatatggaatggggtaatttccggtcatcgcaccttccactaacagaatatgatgaagcattggacactgagagtttgaaccccggtgaacagatttttgaaaaaatcatctctggcatgtatttgggagaaattgtacgcagagtcttgtgcaggatggcagaggaagctaacttttttggtgatactgttcctccaaaattgaaaattccattcatattgaggactcctcacatgtcggctatgcatcacgacacatctccagatttgagagtagttgggaagaaactaaaggatatattagagatatccaatacctctttgaagatgagaaaacttgttgttgagctctgtgacatagttgcaactcgaggtgcccgcctatctgctgcagggattgtaggcatcctcaagaaattaggacgagacacagtaagagatggggaaaaacagaagtcagtaatagcattggatggcggtttgtttgagcactacacgaaatttagtgcctgcatgcagagcacggtcaaggagttgctgggagaggaagtttctgagaccgtcgtcattgagcattctaatgatggatcaggcattggagccgcactccttgcagcttcgcactcccaataccttgaggttgaagagtcttgaaaattgcctccattacacacaacatcctagtttttgtatattttcccatttctcactctcccttcttagttctttcggcttatttagagctctccccatccctgcttcaagaattctagctacaaaagttttgaatttggctcctgtggagtgtataattgagtaatggatcaattgtgcagtcattttgggcagcccctggccaatagctttattgctgtcattctgcattttgcttctttttttttccccaaaagctggggcacaatgttggtacaagtgtataacattatatgtcctgaattagaaaataaaatgggggatagaactttttctttcaaaaaaaaaaaaaaaaaaaaaaaaaaaaa

SEQ ID NO: 10356 - protein, 498 aa, Citrus sinensis
MGKVTVAATVVCAAAVCAAAALVVRRRMKSTGRWARAVAILKEMEEKCGTPIGKLRQVADAMTVEMHAGLASEGGSKLKMLISYVDNLPTGDEKGLFYALDLGGTNFRVLRVQLGGREGRVVKQEFEEVSIPPHLMTGSSHELFDYIAAALAKFVATEGEGFHVSPGRQRELGFTFSFPVRQTSIASGDLIKWTKGFSIEDTVGEDVVGELTKAMERIGLDMRVAALVNDTIGTLAGGRYHNKDAIAAVILGTGTNAAYVERAHAIPKWHGLLPKSGEMVINMEWGNFRSSHLPLTEYDEALDTESLNPGEQIFEKIISGMYLGEIVRRVLCRMAEEANFFGDTVPPKLKIPFILRTPHMSAMHHDTSPDLRVVGKKLKDILEISNTSLKMRKLVVELCDIVATRGARLSAAGIVGILKKLGRDTVRDGEKQKSVIALDGGLFEHYTKFSACMQSTVKELLGEEVSETVVIEHSNDGSGIGAALLAASHSQYLEVEES

SEQ ID NO: 10357 - DNA, 1362 bp, Drosophila simulans
  CDS (1)..(1362)
atgccgagcctggtgcacacggaaattgagaccgcggtcaagggcttcctgatcgaccaggagaagatgaccgaggtggtggagcgcatgaccaaggagataaagatgggtctggccaaagacacgcatgcgcgagccgtgatcaagtgcttcgtcagccatgtgcaggatctgcccactggcaaggagcggggcaagtatttggccctggatctgggtggctccaacttcagggtgcttctggtgaacctgataagcaactcggacgtggaaatcatgtcgaagggctacaattttcccctgactctgatgtccggatcgggaaaggcgctattcgacttccttgccgaatccctgtccgagttttgccacacccatggactggagaacgaatcactgcctctgggcttcaccttctcgtttccgctccagcagcagggactctccaagggtatccttgtggcctggaccaaaggattcagctgcgaaggcgtggtgggcaagaatgtggtgagtctcctccaggaggccatcgatcgaaggggcgatataaagattaacaccgtcgccattctcaacgatacggtgggcactctgatgtcctgcgctttctatcatcccaactgccggataggattgatcgtgggaaccggctccaatgcgtgctatgtggagaaaacagtaaatgccgaatgcttcgaaggataccagaccagtcccaagccgtcaatgatcatcaactgcgagtggggcgccttcggagacaatggtgtcctggagttcgtgcgaacttcctacgacaagatagtcgacaaggtgacacccaatcccggcaagcagacgttcgaaaagtgcatatccggcatgtatatgggtgaacttgtgcgtttggtcgtcatcgatatgatagccaagggctttatgttccacggcataatttccgagaagatccaggagcggtggagctttaaaaccgcctatatttccgatgttgaaagtgatgcacctggcgagtatcgtaactgcaataaggtacttagcgaactgggcatcttgggctgccaggaacccgacaaagaggcgctgcgttacatctgcgaggcggtgtcctccaggtctgccaagctgtgtgcctgcggcctggtcaccatcatcaacaagatgaacattaacgaggtggtcatcggcatcgacggtagcgtgtatcgcttccatcccaagtaccacgacatgctccagcaccacatgaagaagctcctcaagccgggcgtcaagttcgagctgattgtttcggaggacggatccggaagaggagcggctctggtggcggccacggcagtccaggccaagagcaaactctaa

SEQ ID NO: 10358 - protein, 453 aa, Drosophila simulans
MPSLVHTEIETAVKGFLIDQEKMTEVVERMTKEIKMGLAKDTHARAVIKCFVSHVQDLPTGKERGKYLALDLGGSNFRVLLVNLISNSDVEIMSKGYNFPLTLMSGSGKALFDFLAESLSEFCHTHGLENESLPLGFTFSFPLQQQGLSKGILVAWTKGFSCEGVVGKNVVSLLQEAIDRRGDIKINTVAILNDTVGTLMSCAFYHPNCRIGLIVGTGSNACYVEKTVNAECFEGYQTSPKPSMIINCEWGAFGDNGVLEFVRTSYDKIVDKVTPNPGKQTFEKCISGMYMGELVRLVVIDMIAKGFMFHGIISEKIQERWSFKTAYISDVESDAPGEYRNCNKVLSELGILGCQEPDKEALRYICEAVSSRSAKLCACGLVTIINKMNINEVVIGIDGSVYRFHPKYHDMLQHHMKKLLKPGVKFELIVSEDGSGRGAALVAATAVQAKSKL

SEQ ID NO: 10359 - DNA, 1398 bp, Drosophila simulans
  CDS (1)..(1398)
atggcaaacacttttaatccggaggaggactttccggaagtgtacaaggtctgcaagttgttcaatccgagcatagacgaccttgagaagataaaacaagcaatggatcgtgagattacgatgggcctgagtcgcgatcatcacgatcgttcgacggttccgtgccacttgagctatgtgcaggatttgccaacgggcagggagcgtggtcagttcttggccctggagatgatgcccaccaactgcaggataatgctggtgaagttcagcagcgagagagatatctacaccagttcgaaatgcgtgataatgccacatactgtagcggcgggtcgaggaaccgaggtcttcacctttctggccaccatcatagccaattttgtgaaggagaaaaaggtggacaaggacaatctgccgctgggcatagcatttgcctttaccctgaagaagctggctttggatgtaggtatccttgtgtcgtggacaaaggagtttggagcacagggcgccatcggcaaggatgtggtccaactgctgcgcgatgctctggccaagtttcccgaaatctccgtcgatgtcatgggtatcatcaatgtgggagccggttcgctgctggctctgtgctgggcccagccggatacccgaatcggcttgatcatgggcagtattgccaatagctgctatgtggaaagggtcgaaaggtgcgaaacctacgagggtgatgagtttagaaggctgatgatcattaattcggattgggcccatttcggggatacggggcagttggatttcatacgtaacgaattcgatcgcctgctggacaccgactccataaatccgggcactcggatctatgagaagtttagtggagctctctgcatgggggaattggttcgcattatagtgcttcgcctgatgaaagcgggcgccatcttcgccgaggacaggcgtgattacatagggatccagtggaagttggacatggtgtcgctgatcgaaatcgtctcggatcctccgggtgtctatacgaaggcccaggaggtgatggacaagtttcgcatacgtcactgcaaggagcgggatctggctgccttgaaatacatctgcgacacggtcaccaatcgagctgccatgctggtggccagtggagtgtcctgcctcattgaccgcatgcgcttgccacagatctcgatcgccgtggatggcggcatctaccgccttcatccgaccttcgccaccgttctcaacaagtacacccgtttgctggccgatcccaattacaactttgagtttgtcatcacccaggacagctgcggagtgggagcggccataatggcgggaatggcacatgccaacaagtacaaaacggacgcgaaattgtttactatggactactag

SEQ ID NO: 10360 - protein, 465 aa, Drosophila simulans
MANTFNPEEDFPEVYKVCKLFNPSIDDLEKIKQAMDREITMGLSRDHHDRSTVPCHLSYVQDLPTGRERGQFLALEMMPTNCRIMLVKFSSERDIYTSSKCVIMPHTVAAGRGTEVFTFLATIIANFVKEKKVDKDNLPLGIAFAFTLKKLALDVGILVSWTKEFGAQGAIGKDVVQLLRDALAKFPEISVDVMGIINVGAGSLLALCWAQPDTRIGLIMGSIANSCYVERVERCETYEGDEFRRLMIINSDWAHFGDTGQLDFIRNEFDRLLDTDSINPGTRIYEKFSGALCMGELVRIIVLRLMKAGAIFAEDRRDYIGIQWKLDMVSLIEIVSDPPGVYTKAQEVMDKFRIRHCKERDLAALKYICDTVTNRAAMLVASGVSCLIDRMRLPQISIAVDGGIYRLHPTFATVLNKYTRLLADPNYNFEFVITQDSCGVGAAIMAGMAHANKYKTDAKLFTMDY

SEQ ID NO: 10361 - DNA, 1347 bp, Drosophila melanogaster
  CDS (1)..(1347)
atggtgcacgagttatgtcagcagctgcttctaacggacgaacaggtgcaggagctgtgctaccgcatcctgcacgagctgcgccgcggcctggccaaggatacacatcccaaggcgaatgtcaagtgcttcgtaacgtatgtgcaggatctgcccaatggcaatgagcgtggcaagttcttggccttggatctgggtggcaccaacttccgggtgctgctcatccatctgcaggagaacaacgattttcaaatggagtcccgcatctatgccataccgcagcacattatgattggatcgggtacacagctattcgatcacatcgccgaatgtctgtccaactttatggccgagcacaatgtgtacaaggagcgtttgccactcggtttcaccttctcgttcccgctgcgccaattgggtctgaccaagggcctgctggagacctggaccaagggcttcaactgcgctggcgtcgtcaacgaggatgttgtccagttgctaaaggatgccatcgcacggcgcggcgatgtccagatcgatgtgtgtgccatactcaatgacaccactggcacgctgatgagctgcgcctggaagaatcacaactgcaagatcggtctgattgtcggcaccggtgcaaatgcctgctatatggagcgtgtggaggaggcggagctcttcgccgccgaggatccgcgcaagaagcacgtcctgatcaacacggaatggggcgcattcggcgacaatggcgcactggactttgtgcgcaccgaattcgatcgggacatcgatgtgcacagcatcaatccgggcaagcagacgttcgagaagatgatatcgggcatgtatatgggcgagctggtgcgtctggtgctggtgaagatgacccaggcgggtatactcttcaatggacaggattccgaagtgctaaacacccgcggactgttcttcaccaagtatgtgagcgaaattgaagctgacgagccaggcaacttcaccaattgccgcctggtgctggaggagctcggtctgaccaatgccaccgacggagactgcgccaatgtgcggtacatctgcgagtgcgtctcgaaacgggctgcccacctggtgtccgccggcattgccacgctgatcaacaaaatggacgagccaacggtgacggtgggcgtcgatggcagtgtgtaccgcttccatcccaagttccataacctgatggtcgagaagatctcgcagctgatcaagccgggcatcaccttcgatctgatgctgtccgaggacggttccggtcgtggagctgccctggtggcggccgtcgcctgtcgcgaagacatactcaatggcaagaagtag

SEQ ID NO: 10362 - protein, 448 aa, Drosophila melanogaster
MVHELCQQLLLTDEQVQELCYRILHELRRGLAKDTHPKANVKCFVTYVQDLPNGNERGKFLALDLGGTNFRVLLIHLQENNDFQMESRIYAIPQHIMIGSGTQLFDHIAECLSNFMAEHNVYKERLPLGFTFSFPLRQLGLTKGLLETWTKGFNCAGVVNEDVVQLLKDAIARRGDVQIDVCAILNDTTGTLMSCAWKNHNCKIGLIVGTGANACYMERVEEAELFAAEDPRKKHVLINTEWGAFGDNGALDFVRTEFDRDIDVHSINPGKQTFEKMISGMYMGELVRLVLVKMTQAGILFNGQDSEVLNTRGLFFTKYVSEIEADEPGNFTNCRLVLEELGLTNATDGDCANVRYICECVSKRAAHLVSAGIATLINKMDEPTVTVGVDGSVYRFHPKFHNLMVEKISQLIKPGITFDLMLSEDGSGRGAALVAAVACREDILNGKK

SEQ ID NO: 10363 - DNA, 1362 bp, Drosophila yakuba
  CDS (1)..(1362)
atgccgagcctggtgaacacggaaattgaggccgcggtcaagggcttcctgatcgaccaggagaagatgaccgaggtggtggagcgcatgaccaaggagatcaagatgggcctggccaaggacacgcattcgcgggcggtgatcaagtgcttcgtcagccatgtgcaggatcttcccactggcaaggagcgtggcaagtatttggcactcgatctgggtggctccactttcagggtgctgctcgtgaacctgctaagcgaatcggacgtggagattgtctcgaagagtttcaattttcccgtaacactgatgtccggatctggaaaggcgctattcgacttcctggccgaatgcctgtcggagttttgccactaccatggcctggagaacgagtcactgccgctgggcttcaccttctcgtttccggtccagcagcagggactctccaagggcatcctagtggcctggaccaaaggattcagctgcgaaggcgtggtgggcaagaatgtggtaactctgctccaggaggccatcgatcgcaggggcgacatgaaggtgaacaccgtggccattctcaacgatacggtgggcaccctgatgtcctgcgcctactaccatcccaactgccgcataggactgatcgtgggcaccggcagcaatgcgtgctatgtggagaagaccgtgaatgccgaatgcttcgagggatatcagaccagtcccaagccttcgatgatcatcaactgcgagtggggcgcctttggtgacaatggtgtcctggagttcgttcgcaccacctacgacaagatcgtcgacaaggtgacaccaaatcccggcaagcagacgttcgaaaagtgcatctcgggcatgtatatgggtgagctggtgcgcttggtcgtcatggatatggtaggcagggaccttatgttccacggcaccacttccgaaaggatgcaggagcgctggagcttcaagtcctcctatatttccgacattgaaagcgatgcaccgggagagtatcgcagctgcaacaaggtcctcagcgaactgggcatcgtgggctgccaggaaccggacaaggaggcactgcgtttcatctgcgaggcggtgtcctccaggtcggccaagttgtgtgcctgcggcctggtcacgatcatcaacaagatgaacatcaacgaggtggtcatcggcatcgacggcagcgtgtatcgcttccatcccaagtaccacgatatgctgcagtttcacatgaagaagctcctcaagccgagcgtcaagttcgaactggttgtctccgaggacggatccggcaggggagccgctctggtggcggccacagctgttcagggcaaggccaagctctaa

SEQ ID NO: 10364 - protein, 453 aa, Drosophila yakuba
MPSLVNTEIEAAVKGFLIDQEKMTEVVERMTKEIKMGLAKDTHSRAVIKCFVSHVQDLPTGKERGKYLALDLGGSTFRVLLVNLLSESDVEIVSKSFNFPVTLMSGSGKALFDFLAECLSEFCHYHGLENESLPLGFTFSFPVQQQGLSKGILVAWTKGFSCEGVVGKNVVTLLQEAIDRRGDMKVNTVAILNDTVGTLMSCAYYHPNCRIGLIVGTGSNACYVEKTVNAECFEGYQTSPKPSMIINCEWGAFGDNGVLEFVRTTYDKIVDKVTPNPGKQTFEKCISGMYMGELVRLVVMDMVGRDLMFHGTTSERMQERWSFKSSYISDIESDAPGEYRSCNKVLSELGIVGCQEPDKEALRFICEAVSSRSAKLCACGLVTIINKMNINEVVIGIDGSVYRFHPKYHDMLQFHMKKLLKPSVKFELVVSEDGSGRGAALVAATAVQGKAKL

SEQ ID NO: 10365 - DNA, 1365 bp, Drosophila yakuba
  CDS (1)..(1365)
atgctggacgcggaggtgcgagaacttatgcaaccctttgtgctaagtgattatcaggtgcaggaagtgtacagccgcttttgcctggaagtggcccgtggacttaagcgatccacacatccacaggccaatgtcaagtgctttcccacgtacgtgcaggatctgcccacgggcgacgagatgggcaagtatctggccctggatctcgggggtaccaacttccgggtgcttctcgtctcgctgaaaggtcaccatgacgccacagtggattctcagatctatgccgtgccaaaggacctgatggtgggatccggtgtgcagctattcgatcacattgcgggctgtctggccaaatttgtggagaaacacgacatgaagaccgcatatctgccactgggcttcactttctcctttccttgcgtgcagctaggccttaaggagggcatcctggtacgctggaccaagggcttcgattgtgctggtgttgagggcgaggatgtgggccgtatgctgcacgaggccattcagcggcgcggagatgccgacattgccgtggtggctatactcaacgatactacaggcaccttgatgtcctgcgcccatcgtaacgcagattgccgtgtgggcgtcattgtgggcactggctgtaatgcctgctacgttgaggatgtggagaatgtggaccttttgcgcgcagacttcaaaaaatcgaagcggagtgttattgtaaatgctgagtggggcgcttttggtgagggtggtcagttggactttgtgcgcaccgaatacgatcgcgaagtggacgaaaagtctatcaatcgtgcggagcagctgttcgaaaagatgactgccggcatgtacttgggcaatctggtgcgccttgtcctgctccgtgccctcgagcgcaagctgatcttcaaacagagcagtcggcgtccagaattcgccggcgtgctgcagagaaatgaagaggttttcgagacgcgctacatatcggagatcgaggacgactccttcccagagtttgccagcaccaggaagatcgtgaggaatctgtttggcctggagaaggcctccgtggaggactgccaaaccctgagatacatctgcgagtgcgtggctaagcgagcggccacattagtagccatcggagtaagtgggctggtgaacaggacctccaaccgccgcgtgatagtcggcatggatggatccgtctacagataccatccaaagttcgatgcctacatgaggcagaccctgcaaaagctggtgaaagcagacaaggagtgggacatcatgctctcggaggacggatccggacgtggagctgcgctggtggccgcagtggccagtaaatcaaagtag

SEQ ID NO: 10366 - protein, 454 aa, Drosophila yakuba
MLDAEVRELMQPFVLSDYQVQEVYSRFCLEVARGLKRSTHPQANVKCFPTYVQDLPTGDEMGKYLALDLGGTNFRVLLVSLKGHHDATVDSQIYAVPKDLMVGSGVQLFDHIAGCLAKFVEKHDMKTAYLPLGFTFSFPCVQLGLKEGILVRWTKGFDCAGVEGEDVGRMLHEAIQRRGDADIAVVAILNDTTGTLMSCAHRNADCRVGVIVGTGCNACYVEDVENVDLLRADFKKSKRSVIVNAEWGAFGEGGQLDFVRTEYDREVDEKSINRAEQLFEKMTAGMYLGNLVRLVLLRALERKLIFKQSSRRPEFAGVLQRNEEVFETRYISEIEDDSFPEFASTRKIVRNLFGLEKASVEDCQTLRYICECVAKRAATLVAIGVSGLVNRTSNRRVIVGMDGSVYRYHPKFDAYMRQTLQKLVKADKEWDIMLSEDGSGRGAALVAAVASKSK

SEQ ID NO: 10367 - DNA, 1848 bp, Emericella nidulans
  CDS (1)..(1848)
atggcttcggtggatccagcgcattcaaggctgcacaccgtggaagagcatgtgattattcatgatgacccgattgatgacgatgaggagcatgaggaggatgatgcggagatggacccttccgtaagggcgtgcttggaacaccagcgcaaagttgacgagttcttgtctccgctttgtcttgatgaagccgtcctatataagctggcccgccgactgtcaagcgtataccgaaagctagccttagaatcagaccagcagttcctcccaacccccgtttcgaagctacccagcggcctggagactggccgctacctagccattgatgtcggtggaagtaatctacgagttgcctttattgaactactcggcgatacggcagatccggatatggctcgcacatccgcgtctgagcggccactcaagaaggcacagacacagcgcgtgaagaggacccttgagaaggcatggccaatccaggaacatctgaagatggacaaagcagaggacctttttgcgtggatcggagattgtattgcggaggtagtggctgagagcctaagttcggatgcgacaaaaaatgcggtccctgaagagctggagatgggcatcactttcagtttcccgatgatgcaagaatctcttgccgaagctacactcatgccgatgggcaaagggttcgccattacgtcggatctcaatcttcgaaatatactactcagtggttacgaaagacacacaagacgccctgatgatgaggaccagccgtcaacgaaacgtcggaagctttatgctttgccgaagctgaagatttctgccattaccaacgacgcggtagccactctcgcatcacttgcatatgcggtgaaatctctacccaacagccgcgttgccatgggtctcattgtaggcacggggtgcaatgccacaataccaatgaagctcagcgccttacatgaagacaaggtaaagcatgtgaggcggagcgatcctgaaacctcgggtataatagtcaacaccgaatggacgatatatggtgtcttgcctccacttaaggagctgaacataatcaccaaatgggatgctgagttggatgcaagcagtgcacgcccgggcttccaaccgttcgagtatatgacgggcggtagatatattggggaactcatccggcttatttttactgactacttgatcaacgttgctggagtgtccacggctgcattacctgcaacacttactcagggatacgccttgacgacatcttacatatcggacaaggttgcgcgtgcccgctcagacgaggaactcacagatgagctggctcactcattacctccaccaagtgatacgtggcagtgggatgctacatctgcaggagtcttacgaacagttgcccgaactgtacaaaggcgatctgcagggttggtagctgctgcagtcgtcggtctattagcatgcgcaggagagatagaattaaggttggacagccctcaaggctcaccgcaagactcgcatgctgcttcgcctgagcgcgacagcatcacgaccctttccgctcagctcaaatctgaggggtcggcttcaaatggattccgggggccgatagttcctataatttcgcctacacctgcggattggcagtctggtccagaggagcttgtcgtcgcctgcactggtggcataatccagcactaccccaacttcaaagagatgtgccagcagactatcgaccggcttattatgcgtactgggcctcagaagagcgggaagtcggtctttttgcgtgaagcatcagatggcggtgttattggcgccggtgttctcgcagggatggtcggaaatcgttga

SEQ ID NO: 10368 - protein, 615 aa, Emericella nidulans
MASVDPAHSRLHTVEEHVIIHDDPIDDDEEHEEDDAEMDPSVRACLEHQRKVDEFLSPLCLDEAVLYKLARRLSSVYRKLALESDQQFLPTPVSKLPSGLETGRYLAIDVGGSNLRVAFIELLGDTADPDMARTSASERPLKKAQTQRVKRTLEKAWPIQEHLKMDKAEDLFAWIGDCIAEVVAESLSSDATKNAVPEELEMGITFSFPMMQESLAEATLMPMGKGFAITSDLNLRNILLSGYERHTRRPDDEDQPSTKRRKLYALPKLKISAITNDAVATLASLAYAVKSLPNSRVAMGLIVGTGCNATIPMKLSALHEDKVKHVRRSDPETSGIIVNTEWTIYGVLPPLKELNIITKWDAELDASSARPGFQPFEYMTGGRYIGELIRLIFTDYLINVAGVSTAALPATLTQGYALTTSYISDKVARARSDEELTDELAHSLPPPSDTWQWDATSAGVLRTVARTVQRRSAGLVAAAVVGLLACAGEIELRLDSPQGSPQDSHAASPERDSITTLSAQLKSEGSASNGFRGPIVPIISPTPADWQSGPEELVVACTGGIIQHYPNFKEMCQQTIDRLIMRTGPQKSGKSVFLREASDGGVIGAGVLAGMVGNR

SEQ ID NO: 10369 - DNA, 1494 bp, Tuber borchii
  CDS (1)..(1494)
atgtatctcaatgcatctcgcaagccgcctagccgcaaaggctccatgcacgatgtgccgaacgatcttatgaagcatatccatgacctcgagaagatgttcaccatcgataccacaaagctccatgaggttgtgtccgtattccaggaggaactcgtcaaggggttatccgtgacaggaggcacaattcccatgaacccgacttgggtgattggatatcctactggtgatgagacaggcacctacctcgctcttgatatgggtggaacaaatcttcgtgtttgcgaagttgagcttcctgaagagcagggccagtatgacatctatcagtccaagtatcgccttcctgaagagatcaaatccggcaccggtgaacaacttttcgattacattgccgagtgtgtcaagcagttcttgatcgccaatcacgagggccaagacatcaaggatttgaaggagctacatcttggttttacattctcatacccgtgcgagcagaacgccattgatcacggtatcttgcagcgttggactaaaggtttcgatattgaaggtgttgagggtcatgacgttgttcccatgttcgaagaggctcttgagagaaaaggggtccctatcaagattactgctttagtcaatgacactaccggaactcttatcgcttccgcttataccgacaacactaccagaattggttgcattttcggtactggttgcaacgctgcctacatggagactatcggctgcattcctaaacttgctcatatgaatctcgatcctagtcttgagattgccattaactgtgaatggggagcgttcgacaatgaacatcgcgtccttcctcgtactgtatatgacaagcatatcgatgaaaactctccccgcccggggcagcaaacatttgagaagatggttgccggtctttacttaggagaaatcttccgtttggttctcgtcgatctctattctaatcctgatgtttcaatttttgaaaagcaggacattagtactcttcaggctgagtactctttggatgcatccttcctagccgagattgagagcgatccttgggagaatttgatggaaactcatgctctctttgagaagaagttgaagattgtgaccaccgagcctgagcgtaagctcatccgccgccttgcggagctcatcggaactcgcgctgctcgtcttggggcctgtggtgttgccgccatttgcaagatgaagaatattgagtcttgccatgttggtgctgacggctcagtgttcaacaagtatcccaacttccaggagcgtggtgcaaaggctcttcgcgaaatcttcggctggggaagaacaattagaaaggatcctatccagattgttccctctgaggacggaagtggcgtcggcgccgctttgatcgcagcactcaccatgaagcgtattaggaagggtattcatgctggtgttaacgtcaagcgcaagaactcgttgattcctccggtcccataa

SEQ ID NO: 10370 - protein, 497 aa, Tuber borchii
MYLNASRKPPSRKGSMHDVPNDLMKHIHDLEKMFTIDTTKLHEVVSVFQEELVKGLSVTGGTIPMNPTWVIGYPTGDETGTYLALDMGGTNLRVCEVELPEEQGQYDIYQSKYRLPEEIKSGTGEQLFDYIAECVKQFLIANHEGQDIKDLKELHLGFTFSYPCEQNAIDHGILQRWTKGFDIEGVEGHDVVPMFEEALERKGVPIKITALVNDTTGTLIASAYTDNTTRIGCIFGTGCNAAYMETIGCIPKLAHMNLDPSLEIAINCEWGAFDNEHRVLPRTVYDKHIDENSPRPGQQTFEKMVAGLYLGEIFRLVLVDLYSNPDVSIFEKQDISTLQAEYSLDASFLAEIESDPWENLMETHALFEKKLKIVTTEPERKLIRRLAELIGTRAARLGACGVAAICKMKNIESCHVGADGSVFNKYPNFQERGAKALREIFGWGRTIRKDPIQIVPSEDGSGVGAALIAALTMKRIRKGIHAGVNVKRKNSLIPPVP

SEQ ID NO: 10371 - DNA, 1473 bp, Aspergillus oryzae
  CDS (1)..(1473)
atggttggaattggccccaaacgtcccccatcccgcaagggatcgatgcatgagctgccccagaacctgttggagcagatcaagcaattcgaggacatctttaccgtggacggcgccaaactcaagcagattgcggaccatttcgtgaaggagctcgaaaagggtctaagcgtcgaggggggtaacattcccatgaatgtgacctgggtcatgggattccccgatggcgacgagcagggaaccttcctcgctttggacatgggcggtactaatctgcgtgtctgtgagatcactttgacggaagagaagggcgctttcgacatcacccagtccaagtatcgtatgccggaggagttgaagacgggtacagcggaggagctttgggaatacatcgccgactgtttgcagcagtttattgaatcccaccacgagaatgagaaactgtctaaactgccattgggctttaccttctcctatcctgctacacaggaatacattgatcatggtgttctccagcgttggacaaagggtttcgacattgacggagtagagggccaggatgttgtgcccccattggaggcaatcctcaagaaaagaggccttcctatcaaagttgctgcgttgatcaacgacactacgggcaccctgatcgcctcttcttacaccgactcagatatgaaaattggctgcattttcggcactggtgtcaacgccgcctacatggaacattgtggctcggttcccaagcttgcacacaagaatctacccccagacatgcccgtggccatcaactgcgagtacggtgcctttgacaatgagcacgttgttctgcccctcacgaagtatgatatcatcatcgaccgcgactcccctcgcccaggacaacaagctttcgagaagatgactgcaggtctttacttgggagaaatattccgtctagccctcttggatctgttggagacgaggcctggtctgattttccagggccaagacacatcccagctccggaaaccttacttgctggacgcgtccttcctcgcagctattgaggatgatccgtacgagaacttgcaggaaactcaggagctcatggagcgcaagctgaacatcaaggccacccagcaggagctggaaatgatccgtcgcttggcggagttgatcggcactcgtgcagctcgtctgtcggcgtgtggtgtggctgccatctgcaagaagaagaacattgagtcttgccatgtgggcgccgacggctctgtctttacgaaatatccccacttcaaggcccgtggagcacaggctctgcgcgagatcttggactgggcacctaacgagaaggacaaggtggtcatcatggctgctgaagacggttctggtgttggagcggctcttattgctgcattgacattgaagcgggtcaaggcaggcatcagctgcggtatccgagatatggccgatatgcagagtctcatttaa

SEQ ID NO: 10372 - protein, 490 aa, Aspergillus oryzae
MVGIGPKRPPSRKGSMHELPQNLLEQIKQFEDIFTVDGAKLKQIADHFVKELEKGLSVEGGNIPMNVTWVMGFPDGDEQGTFLALDMGGTNLRVCEITLTEEKGAFDITQSKYRMPEELKTGTAEELWEYIADCLQQFIESHHENEKLSKLPLGFTFSYPATQEYIDHGVLQRWTKGFDIDGVEGQDVVPPLEAILKKRGLPIKVAALINDTTGTLIASSYTDSDMKIGCIFGTGVNAAYMEHCGSVPKLAHKNLPPDMPVAINCEYGAFDNEHVVLPLTKYDIIIDRDSPRPGQQAFEKMTAGLYLGEIFRLALLDLLETRPGLIFQGQDTSQLRKPYLLDASFLAAIEDDPYENLQETQELMERKLNIKATQQELEMIRRLAELIGTRAARLSACGVAAICKKKNIESCHVGADGSVFTKYPHFKARGAQALREILDWAPNEKDKVVIMAAEDGSGVGAALIAALTLKRVKAGISCGIRDMADMQSLI

SEQ ID NO: 10373 - DNA, 2056 bp, Sparus aurata
  CDS (97)..(1533)
ctttacttgactgactctgcacacacacagtctggacacacactcaccacacacctagagacacataccgaggctcatttagtcaaacctgcggagatgccgtgtgtcagctctcaactcgaccagatggtgaaaatgccttgcagctacagctctgtgattgataagatccacatggtagagcagatcctgtcagagttcaggctgaataaggaagagctaaaagaagtcatggagaggatgcagcgtgagatggatcgaggactgcgtatagagacgcacgaagaggccagcgtcaaaatgcttccgacttatgtctgctccacccctgagggatcagaggtgggcgacttcctggccctggatctggggggcacaaacttccgtgtgatgctggtgaaggtgggtgaagatgaggagaggagctggaaggtggagaccaagaaccagatgtactccattcctgaagacgccatgacgggcactgcagaaatgctgttcgactacatagcagagtgtatgtccgactttttggacagacatcatatcaagcacaagaagcttcctctcggtttcaccttctcctttcctgtacgacatgaggacattgacaagggtatcctgcttaactggaccaagggcttcaaggcgtcgggggcagaagggaacaatgttgtgggattactcagagacgctatcaagagacgaggggacttcgagatggatgtggttgccatggtgaacgatacagtagccaccatgatttcctgctattatgaagatcgcagctgtgaagtcgggatgattgttggtactggttgtaatgcgtgttacatggaggagatgaggaccgtggagctggtagaaagcgaggagggccggatgtgtgtgaacacagagtggggggcattcggagacaacggggagcttgaggagtttagactggagtacgacagagtcgtggacgagacctcgattaaccccggacatcagctatatgagaagcttatcagcgggaagtatatgggtgagctggtccggcttgtcctggtgaagctggtgaatgaagacctgctgtttaatggtgaagcgtctgagcagctgaagactcgtggcagctttgagacgcgctatgtctcacaggtggagagtgacaccggggacagaaaacaaatctacaacatcctgtcctcactgggtgttctgccatcagagctggactgtgacattgtacgtctggtctgtgagagtgtttccactcgctctgcccacatgtgcggcgcagggctcgctggtgtgatcaacctgatgcgtgagcgacgcagccaggaggccctggcaatcacggtgggggtcgacggatcagtctacaagctgcacccatgtttccgtgacaggttccacaagatcgtcagagacctcacgcctcactgtgagatcgccttcatccagtcggaggaggggagcggccgcggagctgctctaatctcagcagtggcctgtaagatggctgcttgcatgctgacacagtaaagggagccgtgcaatgagcaagcctgaactctgagtttgagaacatgtcatcccggtcggcagctctggccttttcaggctaagtggatactcgtcactggaagatatacagaaaagaaagcagtaaacaacttgtattattgttattctactgtatttggtagaattagaccaacttgtaacaatgtcagtgtgtctgaactggtttgaattggtttactgtgacggactgggccatttaaagaatggctggcgtattattgatgagtgtgttataataccagtgcaaactggttgatgtacatcacattggattgtttttgtaaatgctgttgtaaactacatcatattcattgctttgctgtgttgtcatttctgtttgttctactgtatatttgaattttacgtttacaaccttatgtgtgttagccagtaggttatagtttttcatgagtgcgtgatgaaatgtgatggaggtaaataagctgtaaataaaactgctcaattaaaggtcccatattgt

SEQ ID NO: 10374 - protein, 478 aa, Sparus aurata
MPCVSSQLDQMVKMPCSYSSVIDKIHMVEQILSEFRLNKEELKEVMERMQREMDRGLRIETHEEASVKMLPTYVCSTPEGSEVGDFLALDLGGTNFRVMLVKVGEDEERSWKVETKNQMYSIPEDAMTGTAEMLFDYIAECMSDFLDRHHIKHKKLPLGFTFSFPVRHEDIDKGILLNWTKGFKASGAEGNNVVGLLRDAIKRRGDFEMDVVAMVNDTVATMISCYYEDRSCEVGMIVGTGCNACYMEEMRTVELVESEEGRMCVNTEWGAFGDNGELEEFRLEYDRVVDETSINPGHQLYEKLISGKYMGELVRLVLVKLVNEDLLFNGEASEQLKTRGSFETRYVSQVESDTGDRKQIYNILSSLGVLPSELDCDIVRLVCESVSTRSAHMCGAGLAGVINLMRERRSQEALAITVGVDGSVYKLHPCFRDRFHKIVRDLTPHCEIAFIQSEEGSGRGAALISAVACKMAACMLTQ

SEQ ID NO: 10375 - DNA, 1800 bp, Oryza sativa
  CDS (1)..(1800)
atggagaggtgccagcgccgccgctggatcggcccagccatcaacgtgggccgtgagcccccctcgtcgacggcccatctaaggcccgcaccgcgaaaagcccaacgcacggcgaaggcgacggcggtggcgaccggcgaccccgactccggccaacttctccattcacctccatgccaatgtgacgcgagtaaatccatccaatccaatccaatccacgatccaatttggttgctggattctcttctgttcttggatagatatccatccgatccgaccatggacaatgtttcctccccctgttgctacgcagtgtgcagttaccgaaaagctaaggaacagaacaagaagagcacgacgcttatccctttccgctgccgccgtatcgatcgcttttcgattcgcctgtcggggaccgggatcatggcggcggtggaggcggagaaggtggtggcggagctgcgggagaggtgcgcgacgccggcgtcgctgctgcgggatgtggcggcggcgatggccggcgagatgggcgccggcctggagaaggagggtgggagcagggtcaagatgctgctctcctacgtcgacaagctccccactgggagagaggatggattgttctatggattggacctaggaggaacaaacttccgggtgctcaaggttcatcttggtggcagcaagaagcatgtcgtcaactctgaatccagggaagtcagcatcccaccacacctgatgtcagggacctcccaggaattgtttggtttcattgctggggaattaggcaagtttgttgctgaagaggaggagggtactgacatgccaaacggcaagaagaaagagctaggattcaccttctcttttcctgtgaggcaacgatctgtggcatcgggtacccttgtcaagtggacaaaggcgttttccattgatgatgcagtaggtgaagatgtggtggctgaactacaaacggctatggtgaaacaaggtctggacatgcatgtagctgcattgattaatgatgctgttggaacattggctggagcaagatactacgatgaagatgttgtcgcaggtgtgatatttggtactggcacaaatgctgcatatgttgagaaggcaaatgctataccaaaatgggaaggggagttgcccaattcaggggatatggtcatcaatatggaatggggtaatttctattcatcgcatcttccagttactgaatacgatgaagcattagacaaggaaagcttaaaccctggagagcagatatatgagaagttaacatcaggaatgtatttaggtgaaatcgtaagaagagtgctgcttaaactgtccttgcagtctggaattttcggttctatagataactccaagctcaaaacttgtttccatctgcggactccgcacatttctgcaatgcaccatgatgaaacacctgacctaaagatagtggctgaaaaattgcatcaaatcctgcagattacacatacatccttagagataaggaaaatggttgtcgaaatatgcgatatcgtggcaaggagggcagctcggctggctgctgctggtgttgcagggatcctcatgaagcttggaagaaatggcggcatcaacaatcagcgctcggtcatcgccattgatggaggtttgttcgaacactacaccaaattcagggaatgtttggagagcacgttgggtgagttgctgggagaggaggcttccaagtcggtagccgtcaagcacgcgaacgacgggtcagggataggggctgcccttattgcagcctctcaatctcgatga

SEQ ID NO: 10376 - protein, 599 aa, Oryza sativa
MERCQRRRWIGPAINVGREPPSSTAHLRPAPRKAQRTAKATAVATGDPDSGQLLHSPPCQCDASKSIQSNPIHDPIWLLDSLLFLDRYPSDPTMDNVSSPCCYAVCSYRKAKEQNKKSTTLIPFRCRRIDRFSIRLSGTGIMAAVEAEKVVAELRERCATPASLLRDVAAAMAGEMGAGLEKEGGSRVKMLLSYVDKLPTGREDGLFYGLDLGGTNFRVLKVHLGGSKKHVVNSESREVSIPPHLMSGTSQELFGFIAGELGKFVAEEEEGTDMPNGKKKELGFTFSFPVRQRSVASGTLVKWTKAFSIDDAVGEDVVAELQTAMVKQGLDMHVAALINDAVGTLAGARYYDEDVVAGVIFGTGTNAAYVEKANAIPKWEGELPNSGDMVINMEWGNFYSSHLPVTEYDEALDKESLNPGEQIYEKLTSGMYLGEIVRRVLLKLSLQSGIFGSIDNSKLKTCFHLRTPHISAMHHDETPDLKIVAEKLHQILQITHTSLEIRKMVVEICDIVARRAARLAAAGVAGILMKLGRNGGINNQRSVIAIDGGLFEHYTKFRECLESTLGELLGEEASKSVAVKHANDGSGIGAALIAASQSR

SEQ ID NO: 10377 - DNA, 1356 bp, Caenorhabditis elegans
  CDS (1)..(1356)
atgaaggttctaccaccagaagtcgaggaaatcctcgcgaaattccgtttaaaccgtgaacaacttcaagaaatcagcgaaaaagtggagcaacaaatgaaaatgggtctcgcaaagactcaaggctcatcgattgcaatgttgccgagttatgtaccagcgttgccagatggaacagaaaccggaaaatacgtggcaatcgatttgtcgggaaagaatcttcgaataatgttactcacaatgaacggagccggaacgacgcccacgcatgaaacagtcaattatatagtagctaatcatgttatgaagggaaccggtgatcagcttttcacattcatcgtcaattgcctccaacgattcctacaagaattcggactagttgatgctaatttacctattgggttcgtattctcatatccatgtgaactattgtcaattcgttcggcacgtcttttgtggtggactaaagggttcgatattaaggattgtttgcaacgggatattgtagctctattggaagaggctctcgagatgaatatgtccacaaaagtgagcatcaaagcagtgatgaacgacacagtaggacagttggctgctgccgcacacaaatatggtccagaatgcacaattggggtggttatcggttatgggtgcaactcgtcatatctggaaaaaacgtcccgaatcacgaaattcgacgcaaaagctcgcggttacgatcatgataacatgattgtcgtcacagaatgggaggaatttggaaaacatggtgaactcgacgatattctgacacaatttgatcgggaagtcgacgccgccagtgtgcacaaaggaaaacagctaatcgataaattgtgcggagccctgtacattggtgaagttgtgcgacgagtactttctcaactggttttggatagagttctattcgaaggacaatcgtgtgaaaaattggacgaagacgagtcattcccgacaaaatatatttcagagattttgggtgaagaagaaggtgtattcaaggcgtgtcgacgtatttgtgaagagcttgaagttgaaatgcacggaactggagattatattataatacgagaagtgtgtgacgtcatctctagacgaggagccagtattgttgccgcagccatcagcgctctgctccgtcacctggaactgtcttccgtgaaaattggtgtaggtggcgctcttattcaattccatccaacctatcatcaaatgctaaaggagaagctcgaagagctcacgccgattaccatgaaattcgaactcgtacctgccgacgaaggaagttgtcaaggagccgctctaattgccgccgttgccgaacgcctgaagctctaa

SEQ ID NO: 10378 - protein, 451 aa, Caenorhabditis elegans
MKVLPPEVEEILAKFRLNREQLQEISEKVEQQMKMGLAKTQGSSIAMLPSYVPALPDGTETGKYVAIDLSGKNLRIMLLTMNGAGTTPTHETVNYIVANHVMKGTGDQLFTFIVNCLQRFLQEFGLVDANLPIGFVFSYPCELLSIRSARLLWWTKGFDIKDCLQRDIVALLEEALEMNMSTKVSIKAVMNDTVGQLAAAAHKYGPECTIGVVIGYGCNSSYLEKTSRITKFDAKARGYDHDNMIVVTEWEEFGKHGELDDILTQFDREVDAASVHKGKQLIDKLCGALYIGEVVRRVLSQLVLDRVLFEGQSCEKLDEDESFPTKYISEILGEEEGVFKACRRICEELEVEMHGTGDYIIIREVCDVISRRGASIVAAAISALLRHLELSSVKIGVGGALIQFHPTYHQMLKEKLEELTPITMKFELVPADEGSCQGAALIAAVAERLKL

SEQ ID NO: 10379 - DNA, 1869 bp, Haemonchus contortus
  CDS (50)..(1507)
tcgtcatctccgccttcttccttccgacagtcaggcttagtcactgaccatgcttttcgacatcgcgttcaaggacgtacttcattgtgtggatgaactacaatgtgtcagacctccacgacccgtatcggatttcgaaaggatccaggagcgatgtcgtcctctggtgttatctgatgaacagttacgcgagattatggttgccttggagaggagcatggaggaaggattggcgaaagaaacagcgaagacagccgctgtgaaaatgctcccgtcgtatgttcgagcagtgcctaacggaaaggaatgtggcgacttcatggcactggaccttggcgggactaattttcgtgtgctactaatccgattaagcggccgagaagcggaaatgactggcaagattttccgagttcccgaaagcatcatgcgtggaacgggagaagcccttttcgatcatatcgctgaatgtatggcaaagttcatggtcgaacaaggtgtgagcacctctcagaagctaccccttggcttcaccttctcattcccgtgcaagcaagaaggtttaacatgtgcaaaactcataaattggacgaaaggcttcaacgcgagcgatgtcgaaggcgctgacgtcgtaacattgttaagagaagcatgtaaaagacgaaatgacatcgacattgatgtggttgctgttttgaacgataccgtcggcacacttttggcatgcgctttcaaggaaaacagttgtcagattggtgtcatcgtgggaactggaacaaatgcttgctacatggagaaactgtctcgcattggaaaactggaaggggaaatgcctgaagacaacctgcccgatgagatgattatcaatacagaatggggcgcctttggcgacgatggggcactggatggtatactcaccgaattcgatgctcaagtcgactcgctaagtatcaatcccggaaaacaactgtttgagaaaatgatttcgggaatgtatatgggggagctggtgagagtagtgctggcttcactagcagcggatggtctgctattcaacggcgaatacgaagccatatcccgccacggatgtttcccgacaaaattcgtctctgagattgagagtgatctactcgaaggagaggatgcaacattccaaaaaaccttccaaatattagaagacattggaatcgagcgtgtgtcgagtgctgactgtgccaacgtagcctatacttgcagccttattagcaccagggccgcttctctaaccgctgctgcaattgccacactgctgaatcgtatgaagagaccctacgtcacagttggtgtagatggatccgtatatcgtttccatccaacgtttccccgtctcctagacgaaaagatcgaccagttgatagaaggagacttagagtaccagttgatgctatcagaagacggaagcggacgaggtgcggcgctggtagcggccgtcgctactcgcataaaacgggaacggctcggccacgcttaaatcacgcttacagtctatgtgtgtcaactactcacaaatttagctctgaaatcataactattgtagatatatctaaggcctgtgaatgtagtattttgtgaaactggttaggaccatcgatgatccttgatggaattgtgacttttgttttgggtctagttttgggtaacagatttaggactaacgataaggtatcgatgattgattgtgatactggtcacttagtacgtgctaatcattaatactaatgtgttcaatgactaaattttaggatgtattcactgaaaagagtgactagatatatttacaagaatgtttccccttggacctaatagtccagctgtgaataaagtattcaaaac

SEQ ID NO: 10380 - protein, 485 aa, Haemonchus contortus
MLFDIAFKDVLHCVDELQCVRPPRPVSDFERIQERCRPLVLSDEQLREIMVALERSMEEGLAKETAKTAAVKMLPSYVRAVPNGKECGDFMALDLGGTNFRVLLIRLSGREAEMTGKIFRVPESIMRGTGEALFDHIAECMAKFMVEQGVSTSQKLPLGFTFSFPCKQEGLTCAKLINWTKGFNASDVEGADVVTLLREACKRRNDIDIDVVAVLNDTVGTLLACAFKENSCQIGVIVGTGTNACYMEKLSRIGKLEGEMPEDNLPDEMIINTEWGAFGDDGALDGILTEFDAQVDSLSINPGKQLFEKMISGMYMGELVRVVLASLAADGLLFNGEYEAISRHGCFPTKFVSEIESDLLEGEDATFQKTFQILEDIGIERVSSADCANVAYTCSLISTRAASLTAAAIATLLNRMKRPYVTVGVDGSVYRFHPTFPRLLDEKIDQLIEGDLEYQLMLSEDGSGRGAALVAAVATRIKRERLGHA

SEQ ID NO: 10381 - DNA, 1971 bp, Spinacia oleracea
  CDS (280)..(1776)
acgagccttaattagaccacctcaaggcaaagctccgattaaaccggtccctccaaaaaaaaaactcatctgaattttccccaatcaaattctcccggatctactccttctctcccttctttctctctctagattgcatcttgtaaagaaagaaagaaaccaaaatttcccaacatgccaaattaatccatcttctttccattgttgtaattagagagagaaaatcaaattgaagagcacccatctgattttttttagtggacgttacatagagagaaaatgaggaaggcagcggtcggagcagcggtggtatgtacagcggcggtgtgtgcggcggcagcggtgttggtaagacagaggatgaagagctcaagcaagtggggtcgtgtaatggcaatactgaaggagttagatgacaattgtgggacccctttgggtaagcttagacaggtggctgatgctatgaccgttgagatgcacgctggtcttgcatctgagggtgcttctaagctcaagatgctcatcagctacgttgacaatctccccactggggacgagcatggactgttctatgcgttagaccttggcggcaccaacttccgagtgcttcgagtaaagttgggtggcaaagaaaaacgtgttgtcgaacaagaatttgacgaagtatcaattccacctgagttgatggttggtacatcagaacaactgtttgattatatcgccgaagccctagccaaatttgttgcaacggaaagtgaaggtcttcatcctgaacccaataaacagagagagctgggatttaccttctctttccctgtcaagcagacatcaatcgcatcagggactcttataagatggaccaagggctttaatatagaagatacagttggtgaagatgtggtggctgaattgaccaaggccatgctaagaaaaggtgtagatatgcgtgtgacagctttggtcaacgatacagttggaaccctagctggaggtaggtactataaagaagatgtaattgctgctgttatattgggtactggaacaaacgcagcttacgttgaacgtgctagtgcaattcacaagtggcatggtcctttgcccaaatcaggggagatggtaattaacatggagtggggtaatttccgttcatcgtatttacctttgactgaatatgacatagcactagatgaagaaagtttgaatcctggtgaacagatatttgagaaaatgatatcaggaatgtacttgggtgagattgtgcgaagagtcttgtataggatggcagacgaggccagcctttttggtgatacagtcccatcaaaattgaaaactccattcatcttaaggacaccagacatgtctgccatgcatcatgacacatcacctgatcttaaagttgttgcgagcaaactgaaggatgtccttgggataccaaactcatcattaaaggtgcgaaagattatagttgacgtatgtgacgtcattgcttcacgtggggcctgcatttctgcagccgggatcttgggtattattaagaaactagggagagacacattgaagcaaggtgagaaccagaagtctgtgattgcattagatggagggttgtttgagcactacgccaaattccgggagtgcatggaggactctttgaaggagctcctaggcgatgaagtcgctgaaactattgtaattgagcactcaaatgatggatcaggcattggtgctgctcttctagcagcgtcgcattcccagtacctcgaggaagatgaatcttgatgacaagatcctacatcctcaattttgtataactttcttcaagctccttagatccttagagatcatggaaattttttcttttttttttcttttttctttttagactttgctgccccagtgaagaataaattatggccaaacgggctctgcttgctgcatgaaaaaatggcatgaagctcgctgttctctcgtgcc

SEQ ID NO: 10382 - protein, 498 aa, Spinacia oleracea
MRKAAVGAAVVCTAAVCAAAAVLVRQRMKSSSKWGRVMAILKELDDNCGTPLGKLRQVADAMTVEMHAGLASEGASKLKMLISYVDNLPTGDEHGLFYALDLGGTNFRVLRVKLGGKEKRVVEQEFDEVSIPPELMVGTSEQLFDYIAEALAKFVATESEGLHPEPNKQRELGFTFSFPVKQTSIASGTLIRWTKGFNIEDTVGEDVVAELTKAMLRKGVDMRVTALVNDTVGTLAGGRYYKEDVIAAVILGTGTNAAYVERASAIHKWHGPLPKSGEMVINMEWGNFRSSYLPLTEYDIALDEESLNPGEQIFEKMISGMYLGEIVRRVLYRMADEASLFGDTVPSKLKTPFILRTPDMSAMHHDTSPDLKVVASKLKDVLGIPNSSLKVRKIIVDVCDVIASRGACISAAGILGIIKKLGRDTLKQGENQKSVIALDGGLFEHYAKFRECMEDSLKELLGDEVAETIVIEHSNDGSGIGAALLAASHSQYLEEDES

SEQ ID NO: 10383 - DNA, 3062 bp, Homo sapiens
  CDS (75)..(2846)
gacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacaaaaaaaaaaaaa

SEQ ID NO: 10384 - protein, 923 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSLSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRGNRGLEELAVSVGVDGTLYKLHPRFSSLVAATVRELAPRCVVTFLQSEDGSGKGAALVTAVACRLAQLTRV

SEQ ID NO: 10385 - DNA, 2245 bp, Mus musculus
  CDS (1)..(1398)
atgctggatgacagagccaggatggaggccaccaagaaggaaaaggtagagcagatcctggcagagttccagctgcaggaggaagacctgaagaaggtgatgagccggatgcagaaggagatggaccgtggcctgaagctggagacccatcaggaggccagtgtaaagatgttgcccacctacgtgcgttccaccccagaaggctcagaagttggagactttctctccttagacctgggaggaaccaacttcagggtgatgctggtgaaagtgggggagggggaggcaggacagtggagcgtgaagacgaaacaccagatgtattccatccccgaggacgccatgacgggcactgcggagatgctctttgactacatctctgagtgcatctctgacttcctggacaagcatcagatgaaacacaagaaactacccctgggcttcaccttctccttccctgtaaggcacgaagacatagacaagggcatcctgctcaactggaccaagggcttcaaggcctccggagcagaagggaacaacatcgtgggacttctccgagatgctatcaagaggagaggggactttgagatggatgtggtggcaatggtgaatgacacggtggccacaatgatctcctgctactatgaagaccgccaatgtgaggtcggcatgattgtgggcaccggctgcaacgcctgctacatggaggagatgcagaatgtggagctggtggaaggcgatgaggggcgcatgtgtgtcaacacagagtggggcgccttcgggaactccggtgagctggacgagttcctgctggagtacgaccggatggtggatgagagctcagtgaaccccggtcagcagctgtacgaaaagatcattggcggaaagtacatgggcgagctggtacgacttgtgctgctcaagctggtagaggagaatcttctgttccacggagaggcctcagagcagctgcgcacacgtggtgcttttgagacccgttttgtgtcgcaggtggagagcgactctggggaccgaaggcagatccttaacatcctgagcactctgggccttcgaccctctgtcgccgactgcgacattgtgcgccgtgcctgtgaaagcgtgtccactcgcgccgcccacatgtgctcagcaggactagcgggggtcataaatcgcatgcgcgaaagccgcagtgaggacgtgatgcgcatcacggtgggcgtggatggctccgtgtacaagctgcacccgagcttcaaggagcggtttcacgccagtgtgcgcaggctgacacccaactgcgaaatcaccttcattgaatcagaggagggcagcggcaggggagccgcactggtctctgcggtggcctgcaagaaggcttgcatgctgggccagtgaaatccaggcaaggacagggacctgggttccacggggactccacaccccacaaatgctcccagtccactagggcaggagacctattctgctgctacccctggaaaatggggagaggcccctgcaagccaagtcagccagtgagacagccctagggctctcagcctggggcaaggggcaagaggatcagcggcaccaaaagcctttcttgctagaatcaactacagagaaaggtgaagcacactcaggtcttgctctttcagcttctggcctcccacagctgtgggtctggcctcccaagggagtgcctcctggacttgcaatggcctggcttccctgggaacacatctccatgaggaggtagcttcagcagcttggccagaccagacctggcccccagaagagtaagggctgcccagacctggctgttttcttgcctgtggctgaagaggctgcgaaaccatgggagaccgactatctagctacatggagggggactttccaggccacaaacattccagagacagtctccttcatatacctccacccctgagtggcttacagttctgggatgaaccctcctaggagatgccagaggatagaggcccagagtccttgctctaggggacctgaaggggagcgcctcactctgcactgttagcaggatggcagcttcaacactcacatccgtgatccgggaagagaagcaagccacccacagcatctctccaggaaaccacccaggtccctctgtccctcatccctgtcaggtttcccagatgccatgccgccctctccacaccagcttggaaccatgggggagtttttaattaaatatttaaaactactt

SEQ ID NO: 10386 - protein, 465 aa, Mus musculus
MLDDRARMEATKKEKVEQILAEFQLQEEDLKKVMSRMQKEMDRGLKLETHQEASVKMLPTYVRSTPEGSEVGDFLSLDLGGTNFRVMLVKVGEGEAGQWSVKTKHQMYSIPEDAMTGTAEMLFDYISECISDFLDKHQMKHKKLPLGFTFSFPVRHEDIDKGILLNWTKGFKASGAEGNNIVGLLRDAIKRRGDFEMDVVAMVNDTVATMISCYYEDRQCEVGMIVGTGCNACYMEEMQNVELVEGDEGRMCVNTEWGAFGNSGELDEFLLEYDRMVDESSVNPGQQLYEKIIGGKYMGELVRLVLLKLVEENLLFHGEASEQLRTRGAFETRFVSQVESDSGDRRQILNILSTLGLRPSVADCDIVRRACESVSTRAAHMCSAGLAGVINRMRESRSEDVMRITVGVDGSVYKLHPSFKERFHASVRRLTPNCEITFIESEEGSGRGAALVSAVACKKACMLGQ

SEQ ID NO: 10387 - DNA, 2449 bp, Schistosoma mansoni
  CDS (4)..(1359)
aaaatggtgttttcagaccagcaactttttgagaaagtagtcgagatactcaagccatttgatctttctgtggttgattatgaggagatttgtgataggatgggagaatcaatgcgactaggtttacagaagagtacaaatgaaaaatcatctattaaaatgtttccatcttatgttacaaaaacaccaaatgggacagaaaccggaaacttcttagctttagaccttggtggaacaaattatcgagtgctttcagttacccttgaaggtaaaggaaaatctccaagaattcaagagagaacatactgtatccccgcagaaaaaatgtcaggttccggaacagagctctttaaatatattgctgagacactggctgactttttggaaaacaacgggatgaaggacaaaaagtttgacctcggattcacattctcttttccatgtgtccaaaaaggcctcactcatgctactttggtgagatggacaaaaggtttctctgcagatggagtagaaggtcataatgttgctgaattgctgcaaactgagctagacaaaagagaattaaatgttaagtgtgtcgcggttgtaaacgatacagttggcacacttgcttcttgtgctcttgaggacccaaaatgtgcggtcggattaatagttgggacggggacaaacgttgcttatattgaggactcttcgaaagttgagctgatggatggtgtgaaggaacccgaagtcgtcataaacacagagtggggtgcattcggcgagaaaggagaattagactgttggaggacacagttcgacaaatcaatggatatagacagtcttcatccaggaaagcaactatatgaaaaaatggtatctgggatgtatcttggtgagctagttcgccacatcattgtttaccttgttgaacaaaaaattctctttcgtggagatctccctgaacgtttgaaagtacgcaattctttgctaactagatacttaacggatgttgaaagagatcctgctcaccttttatacaacactcattatatgcttactgatgacttgcatgtccctgttgttgagccgatagataaccgtatagtacgatatgcctgtgaaatggtcgttaaacgggcagcttacctagcaggtgcaggtattgcctgcattcttcgaagaataaaccgctcagaagtaactgttggtgttgatggctctttgtataaattccacccgaagttttgtgaacgaatgacagatatggttgataagctaaaaccaaagaatacacgattctgtctacgtttatctgaagatggaagtggaaaaggagcggcggccatagcagcgtcatgtacacgacaaaattaaataatacacacacaagaaactattgtttacattcagtgctttcatctgttttgttggcctgatacaattctccgataattcagaaaactggccctctttatttagtttcttggctatgattaatttactatacttcggaacaatataatcttaatattgaaggaaagaaacatcattatgaaattaaagaatcaaatataaatcgactgttttttttcttattagattacataataaagtagttcaataacttagttctttatatacacggcatttttctgtaacttcctatgacttctgttatctggtttttatatcaataaagtatacttcatatatatatatatatatattgagaacttctagtcagtcagtggcatcaaagtcacagaatcttatagattatataattctctttggctttattatgtaagagtcaatgaaactatatcctaaacaaaaaaagttttttttctcttcatcagctattctatgcaatacatgaagaattattctttaatgctataattatagaaatatttttttctcttttaaatttgcaattttgtagagtaaacataaataagatttttagttgtaaaagaaggcaaatattctaattatattcgctatggtttttacttttttttatgtttcatacacaaaaaaaagaagaaggaaaagaaactcttatatcttttagttttcattaatattactattatttttgaatcattattcttattatattacgattattgtattacgtatatatatatatatatatatatattaaaaaaaagaaaatgttagccggaatgtaaacaatcagatttagtgtatttcattctagcacattgtgataaatttgtttaactatttatttccttgtgtgtgtgtgtgtgcttgtgagcgcgtttatttgtgatcggctaattgaacatatctatggtaaacaaaattaagaaatgaaagatctcctgttgtaaattacaacataatttgagtttgaaaacaaaacaaaaggattgataaatatgtaatcattttgtatttatgggccaaatatatctcactattttatgctatt

SEQ ID NO: 10388 - protein, 451 aa, Schistosoma mansoni
MVFSDQQLFEKVVEILKPFDLSVVDYEEICDRMGESMRLGLQKSTNEKSSIKMFPSYVTKTPNGTETGNFLALDLGGTNYRVLSVTLEGKGKSPRIQERTYCIPAEKMSGSGTELFKYIAETLADFLENNGMKDKKFDLGFTFSFPCVQKGLTHATLVRWTKGFSADGVEGHNVAELLQTELDKRELNVKCVAVVNDTVGTLASCALEDPKCAVGLIVGTGTNVAYIEDSSKVELMDGVKEPEVVINTEWGAFGEKGELDCWRTQFDKSMDIDSLHPGKQLYEKMVSGMYLGELVRHIIVYLVEQKILFRGDLPERLKVRNSLLTRYLTDVERDPAHLLYNTHYMLTDDLHVPVVEPIDNRIVRYACEMVVKRAAYLAGAGIACILRRINRSEVTVGVDGSLYKFHPKFCERMTDMVDKLKPKNTRFCLRLSEDGSGKGAAAIAASCTRQN

SEQ ID NO: 10389 - DNA, 1407 bp, Toxoplasma gondii
  CDS (1)..(1407)
atgcagcctcgtcaaccaggcgacgaagcgaagcagctcgcggagctggaggtcgttcgccaaatgatgaccccgacacgcgaggttctgctggagctgcacgaaagctttttgaaggagctacaacgcggcttggaaatgcacaagagacacggcatcacatgggtgcctgaggaatgctcgatgaaaatgctggacagctgcgtgtcgaatctgccgactggtgccgaagttggcgaggcatatgccatcgacttcggaggctcgacatgccgggctgttcgttgttctcttcttggcaagggcaaaatggaaattattcaagacaaaatctgcctgagaagcgcggaacatcgatgcgccaagggattcatggacaagaaggcaggaggcaaagaactgttcgaccaattcgccatgtgcatccgcggcctgatggataggtccggagacctgaagaaggcggaagagaccaacacacctgtcccagttggattcactttctcttttccttgcgcccaagcggcgttgaactctagctttctcattgagtggacaaagggcttcgaaactggccgcgagaacccggatcgtgtagaaggcaaagatgtggcagtgttgcttgccgatgcactgcaacgtcataacgttcctgctgtctgcaaggctatcgtgaacgacacggttggcacattggtgtcttgcgcatatcaaagagtgccaggcactccggagtgccgtgttggactcatcatcggcaccgggttcaacgcgtgctacgtggaacctgaagctagcaactatggctacacgggtaccgtcgtgaatatggaggcaggcaacttccacaaggatcttccgcgcaacgaaatcgacgtcgaggtcgatgagaagacacacaacagaggcaaacagcaattcgagaaactcgtgtcgggctactacatcggcgaaatcgtccgggtcgctgcagtcagagtatttggcgcccgtgcccccgagaaagcaagtgtcagacactcgattcatggtgaaacggcctcgacgatccgtgatgaccatagccaggacaaagccgccagcattcaggctatcaaggagtgctggggtgtgacgatggacttggacgacatcaagtgcatctgggagatttgccgactcgtcttcgaccgctcagccgcgttcgctgcaacgctggcggtcgctctgtgctaccgaacagggcgacttgacaccggatccaccgtaggaattgatggtgctttgtatgtgaagaaccagtggtaccgggaggctgttgagtactacacaaaattggtcgccggcgacgcggcgaaaaacattcactactgcattgcggatgacggctctggcaagggtgctgctctgatcgcagatgtgaactga

SEQ ID NO: 10390 - protein, 468 aa, Toxoplasma gondii
MQPRQPGDEAKQLAELEVVRQMMTPTREVLLELHESFLKELQRGLEMHKRHGITWVPEECSMKMLDSCVSNLPTGAEVGEAYAIDFGGSTCRAVRCSLLGKGKMEIIQDKICLRSAEHRCAKGFMDKKAGGKELFDQFAMCIRGLMDRSGDLKKAEETNTPVPVGFTFSFPCAQAALNSSFLIEWTKGFETGRENPDRVEGKDVAVLLADALQRHNVPAVCKAIVNDTVGTLVSCAYQRVPGTPECRVGLIIGTGFNACYVEPEASNYGYTGTVVNMEAGNFHKDLPRNEIDVEVDEKTHNRGKQQFEKLVSGYYIGEIVRVAAVRVFGARAPEKASVRHSIHGETASTIRDDHSQDKAASIQAIKECWGVTMDLDDIKCIWEICRLVFDRSAAFAATLAVALCYRTGRLDTGSTVGIDGALYVKNQWYREAVEYYTKLVAGDAAKNIHYCIADDGSGKGAALIADVN

SEQ ID NO: 10391 - DNA, 3901 bp, Brachydanio rerio
  CDS (128)..(2884)
cgccattttacaggaacccacgctgcttctggggcccagactgctttttcctgcctcaccggaaaggattgtaaggctttgctcttcttttcttctctttgctttttcaccaaagaggtgaagcaggatgatagcggcacagcttctggcctactacttcactgaactgaaggatgaccaggtcaaaaagattgacaaatacttgtacgccatgcggttctctgacgagacgctgcgcgatattatggctcgtttccgacgggaaatggagaacggattggcacgagacaccaacccgacagccaccgttaaaatgctgcccacctttgtaaggtccattcctgatggatcagagaaaggagatttcatcgcactggatctgggtggctctaatttccgtattctgcgtgtaaaagtgtctcatgagaagaaacagacagtgcagatggaaagtcagatttacgagactccagaagacatcatccacggcagcggatcacggttgtttgaccatgttgcagaatgtcttggagacttcatggagaaacaaaaaattaaagacaagaagcttcctgtgggcttcaccttctcatttccttgttcacaaagcaaactggatgaggctgttttgctgacatggacgaaacgcttcaaggttaatggagtagagggaatggatgtagtgaagcttctcaataaggccattaaaaaacgtggagattacgaagcagatataatggctgttgtcaatgacactgttggaactatgatgacctgcggatttgatgaccagcgatgtgaagtcggcattatcataggtaccggcactaatgcatgctacatggaggagctcagacacatggacatggtggagggagatgaaggcaggatgtgtattaatactgaatggggggcgtttggagatgacggcacattggaggacatccggactgagtttgacagggagattgaccgaggatccctcaaccctggcaagcaactgtttgagaagatggtgagtgggatgtacatgggtgagctggtgaggctgatcctggtcaaaatggctaaagaaggcctgctgtttgaaggccgcatcacaccagagctgcttacaaaaggaaaaatcgaaaccaagcacgtttctgcaattgagaagagcaaggaaggactaaccaaagccaaggagattttgacacgcttgggtgtagagccgtctgaggacgactgcattgctgtgcagcatgtttgtgccattgtctcttttcgctctgctaatctaattgctgccactttgggtgcaatcctgacacgtctgaaggacaacaagaacaccccacgtctccgcaccaccgtgggcattgatggctccctatacaagatgcacccacagtatgcccgtcggttgcacaaaacagtgcgtcgtctggtgccagagtctgatgttcgcttcttgctgtctgagagtggaagtggaaagggagctgcactggtgacagcctgggcttaccgtttggcggaccaggagcgtcaaattgcagaaaccctggaagagttcaggttgaccaaagaccagctgctagaggtgaaaaagaggatgagaactgagattcagaatggactgagcaagagcacccaaaacacagccaccgtcaaaatgctgcccacatatgtgcggagtacccctgatggatcagaaaacggtgactttttggctctggatcttggaggtacaaacttcagggtccttttggtaaagattcgcagtggcaagagacgaactgtggagatgcataataaaatttatgccattcccatagaagtaatgcaaggaaccggagaggagctttttgatcacatcgtgtactgcatatctgacttcctggactacatgggaatgaagaatgcccgtctgcctctgggctttaccttttctttcccctgcagacaaactagtcttgatgcgggactcttggtgaattggacgaagggctttaaagccacagactgtgaaggtgaagatgttgtcggccttctgagagaggggatcaagaggagagaggagtttgatttggatgttgtagccatagtaaatgacacagtgggcacaatgatgacctgcgcatatgaagagcccacgtgtgaggttgggctaatcgcaggaacgggcagcaatgcctgctacatggaggaaatgcgaaacatcgagacagtaagtggagaggagggcaggatgtgtgtgaatatggagtggggagcatttggagataatggctgtctggatgacatccggacgaagtatgacgatgctgtggatgacctctccctcaatgccggcaaacaaaagtatgagaagatgtgcagtggcatgtacctgggtgagattgttcgaaacatcttgatcgacttgacgaagcgaggcttcctcttcaggggacagatctctgaaacactgaagaccagaggcatcttcgaaaccaagttcctgtcccaaattgagagtgaccgtttggcgctactgcaggtcaggtctattctccagcatctgggtctggacagcacatgcgatgacagtatcatcgtcaaggaggtttgtggagctgtttctcgtcgagcagctcagctctgtggagcaggaatggctgctgttgtggataaaatccgggagaaccgtggactggatcatctggacatcactgttggagtggatggcaccctgtataagctccatccacatttctctaggataatgcatcagacggtgaaggagctcgcccccaaatgcaacgtcactttccttctctcagaagacggaagcggtaaaggtgctgccttgatcaccgccgttgggtgtcgcctccgccagcaagaacagaagagctgaaccctgcgatgaacaagccctcggcctcttctccagctctccaagagctcatacatttccactcgcagctgtgactcggctctcaaaaaccacgacccggcacatccttctgctcattcccagagctgggatctgaccccttggctttgtatttcactcctacatgttcctgtttgtctatgtgtgttattaggggttggtccatcagcgtccacccaactatataaagatgttctttaagatgttaaattgttgttaaagtatttatggatgtatattggaaaaagggaagaaatgtaaacacagtacaaccattaaagtaaagatatttgaccaagtatattaagatattatttattttatttttctatctgccggtagacataacaggaatggatacctgaggaaaagaaggtattttgttgcgattatgccaagctaactccaaacctctgcatattgtcatttgtctgtgtggcagcttgtagtgatgaatactgcgaaacattcactgtcgaagtgaggaagacgtgcaaattgcagtcacagctgccttcctgtgtaattcaaaccactacttgtcgccatacaaatgaacaaagacaggaaaacctattgcctttgcatatccaacctttccgaattagtcttaccttctcatacccgaagcggactgtatcgtgcgtattgcttttgtcagctttttgctgtgtgtgtgtatatgcagatatgcgggttgtcggtactgattcccagtaaatgttcttctgtgtgccccggctggttatttgtgagtgattgtgtgtagttcatgtgagtgaatctgtgtagtggctcagagatctactgatgaatgcatgccttatttggaaacggaaattagcatccactgattttgtactatttcatagttgcactatataaatagatgttcctggaaaaagaaaacctataggagaaaaaccataaaaatattttgatcaactactgaaaaaaaaaaaaaaaaaaaaaaaaaaa

SEQ ID NO: 10392 - protein, 918 aa, Brachydanio rerio
MIAAQLLAYYFTELKDDQVKKIDKYLYAMRFSDETLRDIMARFRREMENGLARDTNPTATVKMLPTFVRSIPDGSEKGDFIALDLGGSNFRILRVKVSHEKKQTVQMESQIYETPEDIIHGSGSRLFDHVAECLGDFMEKQKIKDKKLPVGFTFSFPCSQSKLDEAVLLTWTKRFKVNGVEGMDVVKLLNKAIKKRGDYEADIMAVVNDTVGTMMTCGFDDQRCEVGIIIGTGTNACYMEELRHMDMVEGDEGRMCINTEWGAFGDDGTLEDIRTEFDREIDRGSLNPGKQLFEKMVSGMYMGELVRLILVKMAKEGLLFEGRITPELLTKGKIETKHVSAIEKSKEGLTKAKEILTRLGVEPSEDDCIAVQHVCAIVSFRSANLIAATLGAILTRLKDNKNTPRLRTTVGIDGSLYKMHPQYARRLHKTVRRLVPESDVRFLLSESGSGKGAALVTAWAYRLADQERQIAETLEEFRLTKDQLLEVKKRMRTEIQNGLSKSTQNTATVKMLPTYVRSTPDGSENGDFLALDLGGTNFRVLLVKIRSGKRRTVEMHNKIYAIPIEVMQGTGEELFDHIVYCISDFLDYMGMKNARLPLGFTFSFPCRQTSLDAGLLVNWTKGFKATDCEGEDVVGLLREGIKRREEFDLDVVAIVNDTVGTMMTCAYEEPTCEVGLIAGTGSNACYMEEMRNIETVSGEEGRMCVNMEWGAFGDNGCLDDIRTKYDDAVDDLSLNAGKQKYEKMCSGMYLGEIVRNILIDLTKRGFLFRGQISETLKTRGIFETKFLSQIESDRLALLQVRSILQHLGLDSTCDDSIIVKEVCGAVSRRAAQLCGAGMAAVVDKIRENRGLDHLDITVGVDGTLYKLHPHFSRIMHQTVKELAPKCNVTFLLSEDGSGKGAALITAVGCRLRQQEQKS

SEQ ID NO: 10393 - DNA, 2577 bp, Pichia angusta
  CDS (691)..(2142)
cactagtttttttttaggatagtagttaattccttgttacggccggcactccagaatgaaaacccgtctgcaataaaattcatgacacctcacactcatttgtatgtagtttttttatcaacaagtattccagggggatcttgacgattgcgcatcggctggactcggttatggataatgaccgggtgctggtgctggataatggcgaggtgcaagagttcgacaacccgcaaaagttgctggaaaatccggactcatacttctaccggctctgcgtggacggcgggcatgtgaagagggattgacatgacatcagatgggcgactttttccgactgtttttgtcgcacctgcatggccacggaaaaacgtgtgcgaattttacgaaaaaagccagtcgctattgtttgctagaaaatttcgatttactttttcagcatgggccggtgcacatctttataaatctggagacttttctattgttgaataatgcagtagtatgaccccggtactaccccagtaaatgcttatagtgatgaaagtggagttaggtggaggtcgctggagaaatgtatgccgaggggtggtgcgttgtcctaaagaatttttccggcccaccagagtagaatataaaaagagctttattctctgttttgaaaaataataccacattattatattttagcctataatgagtatcgacgacaaaccgctgccagcagacctggctaaagagatcgagacctacaaggagctgttctgggtgccaaccgagactctccacaagatcatcgattacttcatcgaggaactcgagagaggtaacgcggacggaacagatcctaccggtatccccatgaaccctgcctgggtgttggaatacccgaacggttctgagaccggcgattaccttgccatcgacttgggaggaacaaaccttcgtgttgtccttgctcacttgcttggagaccacaagttttctaccgaacaaactaagtaccacatcccaagccacatgagaacaaccaagaacagagacgagctgtttgagttcattgctcaatgtctggaagactttcttaagtcgaaacaccctgacggaattccatcggacgctgttttccccttgggattcactttttcgtacccagccacgcaaaacagcatttttgagggtgttctacagagatggaccaaaggttttgatattcctaatgtcgagggccacgacgtggtgcctcttctgatggaacaggtcgagaagaaaggcctgcctatcaagattggtgccctgatcaacgacaccagcggaacccttgttgcatcgagatacacagacgagctcacggagatgggctgtatttttggtactggtgtcaacggagcatactacgaccgcatcaagaacatccctaagctgaagggaaagctttacgacgatatcgacccagagtctccaatgctgatcaactgcgaatacggttctttcgataatgcacacaaggttcttccaagaacgaagttcgacatcagaatcgacgacgagtctccaagaccgggacaacagtctttcgagaaaatgacttccggctactacctaggagaacttctcagaatgattatgctggacacctacaaaaagggactcattttcaagagctacactgagtcttcggagcagatcaagaacctcgaaaccccatacttcctggacacatctttcctgtctatcgctgaggctgacgacaccccttcattgagcgtcgtgtcgaatgagttctccaacaaactcttcatcgacaccactttcgaggagagactgtacgtgagaaagctgtcgcaatttatcggaaccagagcagccagactctcgatttgtggtatctctgccgtgtgcaaaaagatgaactacaaaaagtgccacgttgccgctgacggatccgtcttcctcaagtacccatacttcccagaaagggcagcacagggcctgagcgacgtgttcggctgggatggtatcgacatgaaggaccaccctatccagatcaaacaggccgaggacggatctggtgttggtgccgccatcattgctgcactttcgcatgccagaagagagaaaggtctgtctttgggtctgaaaaaataagcttgggataaagttacggcaagtgtacatatacaataaatttataaagtcttgagtgcatatattttttttccttatcttcggagaacgttctgtctttctcctcccatgttgtccatggcacggtaggtaacagagcgatccagttcccattgaacctgcgtggatggaacgtcgattgcatcaacacaacgaacctgtcgaaccatcctggctttaaaaccttcaagggctccaagaccgacgcggccacaatcgcagacatttttgagggacttgtagagatcgggctggagtacgacgccgtcatcgttggctatgttgctagtgtgccaaatctcgaatgtatcgctgacattctagctaaactgagccacaaaccgctggtggtgctcgatcccatcctcggcgacaacgacaagctgtacgtcgacc

SEQ ID NO: 10394 - protein, 483 aa, Pichia angusta
MSIDDKPLPADLAKEIETYKELFWVPTETLHKIIDYFIEELERGNADGTDPTGIPMNPAWVLEYPNGSETGDYLAIDLGGTNLRVVLAHLLGDHKFSTEQTKYHIPSHMRTTKNRDELFEFIAQCLEDFLKSKHPDGIPSDAVFPLGFTFSYPATQNSIFEGVLQRWTKGFDIPNVEGHDVVPLLMEQVEKKGLPIKIGALINDTSGTLVASRYTDELTEMGCIFGTGVNGAYYDRIKNIPKLKGKLYDDIDPESPMLINCEYGSFDNAHKVLPRTKFDIRIDDESPRPGQQSFEKMTSGYYLGELLRMIMLDTYKKGLIFKSYTESSEQIKNLETPYFLDTSFLSIAEADDTPSLSVVSNEFSNKLFIDTTFEERLYVRKLSQFIGTRAARLSICGISAVCKKMNYKKCHVAADGSVFLKYPYFPERAAQGLSDVFGWDGIDMKDHPIQIKQAEDGSGVGAAIIAALSHARREKGLSLGLKK

SEQ ID NO: 10395 - DNA, 2321 bp, Physcomitrella patens
  CDS (317)..(1858)
gctctctgagcctcacctccctcgctcccttgtcttgctctgcgatctctcgtcaagcttttttttcccccctttctttctttttctcccgtcctctgttgtgcttgcgccagccgatcgcctacacctagcagccgcggttggagtgctgtgtttttagctttttggagtcctcagatctggcagacagtttgatgtagggacgttggtgtaggtttattcagctgatcgattgagagtgcaaaaggcgaagctgtgtgcgtgtgcgtgtgcgtgtttgctcgtgagtgtttgggagtattgctaaagggtagcaatggcgatcgggaaggtactggggtgtgccgggtttcagcacagtgcagtgccaacgctccgtgaaccagtgcggctgagggcgcaatgcagacgccggggaaagaccgtgtctatgtcggttcagaagacgtcgaaaacggtacagcaggcggagaagatgtcgcaggagttccgtcagtcttcctctactcccctgcctcttttgcaccaggtagcggacgctctcgtgcaagaaatgtatgctggattggcgtcggaaggtggtagtgatcagctgaagatgcttccgacctatgtcgaaaacttgccttctgggagcgagaaggggctgttctatgccgtggatttgggcggcacaaacttccgtgttctgcgagtggaattgggaggcaaaacaggccaaattttgagccaagagttcaaggaagtggtaatccctccagagcttatggtgggcactggtaaggatcttttcgacttcattgctggtacactcgcatcatttgtcgacactgaagacgagtcaattaaagctcactttgttcaatcgggaaaaaccagggagtccggtttcgctttctccttccccgttcgacagacctcagtcaaatctggcattgtcatccactggacgaagggcttcaaagttgatgatgcggtgggcaaagacatcgtgaagcaatttcaggatgcaatcagcagaagtaaccatcagattatgatctcagccctggtaaacgacaccgttggcacgttggccggaggcagattcaacttcgacgaggagaccatgattggttgcattattggaacagggacaaacgcatgctatgtcgaacgtgccgatgctgtacataagtgggacgagccactgcccaaatcaggagaaatggttatcaatatggaatggggaaatttccgttcaccctacctgccacgaacatttgctgatgagactgttgacaaagacagcgtcaatccaggggaccagtggttcgagaaaatgatctctggaatgtacctcggcgagatcgtgcgccttgttctggctaggatggccaaagaagcggaactgtttggtggcaatgtccccgtgaagctcttggagcggctcaccctaggcaccccacatgtttccaaaatacatctggacaattcacctgacctcgacgtggttgccaaagttctcaaggacgtcttcgagatcgaaaccaccacacttgaggaaagaaagatagtacacgaggtgtgtgacatcatgggcgagcgaggtggaaggttggctgcagcaggtctctacggaatcctgaagaagatcggaagaaccggcaaatctcgaaacggatccaagaagaagaccgtgattgcaatggacggtggcctgttcgaacaccacgtccgttaccggtcatacatggaggaggcgctccaggagttgatgggttctgacgcagcgtacgaggtggcgttgagactacagaacgatggttctggaatcggtgccgctttgcttgccgcttcccactcacacttcaaataggataaaacgcacacaaagcttagggggatcatggcaggtgatgagcatcgcctgttttgcatgcctgtacaatattccgagtcctgatgatctgtctatcttctgagatgcacccatcgtctgtaccatttgtaccggcttatcgtaccgcaggaagacgccgttcttcaagtcgttgtctatctggtgaccaaaaccgcagagtttcaagctgagaggcctagtaggggtagtgtaggcagagtcaagttttattgtctctggtcagttacgtagaacagtttgcggttgagtctacccatctcatctagatctgcactgcacacctttcaataagctggtttcacttgaggttgccgtgcgcaagctagtatctggcacagagatgagaggttcattgctgcgcattctcttagcaatcctcacaatttccgaggtgattgtggggtgatggagctgggcg

SEQ ID NO: 10396 - protein, 513 aa, Physcomitrella patens
MAIGKVLGCAGFQHSAVPTLREPVRLRAQCRRRGKTVSMSVQKTSKTVQQAEKMSQEFRQSSSTPLPLLHQVADALVQEMYAGLASEGGSDQLKMLPTYVENLPSGSEKGLFYAVDLGGTNFRVLRVELGGKTGQILSQEFKEVVIPPELMVGTGKDLFDFIAGTLASFVDTEDESIKAHFVQSGKTRESGFAFSFPVRQTSVKSGIVIHWTKGFKVDDAVGKDIVKQFQDAISRSNHQIMISALVNDTVGTLAGGRFNFDEETMIGCIIGTGTNACYVERADAVHKWDEPLPKSGEMVINMEWGNFRSPYLPRTFADETVDKDSVNPGDQWFEKMISGMYLGEIVRLVLARMAKEAELFGGNVPVKLLERLTLGTPHVSKIHLDNSPDLDVVAKVLKDVFEIETTTLEERKIVHEVCDIMGERGGRLAAAGLYGILKKIGRTGKSRNGSKKKTVIAMDGGLFEHHVRYRSYMEEALQELMGSDAAYEVALRLQNDGSGIGAALLAASHSHFK

SEQ ID NO: 10397 - DNA, 1314 bp, Treponema denticola
  CDS (1)..(1314)
atgaaagagatcgacgatttttttaagagaaataattttgattataaaattgatatcgaatatgcagcttcaatccttttggaagatatgaaaaaaggattggaaagcgaagctgagtctgtttcttctatggatatgattcccttatggaaaaatcttcccaccgatatccctaaggataaaaaggtaataatcatcgatgccggaggtactaattttagggcaggcattgtctattttgacaaaaaaggagtgcctgaaattctttctttttttaagcatccgatgcctgctcttgacagggaaatgactaatgaagagttctttgacagcattgccgaatacttagaacctttaaaagatgagtctgatatgatttctttttgcttttcctatgccataaagatttttcctgacggcggcgggcaggctattaagctttcaaaagaaataaaactgccctatatcggcgattgcaaaataaatgagggactttttcaagccttatctcgtaagggttggaaaaaaataaaaaaaattataatggtgaacgataccgctgcagttctccagtcaggaattttttctgaaaccgacgatcagggctttgactctcacataggctttgttctaggaacgggcctaaattctgcatatatcgaatacggaaaaattgaaaaactcaaaactaccgaattttacgataaacctcagataatcgtatgcgagtctggaaagagcaataagattcctcaaagtaaattcgataaaatcttatccgaaaattccaatttaaaaaacgagtattttttagaaagaatgtgttcaggacgctatcttggagagctttgttcaatcgctttaagggcgggttctgccgaaggaattttttcaccgagggtcaacaagatgcttttaaattcctgtgatttttcaactgaagagatttctttatttttaaaggaacaaaatcacgataaaaatattttttccggtataatcgaagctcattcggtttcggaagactatgttaaaatctattccatatgtaaatgtttttttgagagagccggaaggctttcagctgccgtaattgctgccgcttgtataaaaaccggtaagggtaaatcgccggataagcccatctgtataagtgccgacggctcgatgtttttaaaaggttttttgattaaagaaagaatctttaagagtttacacacctgtttaaccgaaaaaagaggaatttactttgtccttaaaacaaatgatgaagctgtaaccttgggtacggctcttgcagcctttttaaattaa

SEQ ID NO: 10398 - protein, 437 aa, Treponema denticola
MKEIDDFFKRNNFDYKIDIEYAASILLEDMKKGLESEAESVSSMDMIPLWKNLPTDIPKDKKVIIIDAGGTNFRAGIVYFDKKGVPEILSFFKHPMPALDREMTNEEFFDSIAEYLEPLKDESDMISFCFSYAIKIFPDGGGQAIKLSKEIKLPYIGDCKINEGLFQALSRKGWKKIKKIIMVNDTAAVLQSGIFSETDDQGFDSHIGFVLGTGLNSAYIEYGKIEKLKTTEFYDKPQIIVCESGKSNKIPQSKFDKILSENSNLKNEYFLERMCSGRYLGELCSIALRAGSAEGIFSPRVNKMLLNSCDFSTEEISLFLKEQNHDKNIFSGIIEAHSVSEDYVKIYSICKCFFERAGRLSAAVIAAACIKTGKGKSPDKPICISADGSMFLKGFLIKERIFKSLHTCLTEKRGIYFVLKTNDEAVTLGTALAAFLN

SEQ ID NO: 10399 - DNA, 1467 bp, Ashbya gossypii
  CDS (1)..(1467)
atggttcacttaggtccaaagaagcctcctacgagaaaggggtccatggcggacgtgccaaagacgttggtggagcaaattgccagtttcgagcgcatcttcaccgtctcggctgagaagctacaggaaattacaaagcactttgtcaccgagttggacaagggtctgtccaagaaagggggcaacatcccaatgattcccgggtgggtgatggactaccctaccggtaacgagaccggtgactacttggccattgacttggggggaacgaacttgagagttgttctagtcaagttgcttggcaaccaccagttcgacaccacgcagtccaagtacagattgcctaaccgcatgagaaccacccagaatgcgagcgagttgtgggacttcattgccgagagtctaaaggacttcttggaggagcagttcccagaaggcgttcaccagacgctacctttgggctttaccttctcttaccctgcatcccaggacaagatcaacatgggtatcttgcagagatggaccaagggctttgacatcccaggcgttgagggccacgacgtggtcccaatgttgcaggagtcgttgaggaaggtgaatgttccaattgaggttgttgctttgattaacgacaccaccggtaccttggttgcctccttgtacaccgacgcggagactaagatgggtgtgattttcggcaccggtgtcaatggtgcttactacgatgttgtcaaggacattgagaagttggagggccgcttgccagaagacatcccaccggagtctgccatggccatcaactgtgagtacggctctttcgacaatgaacatttggttcttccaagaaccaagtacgacattctaatcgatgagcagtctccaagacctggccagcaggctttcgagaaaatgacctctggttactacttgggtgaggtgcttcgtttggctctcttggacctacacggccagggcttgatcttccaaggccaagatatctctaagttggagaccccatacgtgatggacacttctttccctgctagaattgaggatgatccatttgagaacttggaggaaaccgatgacttgttcaaggacaacttggacattgacactacccgtccagagcgtaaattgatcagaaagttgtccgagatgattggtaacagagctgcaagactatctgtgtgtggtatcgctgcaatttgccagaagagaggctacgaaaccgcacacattgctgcagatggctctgtcttcaacaagtacccaggtttccaaactagagctgccgagggcttgagagacatctacggctgggagcactcttcttcccaggattacccaatcaagattgtcgctgctgaggatggttctggcgctggtgccgcggtcattgcagctttgaccacgaagagattggcagcaggcaaatctgtcggcttgcctgaggcgcaaaattaa

SEQ ID NO: 10400 - protein, 488 aa, Ashbya gossypii
MVHLGPKKPPTRKGSMADVPKTLVEQIASFERIFTVSAEKLQEITKHFVTELDKGLSKKGGNIPMIPGWVMDYPTGNETGDYLAIDLGGTNLRVVLVKLLGNHQFDTTQSKYRLPNRMRTTQNASELWDFIAESLKDFLEEQFPEGVHQTLPLGFTFSYPASQDKINMGILQRWTKGFDIPGVEGHDVVPMLQESLRKVNVPIEVVALINDTTGTLVASLYTDAETKMGVIFGTGVNGAYYDVVKDIEKLEGRLPEDIPPESAMAINCEYGSFDNEHLVLPRTKYDILIDEQSPRPGQQAFEKMTSGYYLGEVLRLALLDLHGQGLIFQGQDISKLETPYVMDTSFPARIEDDPFENLEETDDLFKDNLDIDTTRPERKLIRKLSEMIGNRAARLSVCGIAAICQKRGYETAHIAADGSVFNKYPGFQTRAAEGLRDIYGWEHSSSQDYPIKIVAAEDGSGAGAAVIAALTTKRLAAGKSVGLPEAQN

SEQ ID NO: 10401 - DNA, 1482 bp, Ashbya gossypii
  CDS (1)..(1482)
atgtctttcgaagatttgcacaaggcgcaacgcgggaaagtcgaggagccagtggacgaaatatgtaaggatttcgaggtgacggaggacaaactccgcgagttgaccgcgtacttcatcgaatgtatggaacagggtctcaagaacggagagacggacgggacgtaccgtgggcttccgatgatcccgtcgtacgtgatgggcaggcccaatggcactgaggagggcacgttcttggcggcggaccttggcggcacgaatttccgggtgtgctcggtgcgtctcaacggtgatcacacgttcaagctggagcagttgaagtcgaagatccccgaggagctccttgacgacgacgtaacatcagacgagttgttcggcttcatcgcgaagcgcacaatggcgtttgtcaagcgctaccactctgaagtgctccagagcgagggcggccaactgaagctcgggtttacgttctcgtatcccgtggcgcagacatcgctatcgagcggcactttgatccgctggacgaagggcttcaacatcaaggatgcgatcggcaaggacgtggtcaagatgtaccaggagcagttggacgcggtcgggttgggcagcgtgcgcgttgtcgcgctggcaaacgataccgtcggcacgttcctctcgcactgctacaattcgcgcaactcggcgtcactcacaacaggcgagatcacagagcccgtcatcgggtgcatcttcggaacgggcacgaatggctgctacatggagaagctcgagaacatcgagaagttgccgcaggagctccgtcagaagcttaccgcgcagggcaagaccgagatgtgcatcaacatcgagtggggctcgtttgacaacgagctcaagcacttgcccacgaccaagtacgacttgctcatcgatcagaagtttacccacaaccccggctttcacctgttcgagaagcgcgtgtcgggcatgttcttgggcgaggtcctccgtaacgtgcttgtcgacctccactcccagggcctcattctgcgccaatacccccagggccagctaccccaccgcttgttgaagcccttcaacctctcctccgagattctctcgcacattgagatcgacgactcctccgatcttcgcgagaccgagctctcgctcttgcaggctctccgcctccccaccaccgccgacgagcgccgccagatccagcgcctcgtgcgcgccatctcgcgccgctctgcctaccttgcctccgtccccattgccgccgtcatcatcaaaacgggcgcgttggaaaagcgctaccacggagaggtcgagattggctgtgatggcagcgtcttcgagttctaccccggattccgttccatgatgcgtcatggcttggcgctgtcccctctaggcccggatggcgaacgtaaagtccatctacatgtagcaaaggacggctcaggcgtcggcgcggcgctatgcgcacttgtcgcctag

SEQ ID NO: 10402 - protein, 493 aa, Ashbya gossypii
MSFEDLHKAQRGKVEEPVDEICKDFEVTEDKLRELTAYFIECMEQGLKNGETDGTYRGLPMIPSYVMGRPNGTEEGTFLAADLGGTNFRVCSVRLNGDHTFKLEQLKSKIPEELLDDDVTSDELFGFIAKRTMAFVKRYHSEVLQSEGGQLKLGFTFSYPVAQTSLSSGTLIRWTKGFNIKDAIGKDVVKMYQEQLDAVGLGSVRVVALANDTVGTFLSHCYNSRNSASLTTGEITEPVIGCIFGTGTNGCYMEKLENIEKLPQELRQKLTAQGKTEMCINIEWGSFDNELKHLPTTKYDLLIDQKFTHNPGFHLFEKRVSGMFLGEVLRNVLVDLHSQGLILRQYPQGQLPHRLLKPFNLSSEILSHIEIDDSSDLRETELSLLQALRLPTTADERRQIQRLVRAISRRSAYLASVPIAAVIIKTGALEKRYHGEVEIGCDGSVFEFYPGFRSMMRHGLALSPLGPDGERKVHLHVAKDGSGVGAALCALVA

SEQ ID NO: 10403 - DNA, 1853 bp, Nicotiana tabacum
  CDS (82)..(1575)
ttttttgtattttttttcatttgtttcggtggacaacttttagccaacctccaattcctccgccgtgacaaaaaagaaaggatgaagaaagcgacggtgggagccgccgtggttggcgccgctacggtatgtgctgtggcggcattcatagtgaaccaccgtatgcgcaaatctagtaaatgggcacgtgctatggctattcttcgtgaatttgaggaaaagtgtgggacccctgatgctaagctcaagcaagtcgctgatgctatgaccgtcgagatgcacgctggacttgcctccgaaggtggtagcaagctcaagatgcttatcacttacgtcgataatctccccaccggtgatgaagccggcgtcttttatgcgttggatcttggtggaacaaattttcgagtattgcgagtgcaacttggtggaaaagatggtggtattgttcatcaagaatttgcggaggcatcaattcctccaaatttgatggtcgggacttcagaagcactttttgattatattgcggcagaacttgcaaaatttgtcgctgaggaagaggaaaagtttcaacaacctcctggtaagcagagagaactaggtttcaccttctcattcccggtaatgcagacttcaatcaactctgggactattatgaggtggacaaagggcttctccattgatgatgcggttggccaagatgttgttggagaactcacaaaagctatgaaaagaaaaggagttgatatgcgggtctcagctctggtgaatgatactgttgggacgttggctggtggtaaatatacacacaacgacgtagctgttgctgttatcttaggtacagggaccaatgcagcttatgtggaacgggtgcaggcgattccaaagtggcatggtccagtgccaaaatctggtgaaatggttatcaacatggaatggggtaattttaggtcatcccatcttcccttgacacagtatgatcacgcgttggatactaatagtttgaatcctggtgatcagatatttgagaagatgacttctggcatgtacttgggagaaattttacgcagagttctactcagggtggctgaagatgctggcatttttggtgatgaggtccctccaaagctcaagagtccatttgtattgaggacacctgatatgtctgctatgcatcatgacatatcctctgatctgagagtggttggtgacaagctgaaggatattctagagatatctaatacctccttgaagacaaggagattagtcgttgagctgtgcaacatcgttgcaacacgaggggcaaggcttgcagctgcaggtatattgggtatcttaaagaagatgggaagggatacacctaggcaaggtggtccagaaaagacggttgtagccatggatggcggattgtatgagcactatacagagtacagaacgtgcttagagaacacattgaaggaattgcttggagatgaattggcgacaagcattgttttcgagcactccaatgatggttctggcattggtgctgctcttcttgctgcctctaactcaatgtaccttgaagataagtcctaggagtgatcaaatccctttcttgctagaggaaaccaccttttactctttatattttgctctcgagcatttttcttcaatttttctccggattataccatcaagcatatttaataaattttcccagtacctttttatctctaggaattttttcctagaaatgcctacacatctagcatacctttttaagtcgctttcagcactgttggttctctctttaatctctttttcatttacttttgaaatcaaattcaaaggcaataaattgggggaatttccgc

SEQ ID NO: 10404 - protein, 497 aa, Nicotiana tabacum
MKKATVGAAVVGAATVCAVAAFIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVAEEEEKFQQPPGKQRELGFTFSFPVMQTSINSGTIMRWTKGFSIDDAVGQDVVGELTKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEDAGIFGDEVPPKLKSPFVLRTPDMSAMHHDISSDLRVVGDKLKDILEISNTSLKTRRLVVELCNIVATRGARLAAAGILGILKKMGRDTPRQGGPEKTVVAMDGGLYEHYTEYRTCLENTLKELLGDELATSIVFEHSNDGSGIGAALLAASNSMYLEDKS

SEQ ID NO: 10405 - DNA, 1894 bp, Nicotiana tabacum
  CDS (317)..(1816)
gtgaattgctacattattacggcaactatgaatatgaaagtaaggaacagtcggtagttagctaaccataccttccaacgcaacaataacggcgtacaacagtagtatagtaatattcatcgtttaaatccttacatatatttcatcattaatttattcaaatctaactgttcgcttaccatcattacgatataaaaaagaaaatttatatagtgttaaagattcacaactgtataaactctctgtttcagcatcaccatttattgtctcttctttttttctccgtcacacgttccttttgatctcactgttaattatgtcggtcaccgttagctcgccggccggccgatccttccatatttcacgatcaccttacaaaaagatctccaagccacgtgtcattatcgctgccgtccgatctggtgttagtttagcggtagcaccaatattgactaagttgcagaaagactgtgcaactccacttcctgttttgcgccacgtggctgatgccatggccgttgatatgcgggctggacttgccgtcgatggtggcagtgatctgaagatgatccttagttatattgacactttaccaactgggaatgagaaaggtttgttctatgcattggaccttggtggtacaaatttccgagtgttaagagtgcagttaggtggtaaagaagagcgcgtaatcgccactgagtttgagcaagtctctatacctcaagaattgatgtttgcaacctctgaggagttgttcgatttcatagcttctgagctaggaaaattttcacaaagtgaaggcggtaagtttgagatgcaacaaggaaggactagagaaataggattcacattttctttcccagtgaagcagacttcagttaaatctggcatcctaatcaagtggacaaagggttttgcagtctctggaactgcaggaaaagatgtggttgcttgtttaaatgaagccatggaaaggcagggattgggaatgcaagtctcggccctggtcaatgacactgtagcaacacttgctggagcgagatactgggacaatgatgtcatggttgctgtcattcttgggactggaaccaatgcttgctacgtagaacgtgtggatgctattcctaaactgccacaaaggatgtccaactctccagaaacaattgtgaatactgaatggggagcattttcaaatggccttcctttaactgagtttgatagagaaatggatgccgagagcattaaccctggtgagcagatttttgagaaaacaatctctggtatgtaccttggagaaattgtaagacgggtgctggtcaaaatggccaaggttggcggcttatttggcggtggctatgttccagaaaagttagtcactccatttgtgctgaggacaccggatatatgtgcaatgcagcaggatacatccagagatcttgaagctgttgagtctgtcctctatgatatagctggggtaaaatctgatctaagtgcaaggaaaacagtcgtagacatttgcgatactattgcaaatcgaggggggcgtctagctggtgcaggaattgttgggattctccagaaaatggaagaggattcaaaaggcgtaatcttcggtaagagaacagttgtagcaatggatggaggtttatatgagcactatcctcagtacagagaatacctccaagaagctgtcacagaacttcttggatcagaaatttctaaaaatgtagtgatagagcattcaaaagatggatctggaattggagctgcattattagctgctgcaaactcaaagtatgaacatgattattaggaaaatggtaattttcatgtctaaaaatgctggtagagcatttgtaattttgtttttgcaatttagaatgtattaaga

SEQ ID NO: 10406 - protein, 499 aa, Nicotiana tabacum
MSVTVSSPAGRSFHISRSPYKKISKPRVIIAAVRSGVSLAVAPILTKLQKDCATPLPVLRHVADAMAVDMRAGLAVDGGSDLKMILSYIDTLPTGNEKGLFYALDLGGTNFRVLRVQLGGKEERVIATEFEQVSIPQELMFATSEELFDFIASELGKFSQSEGGKFEMQQGRTREIGFTFSFPVKQTSVKSGILIKWTKGFAVSGTAGKDVVACLNEAMERQGLGMQVSALVNDTVATLAGARYWDNDVMVAVILGTGTNACYVERVDAIPKLPQRMSNSPETIVNTEWGAFSNGLPLTEFDREMDAESINPGEQIFEKTISGMYLGEIVRRVLVKMAKVGGLFGGGYVPEKLVTPFVLRTPDICAMQQDTSRDLEAVESVLYDIAGVKSDLSARKTVVDICDTIANRGGRLAGAGIVGILQKMEEDSKGVIFGKRTVVAMDGGLYEHYPQYREYLQEAVTELLGSEISKNVVIEHSKDGSGIGAALLAAANSKYEHDY

SEQ ID NO: 10407 - DNA, 1849 bp, Nicotiana tabacum
  CDS (44)..(1537)
gctaattacccttctccatcatttttctttagtattaagagatatgaagaaggcgacggtgggagcggtggtggtgggggcggcggtgacggtagctgtgggggcactcatcgtccggcaccgaatgcggaaatcgagcaagtgggcacgtgcgagggcaattctgaaagaattcgaggagaagtgtgggaccccagatgccaagctaaagcaagtggcggatgccatgacggtggagatgcacgccggcctcgcctctgagggcggcagcaaactcaagatgcttatcagctatgtcgacaatctcccaactggcgatgaagaaggagtcttttatgcattggatcttggtggaacaaattttcgagtattgcgggtgcaattggggggaaaagatggtggtattgtccatcaagaatttacggaggcatcaattcctccaaatttgatggttgggacttcagaagcactttttgactatattgcggcagaacttgcaaaatttgttgctgaagaagaagaaaaatttcatcaacctcctggtaagcagagggaactcggtttcactttctcattcccaatcatgcagacttcaatcaattctggaactcttatcaggtggacgaaaggtttctccattgatgacacggttggacaagatgttgttgcagaactgacaaaagccatgcaaagaaaaggagttgatatgagggtgtcggcgctggtgaatgatactgttggaacattggctggtggtagattctccaataaggatgtatccattgctgtgatattaggtactgggaccaatgcagcatatgtggaacgggctcaggcaattcccaaatggcatggtcctctgcctaaatctggagaaatggttatcaacatggaatggggtaactttaggtcctcccatctccccttgacagagtacgaccatgcaatggatacagatagtttaaatcctggtgaacagatatttgagaagatatgctctggcatgtacttgggagaaattttacgcagagttctactcagaatgtctgaagaagctgccattttcggtgatgaggtccccccaaaactcaagaatcaattcatattgaggacacctgaaatgtctgctatgcatcatgacacatcctctgatttgagagtggttggcgacaagttgaaggatatcttagagatatccaatacctccttgaagacaagaagattagttgttgagctgtgcaacattgttgcaacacgtggcgcaaggcttgcagcggctggggtcttgggcattgtcaaaaagatgggcagggatacacccagggaaagtggtcaagaaaagatagtcgtagccatggatggtggattgtacgagcactatacagaatacagaaagtgcttggagaacactttagttgaattgcttggagaggaaatggcaacaagtattgttttcgagcacgcaaatgatggttctggcattggcgctgcacttcttgcggcctctaactccctatatgttgaagacaagtcttgagagcgatcaagatgatatttagctagaggaaactctctcaaccttttatatagtgcttttctctagccttttcttttgatttctctcctttttggttcttctaccaattatattcataattttgcagcacttgtgcttggtttatagtttaggatatttttcctgggaatgcctacttatttcttctggaaaagggtgcaagcaaattgtataacactcagcactgctgattcttccccttggtcttttgttttcaatctgcgatcaaattttagggtttaataaaatggggtgttaagtttttgttaaagc

SEQ ID NO: 10408 - protein, 497 aa, Nicotiana tabacum
MKKATVGAVVVGAAVTVAVGALIVRHRMRKSSKWARARAILKEFEEKCGTPDAKLKQVADAMTVEMHAGLASEGGSKLKMLISYVDNLPTGDEEGVFYALDLGGTNFRVLRVQLGGKDGGIVHQEFTEASIPPNLMVGTSEALFDYIAAELAKFVAEEEEKFHQPPGKQRELGFTFSFPIMQTSINSGTLIRWTKGFSIDDTVGQDVVAELTKAMQRKGVDMRVSALVNDTVGTLAGGRFSNKDVSIAVILGTGTNAAYVERAQAIPKWHGPLPKSGEMVINMEWGNFRSSHLPLTEYDHAMDTDSLNPGEQIFEKICSGMYLGEILRRVLLRMSEEAAIFGDEVPPKLKNQFILRTPEMSAMHHDTSSDLRVVGDKLKDILEISNTSLKTRRLVVELCNIVATRGARLAAAGVLGIVKKMGRDTPRESGQEKIVVAMDGGLYEHYTEYRKCLENTLVELLGEEMATSIVFEHANDGSGIGAALLAASNSLYVEDKS

SEQ ID NO: 10409 - DNA, 1568 bp, Nicotiana tabacum
  CDS (38)..(1534)
agaacaattgtgtgttgttgtgttacaagtgaaaaatatgggaaaagtggtggtgggtgcagcagtagtatgtacagctgcagtatgtgctgctgctgttttattaatgaggcacaaaatggaaaattcaggtaaatgggctaaagctatggatatattgaaagagtttgaggagaagtgtgaaactccaataggaaaacttaggcaagtggctgatgctatgactgtagagatgcatgctggacttgcttctgaaggtggtagcaaactcaagatgctcattagctatgttgataacctccccactggggacgaaaccggtctgttttatgcattagatctaggcggcacaaacttccgtgtgatgcgtgtgcagttgggcgggaaagaaaagcgtatagttaaacaagaagttaaagaagtttcaattccaaagaatgtgatggctggatcgtcatctgacgcgttatttgattttattgccacgacgcttgtaaaatttgttgctacagaaggcgacgattttcatcttccacccggtagacaaagggagttgggcttcaccttctctttcccagttaaacaactgtcaattgcatcaggaactcttattaaatggacaaagggcttctctatagatgatgcggttggccaagatgttgttagagagttaacaaaagcaatggaaagggtcggtcttgacgtgcgcgtggctgctttgatcaatgatactgttggaacattagcaggaggtcggtataacaaccctgatgtcattgctgcagtaatattgggtactggaaccaatgcagcatatgttgagcgggcaaatacgattcccaaatggcatggtctgctgcctaaatcaggagatatggttattaacatggaatggggtaatttccgctcatcacatcttccggtaacagaatacgaccaaagtcttgacgctgagagtttaaacccaggggagcagatttatgagaagatgatttccgggatgtatcttggagaaattttgcgcagagtcttgtgtagaatggctgaagaagcttcattttttgatgattatgtcccaccaaaactgaaaactccattcattttaaggactcaggacatgtctgctatgcatcacgacaagtctgctgatctcaaggtggttggcgacaagctgaaggatatcttagaggtacctaattctacctggaaaatgaggaaaataattgttgagctatgtgacattattacctctcgtggagctcgtctttctgcagcaggaatcgtgggtatcctcaagaaattgggaagagacactttgaaggatggagagaagcagaggtcagtaatagctgttgacggtgcattgtttgagcattacacaaagttcagaaattgcatggagggaactattaaagagttgttgggagacgccgcagaaaacatagtcgttaagctttcgtatgatggttctggtgttggagctgcactattggctgcttctcattcccagtacctcggactcaaggaatcttgatcatggtcagagtgatagaaaaagcctgagatgg

SEQ ID NO: 10410 - protein, 498 aa, Nicotiana tabacum
MGKVVVGAAVVCTAAVCAAAVLLMRHKMENSGKWAKAMDILKEFEEKCETPIGKLRQVADAMTVEMHAGLASEGGSKLKMLISYVDNLPTGDETGLFYALDLGGTNFRVMRVQLGGKEKRIVKQEVKEVSIPKNVMAGSSSDALFDFIATTLVKFVATEGDDFHLPPGRQRELGFTFSFPVKQLSIASGTLIKWTKGFSIDDAVGQDVVRELTKAMERVGLDVRVAALINDTVGTLAGGRYNNPDVIAAVILGTGTNAAYVERANTIPKWHGLLPKSGDMVINMEWGNFRSSHLPVTEYDQSLDAESLNPGEQIYEKMISGMYLGEILRRVLCRMAEEASFFDDYVPPKLKTPFILRTQDMSAMHHDKSADLKVVGDKLKDILEVPNSTWKMRKIIVELCDIITSRGARLSAAGIVGILKKLGRDTLKDGEKQRSVIAVDGALFEHYTKFRNCMEGTIKELLGDAAENIVVKLSYDGSGVGAALLAASHSQYLGLKES

SEQ ID NO: 10411 - DNA, 1964 bp, Nicotiana tabacum
  CDS (101)..(1600)
tctttaacaaaccccatttaaaatcaaccaaaaaagtttcaatctttacggtatattcactcaaatatacacaaaaagtttgattttttttcaagaaaatatgggaaaattggttgtaggtgtatcagttgtgtgtactgctgctgtagtatgtggggtggcagttttgttaatgaagcgcaggatgaagaattctggggagtggggaaaagttgaagctttattgaaggattttgaggagaagtgtgcaactccaatggggaaacttaagcaggtagctgatgctatgactgtagagatgcatgctggacttgcttctgaaggtgggagtaagctcaagatgcttattagctatgttgataaccttcctactggggacgaagaaggtctgttttatgcattggatctaggcggcacaaactttcgtgtgatgcgtgtgcagttgggtgggaacgaaaagcgtatagttaaacatgaagttaaagaagtttcaattccacagaatgtgatggctggatcatcatctgaagtgttatttgattttattgccacggcacttgcagaatttgtagctacagaaggtgatgattttcatcttccacctggtagacaaagggaattaggctttaccttctctttccctgtgaaacaattgtcaattgcatcaggaactcttattaaatggacaaagggcttctccatagaagacgtggttggccaagatgtggtgggagaattagcaaaagcaatggaaagggccggccttgatgtgcgtgtgactgctttagtcaatgatactgttggaacgttagcagggggtcggtacaatgatcctgatgtcattgctgcagtaattttgggtactggaaccaatgcagcatatgttgaacgggctcatgcgattcccaaatggcatggtctgttgccgaaatccggagagatggttatcaacatggaatggggtaatttcctctcatcacatcttccagtaacagaatatgaccaaaatcttgatgttgagagtttaaaccccggggagcagatttatgaaaagatgatctccgggatgtatcttggagaaattttgcgtagagtattgtgtagaatggctaaagaagcttcattattcggtgattatgtcccatccaaactgaaaattcctttcatattgaggactccggatatggctgctatgcatcacgacgagtcggctgatctcaaggtggttggcaataaactgaaggatatcttagaggtacctaattctaccttgaaaatgaggaaaatagttgtggagctatgcgacatcatcacctctcgtggagctcgtctttctgcagcaggaatcgtgggcatcctcaagaaattgggaaaagacactttgaaggacggagagaaccagaggtctgtcatagctgtggacggtgcattgtttgagcgttacaccaagttcagaaattgcttggaggaaactatgaaagagttactgggagacactgcggacagcatagttattgagctttctaatgatggttcaggtgttggagctgcacttttggctgcctcgccttcccaatacacagatctcgaggaatcatgatcatggtcagagtgacacaaccaaaagtgcctagccaaagtttgtacgtttacaatcacccctcttcttgctaaagagaaccctcttcttactttcttctccgagatgattgaaatattccttgcttccttgtgcaccgcatcatgtaagagtgagctttgaagtgagccatagttcaatgtatcaaatgagcacatctctcttcagctaaacatcaatatgctgaccttttcactcctggtgcctctaaggatcatctttatcccaagtgtaagcttaaattttttcctcactagtcagaaataaagctaggatacaaataaagttcttctagtagcaaaaaaaaaaaaaaaaaaaaaaaaaa

SEQ ID NO: 10412 - protein, 499 aa, Nicotiana tabacum
MGKLVVGVSVVCTAAVVCGVAVLLMKRRMKNSGEWGKVEALLKDFEEKCATPMGKLKQVADAMTVEMHAGLASEGGSKLKMLISYVDNLPTGDEEGLFYALDLGGTNFRVMRVQLGGNEKRIVKHEVKEVSIPQNVMAGSSSEVLFDFIATALAEFVATEGDDFHLPPGRQRELGFTFSFPVKQLSIASGTLIKWTKGFSIEDVVGQDVVGELAKAMERAGLDVRVTALVNDTVGTLAGGRYNDPDVIAAVILGTGTNAAYVERAHAIPKWHGLLPKSGEMVINMEWGNFLSSHLPVTEYDQNLDVESLNPGEQIYEKMISGMYLGEILRRVLCRMAKEASLFGDYVPSKLKIPFILRTPDMAAMHHDESADLKVVGNKLKDILEVPNSTLKMRKIVVELCDIITSRGARLSAAGIVGILKKLGKDTLKDGENQRSVIAVDGALFERYTKFRNCLEETMKELLGDTADSIVIELSNDGSGVGAALLAASPSQYTDLEES

SEQ ID NO: 10413 - DNA, 1797 bp, Nicotiana tabacum
  CDS (33)..(1565)
cctcaaataaaaagaaaaataaacggtgtcgtatggggaggttagcggtggggatatcggcggggtttgcggtggcggcgtgtattgtggcggcagctatggtgggtaagagggtaaaaaggaggaggaagtggaagaagatggtgaaggttctagaagaactggaagagtcgtgtggtacacccgtgggtaggctaaagcaagtagtggatgctatggctgttgaaatgcacgctggacttgcctctgaaggcgggagtaaactcaagatgttgcttacttatgttgataagctcccaaatgggagggaaaagggaacatattatgctctgcaccttggtggtacgaattttagagtcttgagagtccacttaggaggccaaaggtctgctattcttggacaagatatagaacgacaacccattccgcaacatctaatgactagcacaagcgaggatctccttgatttcgttgcgtcatcattaaaggacttcattgaaaaggaaggtaatggcttggagcagccttcacccaggaggagagaacttggctttacattttcatttcctgtgaagcaaacttccgcctcatctggcattttgatcaaatggacaaagggattttcgattgaagacatgattggaagagatgtttctgaatgtctacaacaagcaattgctagaaaaggtcaagatgtgcgggtggcagcattgataaatgacactgtgggaactctagctcttggacattataatgatgaagacacagttgccgcggttgtaattgggaccggcactaacgcatgctatttggagcgggcagatgcaattattaagtgccaaggtcttttaacaacatcaggaggcatggtagtcaatatggaatggggaaacttttggtcatctcatttacctagaacctcatatgatattgacttggatgttgctagcccaaacccaaatgatcagggttttgagaaaatgatatcaggactgtatttgggagacattgtcaggagagtactccttagaatgtcacaggaatcagatgattttggacctgcatcatcaaaattagcagttcctttcgccttgaggacaccgttgatggctgctatgcacgaggatgattcacctgacttaagtgaagtagccaggattctgggagaagttctagagttacctgatgtcccagtgaaagttcggaagcttgtagtgaaggtatgtgatgtaattactcgaagggctgctagattagcagctgctggtatcgtgggaatattgaagaagataggtcgagatggaagtggaggcatagctggtggaaaattcaggagcgatagaccaagtcggatgagaagaacggttgtggctatcgagggtggtttatacacaagttacaccttattcagagaatacctgaatgaagcgatgaaggaaattttaggggaagaaatttcctcgaacgtcattcttagggtcatggaagatggatcagggattggagcagctcttcttgctgctgcaaattcagcctctgaagtggatagggtacagctgcactgaatataaagcaaatactactatatatacacatctatacacagctttgtaaattgtagcaaaattgtttcatatattcaaatcctatcacaatgtaataggaaggttgtgtatatgtgtcatatactgttcaaatctgatgttatagtctagaatatccccacttgtgttcttagtaatgatcattgcaacccttgtatgtgaaattaatgctattgatgatttcagtatttag

SEQ ID NO: 10414 - protein, 510 aa, Nicotiana tabacum
MGRLAVGISAGFAVAACIVAAAMVGKRVKRRRKWKKMVKVLEELEESCGTPVGRLKQVVDAMAVEMHAGLASEGGSKLKMLLTYVDKLPNGREKGTYYALHLGGTNFRVLRVHLGGQRSAILGQDIERQPIPQHLMTSTSEDLLDFVASSLKDFIEKEGNGLEQPSPRRRELGFTFSFPVKQTSASSGILIKWTKGFSIEDMIGRDVSECLQQAIARKGQDVRVAALINDTVGTLALGHYNDEDTVAAVVIGTGTNACYLERADAIIKCQGLLTTSGGMVVNMEWGNFWSSHLPRTSYDIDLDVASPNPNDQGFEKMISGLYLGDIVRRVLLRMSQESDDFGPASSKLAVPFALRTPLMAAMHEDDSPDLSEVARILGEVLELPDVPVKVRKLVVKVCDVITRRAARLAAAGIVGILKKIGRDGSGGIAGGKFRSDRPSRMRRTVVAIEGGLYTSYTLFREYLNEAMKEILGEEISSNVILRVMEDGSGIGAALLAAANSASEVDRVQLH

SEQ ID NO: 10415 - DNA, 1632 bp, Oryza sativa
  CDS (1)..(1632)
atggtggcggcggcggtggcggcggcggagcaggtggtggcggcgctgcgggaggagtgcgcgacgccggcggcgcggctggatggggtggcggcggcgatggccggcgagatggcggcggggttggcggaggagggcggcagcaagatcaagatgatcgtttcctacgtcgacaacctccccaatggctctctcctacttggaaatttcttagtaattgtgtggttcttggatgccatgaacactttaatatcagcagctacagatgattcggatactctgattgaaaataaaaattgcggaaaatatcttttgctattctcgttactaaaacaacagaatagtggaacagcaatgtgtgcggtactgtatttctgcataaaaaggaccgaagagggcttgttctacgcgctggatcttgggggaacaaacttccgagtcctgcgtgtgcagcttgctggaaaggagaaacgggtcgtgaagcgcgagtcgagggaggtctcgatccctccccatctcatgtccggcaactcctcggagctgtttggcttcatcgcttccgcgttagccaagttcgtcgctgatgaaggacataatgccgtgttcaacgacaggcaaagggaactggggttcaccttctctttccctgtgcggcaaacatcgattgcgtctgggactcttatcaagtggaccaaggcgttttctattgatgatgctgtaggtgaagatgtggtggccgaattgcagatggccatggagaagcaaggtctggacatgcgcgtttccgcattgatcaatgacactgttgggacattggcggcaggcagctactacgacgaagatattgtcgtcggtgtgatcttaggcactggctcaaacgccgcatatcttgagaaggcaaatgctatccctaagttggaaggcgagttaccaaaatcaggaaacatggttattaatacagaatggggtaacttctcctcatcctgtcttccaataacagaatatgatgaagcactagataaagagagcttaaaccctggagagcaggcaagtttctctagaagattgcatactcctcacatgtcaaaaatcttcgagaaattgatttcaggaatgtatctaggtgaaatcgtaaggagagtgcttcttaaaatatctttgcagtcttcaatttttggcaatctagatcagaccaagctcaaaacccgctttattctgaggactcctgatatttccgtgatgcatcatgatggaacacctgatctcagaattgtggctgaaaaacttgcagataacctgaagatcacagacacatccttagaaacaaggaagatggttgtcgaaatctgtgacatcgtcacccgaagatcagcccggctggctgctgctgggatcgtagggatcctcaggaagatcggcagaggcgtcccaggcgacaagcgaaagtcggtcatcgccatcgatggcggtctatatgaacattacaccgaattccggcagtgcctggagaccacgctgacggagttgctcggagaagaggcgtcgaagtcggtggctgtcaagcttgcaaacgacgggtctggccttggagctgccctgattgcagctgctcattctcagtacctgaattga

SEQ ID NO: 10416 - protein, 543 aa, Oryza sativa
MVAAAVAAAEQVVAALREECATPAARLDGVAAAMAGEMAAGLAEEGGSKIKMIVSYVDNLPNGSLLLGNFLVIVWFLDAMNTLISAATDDSDTLIENKNCGKYLLLFSLLKQQNSGTAMCAVLYFCIKRTEEGLFYALDLGGTNFRVLRVQLAGKEKRVVKRESREVSIPPHLMSGNSSELFGFIASALAKFVADEGHNAVFNDRQRELGFTFSFPVRQTSIASGTLIKWTKAFSIDDAVGEDVVAELQMAMEKQGLDMRVSALINDTVGTLAAGSYYDEDIVVGVILGTGSNAAYLEKANAIPKLEGELPKSGNMVINTEWGNFSSSCLPITEYDEALDKESLNPGEQASFSRRLHTPHMSKIFEKLISGMYLGEIVRRVLLKISLQSSIFGNLDQTKLKTRFILRTPDISVMHHDGTPDLRIVAEKLADNLKITDTSLETRKMVVEICDIVTRRSARLAAAGIVGILRKIGRGVPGDKRKSVIAIDGGLYEHYTEFRQCLETTLTELLGEEASKSVAVKLANDGSGLGAALIAAAHSQYLN

SEQ ID NO: 10417 - DNA, 1536 bp, Oryza sativa
  CDS (1)..(1536)
atggaggggagggcggcggggtgggtgagggtggcggcggtggggtgggcggtggcggcgtgcgcggtggcggcggggatggtggcgaggcgaggggcggcgagggtgcggtggaacagggcggtggcggtggtgcgggacctggaggagcggtgcgccacgcccgcggagctgctgcagcgggtggtcaactcgctggccatcgagatgttcgccggcctcgcctccgacggcgggagcaaggtgcggatgctgctcacctgcgtcgacgcgctccccgacggtagttcacatgacatgaccaggagcgaggaaggcatcagttatgccattgatcttggaggaacaagctttagagtcctgaaagtagaacttggcgcagggtctacaatcatcaatcgaaaagttgaacatcagcctatccccgaaaatttgactaagggtacaagcgatgatttgttcaatttcattgcctcggcactgaagaattttattgaaagagagggtggggaggttgaggggagggcacttggttttacattttctttccctgtgagacagacttccatttcctcggggacattaattcgatggactaaagaattttcaattgaagaggctgtcgggaaagatgttgctcagtgcctaaatgaagcccttgctaggaatggactcaatatgaaggtcaatgtattggtgaacaatactgtggggacattagctctcgggcattattatgatgatgacacagtagctgctgtgattattggagctggcaccaatgcttgctatattgaacgcaacgatgcaattattaaatctttgggtcgcgttaccaattctgaacgaacggtagtaaatgtggaatggggtagttttcggcctccacaaatagaattgactccttatgatatatgcttcaacaacgaaacatggaattattatgaccagggttttgagaaaatgatctctggtgtgtatcttggggaaattgcaagattggtgttccaaaaaatggctgaagagtcagatatatttggtactgctgttgatggtctatcgacccctttcgtcttaagtacaccaaacttagctgctatccgcgaggatgattccccggacttgagagaagtcggcaagatacttgaggaacatcttaagctaccagatgttcccctcaagacccggaagcttgttgccagagtctccgacatcatcacccggagagctgcccgcctagcagcggctgcgattgtcgcgatactgcaaaagatcggctgcgatggaaccctttgtggttcaactcaggttcgaacaatgcgaggcgtgcgaagaagaacggtggtcgcgatcgagggcggcctcttcgaaggctactcggtcttcagagagtatctgaatgaagctctagttgagatccttggagaggagattgcagccactgttagtcttagggtgatggaggagggatctgggactggtgctgccctccttgcagctgcatattcatcggctaggcagaagaactccgagtag

SEQ ID NO: 10418 - protein, 511 aa, Oryza sativa
MEGRAAGWVRVAAVGWAVAACAVAAGMVARRGAARVRWNRAVAVVRDLEERCATPAELLQRVVNSLAIEMFAGLASDGGSKVRMLLTCVDALPDGSSHDMTRSEEGISYAIDLGGTSFRVLKVELGAGSTIINRKVEHQPIPENLTKGTSDDLFNFIASALKNFIEREGGEVEGRALGFTFSFPVRQTSISSGTLIRWTKEFSIEEAVGKDVAQCLNEALARNGLNMKVNVLVNNTVGTLALGHYYDDDTVAAVIIGAGTNACYIERNDAIIKSLGRVTNSERTVVNVEWGSFRPPQIELTPYDICFNNETWNYYDQGFEKMISGVYLGEIARLVFQKMAEESDIFGTAVDGLSTPFVLSTPNLAAIREDDSPDLREVGKILEEHLKLPDVPLKTRKLVARVSDIITRRAARLAAAAIVAILQKIGCDGTLCGSTQVRTMRGVRRRTVVAIEGGLFEGYSVFREYLNEALVEILGEEIAATVSLRVMEEGSGTGAALLAAAYSSARQKNSE

SEQ ID NO: 10419 - DNA, 25 bp, Primer
atgtcattcgacgacttacacaaag

SEQ ID NO: 10420 - DNA, 23 bp, Primer
tcatgctacaagcgcacacaagg

SEQ ID NO: 10421 - DNA, 186 bp, Saccharomyces cerevisiae
  CDS (1)..(186)
atgttcagcgaattaattaacttccaaaatgaaggtcatgagtgccaatgccaatgtggtagctgcaaaaataatgaacaatgccaaaaatcatgtagctgcccaacggggtgtaacagcgacgacaaatgcccctgcggtaacaagtctgaagaaaccaagaagtcatgctgctctgggaaatga

SEQ ID NO: 10422 - protein, 61 aa, Saccharomyces cerevisiae
MFSELINFQNEGHECQCQCGSCKNNEQCQKSCSCPTGCNSDDKCPCGNKSEETKKSCCSGK

SEQ ID NO: 10423 - DNA, 765 bp, Candida glabrata
  CDS (315)..(506)
gaattccgcccttcatacacatcctacactcccttaaggagggaagtacaaacaagtgttcgcccattctcttctctcatgatgtgtaaagaaaagtgaaaatcagcaataatagcttctgactatgactatctgtattgacagcaataatagctttcgggatagcatgcaaaaaaaaaatttatatataaacagaggtctttttgaaatgttagatcaatttctaattaaacattttgtagatcctacataactcatacaacaaacaacaaacaacaaacaacaaacaacaaacacatacaaaaacaaacacaatggctaacgattgcaaatgtcctaacggttgctcctgtccaaactgcgccaacggtggctgccagtgcggtgacaagtgcgagtgcaagaagcagagctgtcacggctgcggtgaacaatgcaagtgcggttcccacggttccagctgtcacggttcttgtggatgcggtgacaagtgtgagtgcaagtaattgcattaacaactaaagcaaactactagataaataatataaaaaaaacgacaagaaaacacaacaacacagcacaagttgcggttttctataacgattagactctatgcattcacgatcgcttatatagcaacatattatacataactttcacatacatttaccctctaataaaatttcacttaatataatatcctacccaaaagctatatttagaaacaggtcgctcacgatccacgcttccacgacgaaagggccc

SEQ ID NO: 10424 - protein, 63 aa, Candida glabrata
MANDCKCPNGCSCPNCANGGCQCGDKCECKKQSCHGCGEQCKCGSHGSSCHGSCGCGDKCECK

SEQ ID NO: 10425 - DNA, 376 bp, Gallus gallus (chicken)
  CDS (50)..(241)
ggctgaccctgcgtgaccctgcgtgagccgaaccgacccgaactgaaccatggaccctcaggactgcacttgtgctgctggtgactcctgctcctgtgctgggtcgtgcaagtgcaagaactgccgctgccggagctgccgcaagagctgctgctcctgctgccccgccggctgcaacaactgtgccaagggctgtgtctgcaaggaaccggccagcagcaagtgcagctgctgccactgagccgcccgcctcgcctgtaaatagctgccatgcttcgggaacagggtggggggtgacagggaccacgaaaagcttattttacatgtttgtaccttccataccgatgaaggaaataaatgagtttggctgaagctg

SEQ ID NO: 10426 - protein, 63 aa, Gallus gallus (chicken)
MDPQDCTCAAGDSCSCAGSCKCKNCRCRSCRKSCCSCCPAGCNNCAKGCVCKEPASSKCSCCH

SEQ ID NO: 10427 - DNA, 386 bp, Mus musculus (house mouse)
  CDS (57)..(263): n means a or g or c or t/u
acgtagcgcatccgcttgccgggaggaaccaagctacggcggctgctggactggatatggaccctgagacctgcccctgtcctactggtggttcctgcacctgctcggacaaatgcaagtgcaagggctgcaaatgcacgaactgcaagaagagctgctgctcctgctgccctgccggatgtgagaagtgtgccaaggactgtgtgtgcaaaggtgaagagggggccaaggcagaggccgagaaatgcagctgctgccagtgaggacgacccagaccctcccacacagcctatgtaaatagtgctgggtgtccctggtggggcacaactgttgtcttccccccccccccccccncgccggctgcctgctccggggtgtgaataaat

SEQ ID NO: 10428 - protein, 68 aa, Mus musculus (house mouse)
MDPETCPCPTGGSCTCSDKCKCKGCKCTNCKKSCCSCCPAGCEKCAKDCVCKGEEGAKAEAEKCSCCQ

SEQ ID NO: 10429 - DNA, 364 bp, Caenorhabditis elegans
  CDS (17)..(244)
ctgaaattaagaaatcatggcttgcaagtgtgactgcaaaaacaagcaatgcaagtgcggagacaaatgtgaatgcagtggagacaagtgttgtgagaagtactgctgtgaggaggccagtgagaaaaaatgctgtccagctggatgtaagggagactgcaagtgtgcaaactgtcattgtgcagagcagaagcagtgcggagacaagacccatcaacaccagggaactgctgcggctcattaaaatgtttcagagttgaatctgaaaataccacaattcctactaaactgtgaacatcctactaaattgtaattacctccgagatttatgtaaactaataaatgtgtatattacttgtatctg

SEQ ID NO: 10430 - protein, 75 aa, Caenorhabditis elegans
MACKCDCKNKQCKCGDKCECSGDKCCEKYCCEEASEKKCCPAGCKGDCKCANCHCAEQKQCGDKTHQHQGTAAAH

SEQ ID NO: 10431 - DNA, 189 bp, Mus musculus (house mouse)
  CDS (1)..(189)
atggaccctggggaatgcacgtgtatgtctggagggatctgcatctgcggagataattgcaaatgcacaacctgcagctgtaaaacctgtcgtaaaagctgctgtccctgctgtcccccaggctgtgccaagtgtgcccggggctgcatctgcaaagggggttcagacaagtgcagctgctgtccctga

SEQ ID NO: 10432 - protein, 62 aa, Mus musculus (house mouse)
MDPGECTCMSGGICICGDNCKCTTCSCKTCRKSCCPCCPPGCAKCARGCICKGGSDKCSCCP

SEQ ID NO: 10433 - DNA, 327 bp, Mesocricetus auratus (golden hamster)
  CDS (62)..(247)
cactcaagtttcgacttttcctcggtcctcagccggtcttcaaccgccgccttcactcgccatggaccccaactgctcctgtgccacagatggatcctgctcctgctctgggtcttgcaaatgcaaagagtgcaaatgcaccacgtgcaagaaaagctgctgctcctgctgcccggtgggctgtgcgaagtgctcccagggctgcgtctgcaaagaggcttcggagaagtgcagctgctgcgcctgaagcggattcccctcagctgtctgtaaatagagcaatgtgtagaaacgtattggtttttttacaaccccgtcctattctcc

SEQ ID NO: 10434 - protein, 61 aa, Mesocricetus auratus (golden hamster)
MDPNCSCATDGSCSCSGSCKCKECKCTTCKKSCCSCCPVGCAKCSQGCVCKEASEKCSCCA

SEQ ID NO: 10435 - DNA, 317 bp, Tilapia mossambica, Oreochromis mossambicus (Mozambique tilapia)
  CDS (1)..(183)
atggatccgtgcgaatgcgccaagactggaacctgcaactgcggaggatcctgctcgtgcactaagtgctcctgcaagagctgcaagaagagctgctgcgactgctgcccatccggctgcagcaaatgcgcctccggctgcgtgtgcaaaggaaagacatgcgacaccagctgctgccagtgaggagtctgcagcatcagctctctgctgcaattatggagtctttatttgccactaatcatgaatttgcacatgtccagaaatgataacgaatgattttgtacttgtgtttgaaataaacatgtttgttgacgcta

SEQ ID NO: 10436 - protein, 60 aa, Tilapia mossambica, Oreochromis mossambicus (Mozambique tilapia)
MDPCECAKTGTCNCGGSCSCTKCSCKSCKKSCCDCCPSGCSKCASGCVCKGKTCDTSCCQ

SEQ ID NO: 10437 - DNA, 378 bp, Sus scrofa domestica (domestic pig)
  CDS (29)..(235)
cacctgctccagcggcagtcctctcgacatggaccctgagacctgcccctgccctactggtggctcctgcacctgcgctggctcctgcaagtgcgagggatgcaaatgcacctcctgcaagaagagctgctgctcctgctgccctgccgagtgtgagaaatgcgccaaggattgcgtgtgtaaaggtggagagggggccgaagctgaggaagagaagtgcagctgctgccagtgaggacgtgcccctccgtgcaaaatgtgtgtaaatagtgctggtggcctagtgccacctgtccccatggtgagctccgcagttggtccccttcccctgctagccactggcaagtgacaataaatcctgtgaaaggcgtaaaaaaa

SEQ ID NO: 10438 - protein, 68 aa, Sus scrofa domestica (domestic pig)
MDPETCPCPTGGSCTCAGSCKCEGCKCTSCKKSCCSCCPAECEKCAKDCVCKGGEGAEAEEEKCSCCQ

SEQ ID NO: 10439 - DNA, 222 bp, Mytilus edulis (blue mussel)
  CDS (1)..(222)
atgcctgcaccttgtaactgtatcgaatcaaatgtgtgtatctgtggcactgggtgtagcggtgaaggttgtcgctgtggtgacgcctgcaagtgctcgggcgccgactgtaaatgttccggttgtaaagtagtttgcaagtgttcaggtagctgtgcgtgtgaagcaggatgtacaggaccttcaacgtgtagatgtgcacctggttgctcctgcaaatga

SEQ ID NO: 10440 - protein, 73 aa, Mytilus edulis (blue mussel)
MPAPCNCIESNVCICGTGCSGEGCRCGDACKCSGADCKCSGCKVVCKCSGSCACEAGCTGPSTCRCAPGCSCK

SEQ ID NO: 10441 - DNA, 132 bp, Drosophila melanogaster
  CDS (1)..(132)
atggtttgcaagggttgtggaacaaactgccagtgctcggcccaaaagtgcggggacaactgcgcctgcaacaaggattgccagtgcgtttgcaagaatgggcccaaggaccagtgctgcagcaacaaataa

SEQ ID NO: 10442 - protein, 43 aa, Drosophila melanogaster
MVCKGCGTNCQCSAQKCGDNCACNKDCQCVCKNGPKDQCCSNK

SEQ ID NO: 10443 - DNA, 186 bp, Homo sapiens (man)
  CDS (1)..(186)
atggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactga

SEQ ID NO: 10444 - protein, 61 aa, Homo sapiens (man)
MDPNCSCAAGVSCTCAGSCKCKECKCTSCKKSCCSCCPVGCSKCAQGCVCKGASEKCSCCD

SEQ ID NO: 10445 - DNA, 180 bp, Panulirus argus
  CDS (1)..(180)
atgcctggtccctgctgcatcgataagtgtgagtgtgccgagggcaaatgcaaatcaggatgtcagtgcaagtcctgcacgtgcagcactccctgcgacaagtgtacaactgcatgctgttgctcgacgaaggaagaatgcgctagcaagtgtaccaagccttgcaaatgctgcccttag

SEQ ID NO: 10446 - protein, 59 aa, Panulirus argus
MPGPCCIDKCECAEGKCKSGCQCKSCTCSTPCDKCTTACCCSTKEECASKCTKPCKCCP

SEQ ID NO: 10447 - DNA, 186 bp, Salvelinus alpinus
  CDS (1)..(186)
atggatccgtgtgaatgctccaaaactggatcttgcaactccggtggatcctgcaagtgctccaactgcgcatgcaccagttgtaagaaagcaagttgctgcgactgctgtccctccggctgcagcaagtgtgcctcaggctgcgtgtgcaagggcaagacttgtgataccagctgttgtcagtga

SEQ ID NO: 10448 - protein, 61 aa, Salvelinus alpinus
MDPCECSKTGSCNSGGSCKCSNCACTSCKKASCCDCCPSGCSKCASGCVCKGKTCDTSCCQ

SEQ ID NO: 10449 - DNA, 225 bp, Ostrea edulis
  CDS (1)..(225)
atgtctgatccatgtaactgcaagacaacgggaaattgtctgtgttcagacacctgtccatccactgggtgtaactgtgcttctgggtgtaaatgtggagccggctgtaaatgtcccggatgtcagattgtttgtaaatgcaacagtacctgcgcatgcggagtaggatgtactggacctgacacttgcaaatgtgctgctgattcgggatgtagctgcaaatag

SEQ ID NO: 10450 - protein, 74 aa, Ostrea edulis
MSDPCNCKTTGNCLCSDTCPSTGCNCASGCKCGAGCKCPGCQIVCKCNSTCACGVGCTGPDTCKCAADSGCSCK

SEQ ID NO: 10451 - DNA, 204 bp, Helix pomatia
  CDS (1)..(204)
atgagcggaaaaggaaaaggagaaaagtgcacctcagcttgcaggagcgagccttgccagtgtgggagcaagtgccagtgtggggaaggctgtacatgtgccgcctgcaagacttgcaactgtaccagtgatggttgcaagtgcggcaaggagtgcaccggcccagactcgtgcaagtgtggcagctcgtgcagctgcaagtaa

SEQ ID NO: 10452 - protein, 67 aa, Helix pomatia
MSGKGKGEKCTSACRSEPCQCGSKCQCGEGCTCAACKTCNCTSDGCKCGKECTGPDSCKCGSSCSCK

SEQ ID NO: 10453 - DNA, 303 bp, Littorina littorea
  CDS (1)..(303)
atgtcttcagttttcggagcaggatgcacggacgtgtgcaagcagacgccatgcggctgtgccacctcgggctgtaactgcacggacgactgcaagtgtcagtcatgcaaatacggagcgggttgcacggacacatgcaagcagacaccatgtgggtgtggcagcgggtgcaactgtaaggaggactgtcgctgtcagagctgttccaccgcctgcaagtgtgcggctggaagctgcaagtgcggcaagggatgcacagggccagacagctgcaagtgtgaccgatcgtgctcctgcaaataa

SEQ ID NO: 10454 - protein, 100 aa, Littorina littorea
MSSVFGAGCTDVCKQTPCGCATSGCNCTDDCKCQSCKYGAGCTDTCKQTPCGCGSGCNCKEDCRCQSCSTACKCAAGSCKCGKGCTGPDSCKCDRSCSCK

SEQ ID NO: 10455 - DNA, 243 bp, Crassostrea angulata
  CDS (1)..(243)
atgtctgatccatgtaactgcattgagactggaacatgtgtctgctctgaatcgtgtccagcaacaggatgtaaatgtggactcggatgtaaatgtggtgacgggtgtaaatgttcaggctgcaaagtcaagtgtaactgcagcggatcttgtggttgtggtaaaggatgcacgggaccggaaaactgcaaatgcgcaaacgattccggatgtgtctgcaaagtcaagtgtaactgcagctga

SEQ ID NO: 10456 - protein, 80 aa, Crassostrea angulata
MSDPCNCIETGTCVCSESCPATGCKCGLGCKCGDGCKCSGCKVKCNCSGSCGCGKGCTGPENCKCANDSGCVCKVKCNCS

SEQ ID NO: 10457 - DNA, 517 bp, Crassostrea gigas
  CDS (68)..(391): n means a or g or c or t/u
tggtgacctgcaggcggccgcactagtgattggaggacaagaggagaaacatcaagactaagaaaacatgtctgatccatgtaactgcactgagactggaacatgtgtctgctctgattcgtgtccagcaacaggatgtaaatgtggacccggatgtaaatgtggtgacgggtgtaaatgttcaggctgcaaagtcaagtgtaactgcagcgggtcttgtggttgtggtaaaggatgcactggaccggaaaactgcaaatgcgcaaacgattccggatgtggctgcaaagtcaagtgtaactgcagcggatcttgtggttgtggtaaaggatgcactggaccggaaaactgcaaatgcgcaaacgattccggatgtggctgtaagaaatgagtgcgtgtaaacaaaggacgaaggcggaccnnntttattgttttatattgtttctacttgatgtaattctaaagttattgttagcataataaaataattccaaaaatcaaaaaaaaaaaaaaaaaa

SEQ ID NO: 10458 - protein, 107 aa, Crassostrea gigas
MSDPCNCTETGTCVCSDSCPATGCKCGPGCKCGDGCKCSGCKVKCNCSGSCGCGKGCTGPENCKCANDSGCGCKVKCNCSGSCGCGKGCTGPENCKCANDSGCGCKK

SEQ ID NO: 10459 - DNA, 222 bp, Mytilus edulis
  CDS (1)..(222)
atgcctgcaccttgtaactgtatcgaaacaaatgtgtgtatctgtgacactggctgcagcggtgacggttgtcgctgtggtgacgcctgcaagtgctcgggcgctgactgtaaatgttctggttgtaaagtagtttgcaagtgttcaggtagctgtgagtgtggcaaaggatgtacaggaccttcaacgtgtaaatgtgcacctggctgttcctgcaagtga

SEQ ID NO: 10460 - protein, 73 aa, Mytilus edulis
MPAPCNCIETNVCICDTGCSGDGCRCGDACKCSGADCKCSGCKVVCKCSGSCECGKGCTGPSTCKCAPGCSCK

SEQ ID NO: 10461 - DNA, 177 bp, Callinectes sapidus
  CDS (1)..(177)
atgcctgatccctgctgcaacgacaagtgtgagtgcaaggagggagaatgcaagacagggtgtaagtgcaagtcctgtcgctgccccccgtgcgataagtgctcgtctgagtgcaagtgtaccagcaaggaggagtgcagcaagacctgctccaagccttgctcctgctgcccctag

SEQ ID NO: 10462 - protein, 58 aa, Callinectes sapidus
MPDPCCNDKCECKEGECKTGCKCKSCRCPPCDKCSSECKCTSKEECSKTCSKPCSCCP

SEQ ID NO: 10463 - DNA, 306 bp, Cyprinodon sp
  CDS (1)..(183)
atggatccctgcgagtgctccaagactggaaaatgcaactgcggaacgtcttgtacctgcaccaactgctcctgcaaatgctgcaagaagagctgctgttcatgctgcccatcaggctgcagtaaatgcgcctctggatgcgtatgcaaaggaaattcctgtgacaagagctgctgtcagtgaggagccaaacccatcaaccccttatttcctgtgctgaggagcctctytaaaatctgacatatwccagatttttagggaatgcatttttgtacttgaatttcaataaatattaatgtaaaattt

SEQ ID NO: 10464 - protein, 60 aa, Cyprinodon sp
MDPCECSKTGKCNCGTSCTCTNCSCKCCKKSCCSCCPSGCSKCASGCVCKGNSCDKSCCQ

SEQ ID NO: 10465 - DNA, 756 bp, Enchytraeus buchholzi
  CDS (1)..(756)
atggcatcacacgctcatgctgaagcacactgtggctgtggaactgagtgccattgccctaaaggtagctgcggctctggctgtggcacgagcactactgctggcagctgtggagtggcaggctgcccgtgtggttctcactgtaaatgtgagaagggagaatgcagaagaggctgtagcaagggttgttgcactcctaagtgtggagttgaaggatgcccctgcggttctcaatgcaagtgtgagaaaggagaatgcaaaaaggggtgcaaggagggctgctgtgcccccaagtgtggagtggcaggctgctcctgtggttcaggatgtaagtgtgagaagggagagtgtaagccaggttgtaccaagcgatgctgtggtactaaatgtggagttgaagattgcccatgtggtccaagctgcaagtgtgagaaaggtgattttaaggtaaactgcagcaagggttgctgtacccctaagtgtggagttgttggctgcccatgcgggtcacagtgcacatgtgagaagggatcctgcaagaaaggttgcagcaaaggatgctgcactcctaaatgtggaatgcaggactgcccgtgtggttcacattgtaagtgcgagaaaggctcctgtgagaagggctgcactcaaggatgttgtgctcctaagtgcgacaacgtaaactgcaagtgtggctcaagctgtcgctgtgagaaaggaacttgcacaccaagctgtgcacaaacctgctgcgcctaa

SEQ ID NO: 10466 - protein, 251 aa, Enchytraeus buchholzi
MASHAHAEAHCGCGTECHCPKGSCGSGCGTSTTAGSCGVAGCPCGSHCKCEKGECRRGCSKGCCTPKCGVEGCPCGSQCKCEKGECKKGCKEGCCAPKCGVAGCSCGSGCKCEKGECKPGCTKRCCGTKCGVEDCPCGPSCKCEKGDFKVNCSKGCCTPKCGVVGCPCGSQCTCEKGSCKKGCSKGCCTPKCGMQDCPCGSHCKCEKGSCEKGCTQGCCAPKCDNVNCKCGSSCRCEKGTCTPSCAQTCCA

SEQ ID NO: 10467 - DNA, 225 bp, Mytilus edulis
  CDS (1)..(225)
atgcctgcatcttgtaactgtatcgaaacaaatgtgtgtatctgtgacactggctgcagcggtgaaggttgtcgctgtggtgacgcctgcaagtgctcgggcgccgactgtaaatgttccggcggttgtaaagtagtttgcaagtgttcaggtagctgtgcgtgtgaaggaggatgtacaggaccttcaacgtgtaaatgtgcacctggctgttcctgcaagtga

SEQ ID NO: 10468 - protein, 74 aa, Mytilus edulis
MPASCNCIETNVCICDTGCSGEGCRCGDACKCSGADCKCSGGCKVVCKCSGSCACEGGCTGPSTCKCAPGCSCK

SEQ ID NO: 10469 - DNA, 26 bp, Primer
atgttcagcgaattaattaacttcca

SEQ ID NO: 10470 - DNA, 24 bp, Primer
tcatttcccagagcagcatgactt

SEQ ID NO: 10471 - DNA, 717 bp, Escherichia coli K12; identical to SEQ ID NO: 423
  CDS (1)..(717)

SEQ ID NO: 10472 - protein, 238 aa, Escherichia coli K12 [sequence omitted]

SEQ ID NO: 10473 - DNA, 711 bp, Bacillus subtilis
  CDS (1)..(711)
atgttaaaataccagcaaatcgcaacggaaattgaaacatatatagaagaacaccagcttcagcagggagacaaactgccagtcctagaaaccctcatggcccagtttgaagtcagcaaaagcaccatcacaaagtccctcgagctattagagcaaaaaggcgcgatctttcaggtcagaggaagcggcattttcgtcagaaaacataaacgaaaaggctatatcagccttctgtcgaatcagggatttaaaaaagatctcgaggatttcaacgtcacctcaaaagtcatcgaactggacgtgagaaagccaacaccggaagcggcggaaaacctgaacatcggaatggacgaggacatctactatgtcaaaagggtccgctacatcaacggccagaccctttgctacgaagaatcctattacaccaaatccatcgtgacgtatttaaacaacgaaatcgtctcccactccatcttccattacatccgggaaggactggggttgaagattggtttttctgatttgtttctgcacgtgggccagcttaatgaggaagaagcggaatatttgggattagaggctggactgccgaagctgtatatagaaagtatttttcacctgacaaatgggcagccgtttgattactcgaagatttcgtataattatgagcagtcgcagtttgtggtacaggctaatagttttttattatag

SEQ ID NO: 10474 - protein, 236 aa, Bacillus subtilis
MLKYQQIATEIETYIEEHQLQQGDKLPVLETLMAQFEVSKSTITKSLELLEQKGAIFQVRGSGIFVRKHKRKGYISLLSNQGFKKDLEDFNVTSKVIELDVRKPTPEAAENLNIGMDEDIYYVKRVRYINGQTLCYEESYYTKSIVTYLNNEIVSHSIFHYIREGLGLKIGFSDLFLHVGQLNEEEAEYLGLEAGLPKLYIESIFHLTNGQPFDYSKISYNYEQSQFVVQANSFLL

SEQ ID NO: 10475 - DNA, 717 bp, Lactococcus lactis subsp. lactis
  CDS (1)..(717)
atgaagaaatatgaagtgattttgcaagatttagaaaaaaagatttttaacgatatctataaaacgaacgatattcttccaagtgaaaatgagctctctgctaattacgagagcagtcgttcaacagtcagacaggctttaaaaattttagaagagaaagggcttattcaaagacgacatggctatggtagcattgtcctcgctcacgataggctccttttccctatctctggcttaacttcatacaaagaactacaaacctctatgggtttccatagtgaaactgaggtcattcgatttgaaagacttgaaattaaccctaaactttcagaaacaactggttttgccgttggtgaacacgccataagtattctcagaaggcgcaaagtagatggcaaattttcaattttagattgggatttatttttagaaaaatattccgaaggtttaactccagaacatgctaaaatttcaacctatgactacttagaagatactctagggcttgatattgcctatgctcaaaaggaagtcacgattgattttgcctgcgaagatgactttaaatatcttgacttaaatcccaaagaccatcatgtcgtgtctgtcaaatctcatgtttatcttgctgataatactctttttcagtatactgaatctcgacatcaagtcgaccgctttcgtttcacagaatttgccagacgacaaaaaagataa

SEQ ID NO: 10476 - protein, 238 aa, Lactococcus lactis subsp. lactis
MKKYEVILQDLEKKIFNDIYKTNDILPSENELSANYESSRSTVRQALKILEEKGLIQRRHGYGSIVLAHDRLLFPISGLTSYKELQTSMGFHSETEVIRFERLEINPKLSETTGFAVGEHAISILRRRKVDGKFSILDWDLFLEKYSEGLTPEHAKISTYDYLEDTLGLDIAYAQKEVTIDFACEDDFKYLDLNPKDHHVVSVKSHVYLADNTLFQYTESRHQVDRFRFTEFARRQKR

SEQ ID NO: 10477 - DNA, 714 bp, Clostridium acetobutylicum
  CDS (1)..(714)
atggaactaaataatacaattgctacacctttgtacaaacaattagaaaaaaaactgcagcaagaaatagatagtggtaaaagacctgctggaagccgtcttccaacagaaaatgaattgagcaaggcttataatgtaagccgtgtgactgtccgcaaagctcttgctgaactatccgagtcaggatatttagagcgcaaatcaggaaaaggtacttttgttgctgaaaaaaaacttgagcgtggcataacaaacggtgttttaggtttttctgaaatgtgtaaaatgatgaatgcaattccgggtgccaaaattataaagatcgcccttgaagagccatcagaaaaggatatacagaaaatgtcacttaataaagatgaaaaagttttagtattagaacgtgtacgttatgcaaatggcaaaccagtattgttagaattaaataaatttcctgaatccttttcctttttatttgaagaaaatttaactgatgcatctctgtatgatattttagaacaacacaatataattttagatcattcccgaaaaacactagatattgtatttgcagatactaaagaagctaaaacattaggaatttctaggggatacccacttttaagaatcaatagtatcatacacaatgcagacaacactattactaacctctgtcagcaactttgtataggagataagtttacatttataatttaa

SEQ ID NO: 10478 - protein, 237 aa, Clostridium acetobutylicum
MELNNTIATPLYKQLEKKLQQEIDSGKRPAGSRLPTENELSKAYNVSRVTVRKALAELSESGYLERKSGKGTFVAEKKLERGITNGVLGFSEMCKMMNAIPGAKIIKIALEEPSEKDIQKMSLNKDEKVLVLERVRYANGKPVLLELNKFPESFSFLFEENLTDASLYDILEQHNIILDHSRKTLDIVFADTKEAKTLGISRGYPLLRINSIIHNADNTITNLCQQLCIGDKFTFII

SEQ ID NO: 10479 - DNA, 735 bp, Brucella melitensis
  CDS (1)..(735)
atgaatgttgaatcggatcatgcgcccctctatgccaaggtcgaggctgctttggcagccgagattgccaaaggcatctttcctcgtggttcccggctcccgcctgaagatagcttgatcgagaggttcggtgtcagccggaccaccgttcgcaaggccattgaaaatctggtcatgcgtggcctggtcgagatccgacgcggcaaaggaaccttcgttgcggagccaaagattcggcaggaattgactgaattgagcggcttcgtggaagatatggttgccttgggtcgcaagccaaccgcaaatctgctcgacaagcgatcggttcccgcttgtgaggaagtggcagagcatcttggcgttgctgttggaacgcaggtctatcgcatcgagcgtgtgcgattggccgatggcgtcgccatgtcgttcgacgaaacctatttgcccctcgatatcggcgagaagattgccagcaacgatttggaagttgaaccgatcttttcattgcttgaaaacaagtatggcatgccacttgtcgaagcagactaccagctggaggctgttacggctgacgaccatgttgcgcaggcgctgggaattgcgccgggaagcccaatatttctgattgagcggacgacctattgcaaagggtcggagccggtggattatgaaaagctttattatcggggcgatctcatcaagttttgcacgcgattatcacgtcggacaaggtag

SEQ ID NO: 10480 - protein, 244 aa, Brucella melitensis
MNVESDHAPLYAKVEAALAAEIAKGIFPRGSRLPPEDSLIERFGVSRTTVRKAIENLVMRGLVEIRRGKGTFVAEPKIRQELTELSGFVEDMVALGRKPTANLLDKRSVPACEEVAEHLGVAVGTQVYRIERVRLADGVAMSFDETYLPLDIGEKIASNDLEVEPIFSLLENKYGMPLVEADYQLEAVTADDHVAQALGIAPGSPIFLIERTTYCKGSEPVDYEKLYYRGDLIKFCTRLSRRTR

SEQ ID NO: 10481 - DNA, 714 bp, Listeria monocytogenes
  CDS (1)..(714)
atgtcgggaatggctaaatacatggaaatatacatagatatccgtgataaaatcaaccaaaacaaatacgaaattaacgagaaattgcctgacggggatagtctggcacgcgtttatgattgcagcaaacttactgtcaaaaaagcgctggatatgctcgtgcaagaaggtatggttattagacgacgcggcgctggtactttcgtgaaatctcattctactaacggcggagaattcgcactaggcccaatgtccggactcgtaaatacatttggaaaagacaacattaaatccaaagttattttattttccattgaaaaaccatcgaaagaagtcgcagaaaaattagagatgcaggatgattatatttaccgaattattcggatgagagaagttggccataaagcctattccatcgaacatacttatatgccacttgcgattattccgggtttagagccgcgtcatttagaggactcaatttataattacattcgggatgacttgaaacttaagatgcaaagtgcgcatgtttgggtacgtggagataaatctaatcaagaggatagtaagctcctcgatttagaagaacctacttttatgatggaaattgagaaattggcgcatttggaagatggtcgagtgtttgaatattcgattacgcgccatacgtatgaatcgtttgtgtttgaaacggtttttgtgcagaattaa

SEQ ID NO: 10482 - protein, 237 aa, Listeria monocytogenes
MSGMAKYMEIYIDIRDKINQNKYEINEKLPDGDSLARVYDCSKLTVKKALDMLVQEGMVIRRRGAGTFVKSHSTNGGEFALGPMSGLVNTFGKDNIKSKVILFSIEKPSKEVAEKLEMQDDYIYRIIRMREVGHKAYSIEHTYMPLAIIPGLEPRHLEDSIYNYIRDDLKLKMQSAHVWVRGDKSNQEDSKLLDLEEPTFMMEIEKLAHLEDGRVFEYSITRHTYESFVFETVFVQN

SEQ ID NO: 10483 - DNA, 723 bp, Listeria innocua; identical to SEQ ID NO: 453
  CDS (1)..(723)

SEQ ID NO: 10484 - protein, 240 aa, Listeria innocua; identical to SEQ ID NO: 454

SEQ ID NO: 10485 - DNA, 741 bp, Nostoc sp. PCC 7120
  CDS (1)..(741)
atgaacgaaataatgccaatttatgcccagattgctgacaaactacgacaaaagattcatcaagggatttatcaactaggggaacaactaccaacggaaaccaagttagcagaacagtttgcagtcaatcgccataccctcagacaagcgatcgctctcctgaaaactgaaggattgttacgagttgaccgaggacgggggacttttgtcgcagccaaaaccatccgctatgctattggtaagcgtgtgcgttataaccaaaccctgaaagcgcaagggttacaagcaaggtttcaactgctacgggttttagaagtacctgctgatgatgctgttgcgaaaggattagagatttcttttggtgagccagtagcgttaattgaacgtttaggtttagcagatgaagaacccattagtgtgggtagtggatattttcccctcaagcgattccctgattttttagaaccggaaaatatcaagattttgcaagaacagcaatcaatttctcagtttttacagcaggtatatggatgtgatcatatccgccgtagtacctgcgtttcggctcgtctagtccaacctcaagatgcaaaatggctacaaataccactcaatcaacccatcttgttagcagaatcagtcaacgttgatcaagcaggtaatgtgattgaatatggcgtaactcgactgcgaggcgatcgtatggagttattttttgaaaataatttatttgatgattga

SEQ ID NO: 10486 - protein, 246 aa, Nostoc sp. PCC 7120
MNEIMPIYAQIADKLRQKIHQGIYQLGEQLPTETKLAEQFAVNRHTLRQAIALLKTEGLLRVDRGRGTFVAAKTIRYAIGKRVRYNQTLKAQGLQARFQLLRVLEVPADDAVAKGLEISFGEPVALIERLGLADEEPISVGSGYFPLKRFPDFLEPENIKILQEQQSISQFLQQVYGCDHIRRSTCVSARLVQPQDAKWLQIPLNQPILLAESVNVDQAGNVIEYGVTRLRGDRMELFFENNLFDD

SEQ ID NO: 10487 - DNA, 780 bp, Brucella melitensis
  CDS (1)..(780)
atgcggatgagcggaaatttcggcgctttcctgcccaagaacctgcagggctctgcgccctcctccggggcggggccgctttacgtgcaactgcgtcagtcactcgaagcggcaatccgtgccgggcaactggccgatggtgaggcattgccgccggaacgcgacattgccgaatataccaatatcagccgcgtgaccgtgcgcaaggccgtggacgacctcgtaaaggcggggcttctggtgcgccgtcacggctcaggcacgtttgtcgtacgccccggcgagcgtgtgcagcaatcactctccatgctgacctcatttacggaagatatggcccggcgcggcattgccacgcaatcgcgctggctggagcgcgggctttattatccctcgccggaagaaatgatgaagcttggtttgtcatcggaaacgcgggtggcgcggttggggcgcctgcgcatggtgggcgacatgccgcttgccatcgaaagggcaagcctttccagtgaattcctgcccgatcccgatgccgtgcaaggctcactttatgcggagctgggccgcacaggttttcgtccggtgcgtgcggtacagcgtattgcggcctgcaatatcaagacgtcggatgctcgcattcttggcgtgcaggaaggcgatgcgggcctttctatcgagcgtctttcctatctggcttcgggccgcgtggtggaatttaccaagtcgctctatcgcggcgatgcctatgatttcgttgcagagctgacaattccgcaatcctga

SEQ ID NO: 10488 - protein, 259 aa, Brucella melitensis
MRMSGNFGAFLPKNLQGSAPSSGAGPLYVQLRQSLEAAIRAGQLADGEALPPERDIAEYTNISRVTVRKAVDDLVKAGLLVRRHGSGTFVVRPGERVQQSLSMLTSFTEDMARRGIATQSRWLERGLYYPSPEEMMKLGLSSETRVARLGRLRMVGDMPLAIERASLSSEFLPDPDAVQGSLYAELGRTGFRPVRAVQRIAACNIKTSDARILGVQEGDAGLSIERLSYLASGRVVEFTKSLYRGDAYDFVAELTIPQS

SEQ ID NO: 10489 - DNA, 744 bp, Salmonella enterica subsp. enterica serovar Typhi
  CDS (1)..(744)
atgaaaacattgagtaaaagttcacacatcccactgtatcaacaggttgtggagtggataagggaaagtatttatagcggagaattagttgaggatgaccggataccttcagagtttcaaatcatggatatgctggaggtgagtcgcggtaccgttaaaaaagcggttgaccaacttgtccgggaaggtgttcttgtgcaagtgcagggtaaaggaactttcgtaaagaaggaaaatgttgcttacccactgggtgaaggtttgctctcctttgctgaagccttagccagccagaagataaacttcacaaccagtgtcataacctcccgactggaacccgctaaccgctttgtagcagagaaactgagtatcaaaccgggacaagatgttttatttcttaaacgccttcgttgtattggcgatgaaaaagtcatgttgattgaaaatcgtatcaacattgatctctgccccggtattattgatgtagattttaccagggagaatttattttcagcaatagaaagattatctgataagaaaataagtttttctgaaagccgttacgcagccaaattaattggtaatgagcgaggccattatcttgatattggtgaagacgcacctgttttgcatttggaacagttggtatttttctctagaggattggccattgattttggtaacgtctggttaaaaggtaataaatattatcttggcactattttacagcgcctggatgcctga

SEQ ID NO: 10490 - protein, 247 aa, Salmonella enterica subsp. enterica serovar Typhi; identical to SEQ ID NO: 460

SEQ ID NO: 10491 - DNA, 714 bp, Listeria monocytogenes
  CDS (1)..(714)
atgaataagaaaaataagttttttgacatttatttagaattagagcaagacattacatctggcgtttatccagcaggcacactacttccaagtgaaaatgtcctggctaagcgtttttcggtgtctcgtgaaaccattagaaaagcacttgtattattgcttgaaaacggctgtattcaaaagctccaaggaaaaggctccattgttattgaccgggaacgttattcttttccagtctctggattaactagctttaaagaattacaaaaatccgaacagatgaatgccactacagaagtcatccggaatgaagagacaactttaccagatcgaattgctgattttgctggtcttccgcacggctcaaactgcttagctatcctcagagtgcgctatttagaaggagaggcaactattttggattacgattatttattagacaaaactgaaccaattgcgaatgagattttagaagactccttgtatcaatacttagaaaatgaaaaaggttatgaaatcagttatgctcaaaaagaaataaccgtggagccactgaatgccgaagataaaaaatacttagccttacatggtgatacgcatgtggttgtcgtaaaaagtactgtgtttttaaaagatacaacactttttcagtatactgaatcgcgtcaccggttggataaattccgttttattgattttgctagaagacgctaa

SEQ ID NO: 10492 - protein, 237 aa, Listeria monocytogenes
MNKKNKFFDIYLELEQDITSGVYPAGTLLPSENVLAKRFSVSRETIRKALVLLLENGCIQKLQGKGSIVIDRERYSFPVSGLTSFKELQKSEQMNATTEVIRNEETTLPDRIADFAGLPHGSNCLAILRVRYLEGEATILDYDYLLDKTEPIANEILEDSLYQYLENEKGYEISYAQKEITVEPLNAEDKKYLALHGDTHVVVVKSTVFLKDTTLFQYTESRHRLDKFRFIDFARRR

SEQ ID NO: 10493 - DNA, 714 bp, Listeria innocua; identical to SEQ ID NO: 455
  CDS (1)..(714)

SEQ ID NO: 10494 - protein, 237 aa, Listeria innocua; identical to SEQ ID NO: 456

SEQ ID NO: 10495 - DNA, 702 bp, Listeria innocua
  CDS (1)..(702)
atggcagctaaaaaaccattatttgaagtaattgcttcgaaaataaaagatagtattaatcgtgatgaatataaaacgggaatgcttatgccaaacgaaactgcgctgcaagaaatttattccagtagccgaaccacaatccgtcgcgcggtagatttattagtggaggaaggtctcgtcgtgcgtaaaaatggagtaggactttacgtgcaaccgaaattaaccgcgcaaaatattttagaaatgacaggtgttatgaaaaatgataccaatgaaaatttaaagaaagacattaaagacttttacattcgtaaagctgggaaattttacgcagaaatattcggaatgaaagaaaatgagttagtttactccattaagtttgtgcaaaaaagcgagcacggtgccacactagatcgcttaattttaccactgggtttataccctgatttacaagcgaaggattttcaaattattaatattatagagcttgttaattcaggtaaatataaattatttgagcttgagcaggaacttcaacttattttagctgggaatgagcaaatcaaaaatatgcatttaaatgaaaatgatcctgtttttaaattaagcagcgttttttatgcggaaaatgacatgccaattgccatccaatatcattatgaagatgctgagtcaaccaaatatgtagttgattttaactaa

SEQ ID NO: 10496 - protein, 233 aa, Listeria innocua
MAAKKPLFEVIASKIKDSINRDEYKTGMLMPNETALQEIYSSSRTTIRRAVDLLVEEGLVVRKNGVGLYVQPKLTAQNILEMTGVMKNDTNENLKKDIKDFYIRKAGKFYAEIFGMKENELVYSIKFVQKSEHGATLDRLILPLGLYPDLQAKDFQIINIIELVNSGKYKLFELEQELQLILAGNEQIKNMHLNENDPVFKLSSVFYAENDMPIAIQYHYEDAESTKYVVDFN

SEQ ID NO: 10497 - DNA, 753 bp, Agrobacterium tumefaciens
  CDS (1)..(753)
atgaacggggcagcgcttaatctggaggacctgcaatcaggcggcggtccgctgtacctgaaattgcgccagacgatcgaagacgccatcaatggcggccgcctgaagcatggcgacgccctgccgccggaacgcgacattgctgaaagcgcctgcgtcagccgcgtcacggtgcgcaaggcggtggatgatctcgtccgcgacggccttctcgttcgccggcatggttcgggcacctttgtcgtcaagcccatcacccgcatgcaacagccgctgaccaagctcacctcctttaccgaggacatgcgccggcgcggcatgacggcaagcacccaatggctggacaggggtcttttccaccccaccggcgatgagatgatgacactcggcctttcccagtccgccatggtggcacggctcacgcgcctgcgtcttgccaatgaccagccgatcgcgctggaagtcaccagcctgccgggggatattttgcccgatccgcaactcgtcgaaaattcgctttatctggagcttgaaaagagcggcattcgccccgtgcgcgccattcagcgcatctcggcccgcaatctcacggatgaggaaacccttctgcttggggtcccgccgggctcggcagcgctttccgttcagcgcatggcctatctcgaaagcgggcgcctcatggaaatatccctcgcgctttaccgcagtgatgcctacgaccttgtcgccgaactgacgatgggtccagagtaa

SEQ ID NO: 10498 - protein, 250 aa, Agrobacterium tumefaciens
MNGAALNLEDLQSGGGPLYLKLRQTIEDAINGGRLKHGDALPPERDIAESACVSRVTVRKAVDDLVRDGLLVRRHGSGTFVVKPITRMQQPLTKLTSFTEDMRRRGMTASTQWLDRGLFHPTGDEMMTLGLSQSAMVARLTRLRLANDQPIALEVTSLPGDILPDPQLVENSLYLELEKSGIRPVRAIQRISARNLTDEETLLLGVPPGSAALSVQRMAYLESGRLMEISLALYRSDAYDLVAELTMGPE

SEQ ID NO: 10499 - DNA, 750 bp, Listeria monocytogenes
  CDS (1)..(750)
atgaaaaaattaaataaatcatcttctacaccactttatatgcaactgaaaaatcaactacaagagaaaattgaacaagatatgtctgttggagatttacttttgacagaaacagaaattgaaaagatgtatgatgttagcaggatgacagttcgaaaagcgatagaagagctggtaaatgagggaattgtaagtaaacaacaaggaaaaggaacgtttgtgagtcaaacaaagactacacaaggacttggacggatttttagttggtcagaggaaatgaaactacaacataaagaatctaagactatcagtgtagaaatttctgcagcaatcccgtcaaaaaaaattcgtacagcactccaattaggcaagcatgaagaagtaacttgtattagacgcgtgagagaaattgatggtgaacctgttgcaattatgattaattatttacgcgccaaatatgttcctggtttactagagaatggtttgaaatcagattccctttaccatgatttggaagaaatttatcatattagtttagtacatgcagatgaaattattacagcaagattatctaccccgattgaatctgccttgcttgcagttccagaagactctgcggtgcttcatgtgcgacgtacttcctatatgaaaggcaataccccagtggaagtggtggatatggtagctcgcggagataggtaccaatatttggctgaattagaaggtagaactaaaaaacatatcatatag

SEQ ID NO: 10500 - protein, 249 aa, Listeria monocytogenes
MKKLNKSSSTPLYMQLKNQLQEKIEQDMSVGDLLLTETEIEKMYDVSRMTVRKAIEELVNEGIVSKQQGKGTFVSQTKTTQGLGRIFSWSEEMKLQHKESKTISVEISAAIPSKKIRTALQLGKHEEVTCIRRVREIDGEPVAIMINYLRAKYVPGLLENGLKSDSLYHDLEEIYHISLVHADEIITARLSTPIESALLAVPEDSAVLHVRRTSYMKGNTPVEVVDMVARGDRYQYLAELEGRTKKHII

SEQ ID NO: 10501 - DNA, 735 bp, Listeria monocytogenes
  CDS (1)..(735)
atggttagaaaattaaataagatgaatgatgcgtcgccactttatgcacaaatagcggatgacttacgggaaaaaatccaatcaggaatttggaaaaccggagataaaattccaccagagctggatttatgtgagttatacaacgttagtagaattaccgttcggaaagcaattgatgaactcgttcgtgagaatctactttatagagagcgtgcgaaaggtacttttgtacgtgactgggaagaagcagaggatgagcattttactttggtgcgcagttttacgaatgagatgaaagaacttggtaaaaaagcggctacgctacatgcagaagtagaagtgatcaatgctgataaaaaaattgcgttgcagttggggcttgcagttggggataaggttttacaagttaagcggctacgaggcacgaaagacttggcgtttgctctttttatcagtgcgattccttatcgacaagcgtattcccttcaagcagaagattattacggttctttttatgaatatttgaaaggatttgggattgtcgttaatcaagaaaaggaatatattgaagctatgctaccaaatcgtgaagttcaggaagctttagcaatcgataagcaggaaccaattttaaaaagagtacggatgacgaaacaaaaagaaagtgattttagagaatacagtgaatgcttttatgtaggaaagcattatcgatattatattgattttgaataa

SEQ ID NO: 10502 - protein, 244 aa, Listeria monocytogenes
MVRKLNKMNDASPLYAQIADDLREKIQSGIWKTGDKIPPELDLCELYNVSRITVRKAIDELVRENLLYRERAKGTFVRDWEEAEDEHFTLVRSFTNEMKELGKKAATLHAEVEVINADKKIALQLGLAVGDKVLQVKRLRGTKDLAFALFISAIPYRQAYSLQAEDYYGSFYEYLKGFGIVVNQEKEYIEAMLPNREVQEALAIDKQEPILKRVRMTKQKESDFREYSECFYVGKHYRYYIDFE

SEQ ID NO: 10503 - DNA, 729 bp, Listeria innocua; identical to SEQ ID NO: 2062
  CDS (1)..(729)

SEQ ID NO: 10504 - protein, 242 aa, Listeria innocua; identical to SEQ ID NO: 432

SEQ ID NO: 10505 - DNA, 726 bp, Yersinia pestis
  CDS (1)..(726)
atgaacttatctagaccaccgaccagctatcccacccgctatcaacatattgcggcccagttagagcaggagttgcgcggccattaccgttgtggcgattatctgccctccgaacaacagctcgccgaccgctatcaggttaaccgccataccctgcgccgggcagtggatgaattggtcgagcgcggctggctacaacgccgccagggcatcggcattctggtgctcatgcgcccttatgactacccgctccatgccaatgcgcgtttcagccagaacctactcgatcaaggcagtgaccccaccagtgagcgcttacttgccgttttacgccctgcggctgagcctgttgcaaaagcactctcgctgacagagggggaatcggtcattcatttgcgcaccctgaggcgggttaatggtgtgccggtctgcattatcgatcactacctacccgatctcagttggtggccagttctacaacggtttcactcaggttcactgcatcagttcatcgcacaacatttacaacagcctttgaaacgcagccaaactcgcatcagcgcccggcgtgctcaagccaaagagagtgccctgctggagattgccacccacgcgccgctcctgtgcgtgcgaacgctaaatacccgtgttgatagccaacaggtggcggaatattccctcagcctgacccgcgccgacatgattgaactgaccatggagcactga

SEQ ID NO: 10506 - protein, 241 aa, Yersinia pestis
MNLSRPPTSYPTRYQHIAAQLEQELRGHYRCGDYLPSEQQLADRYQVNRHTLRRAVDELVERGWLQRRQGIGILVLMRPYDYPLHANARFSQNLLDQGSDPTSERLLAVLRPAAEPVAKALSLTEGESVIHLRTLRRVNGVPVCIIDHYLPDLSWWPVLQRFHSGSLHQFIAQHLQQPLKRSQTRISARRAQAKESALLEIATHAPLLCVRTLNTRVDSQQVAEYSLSLTRADMIELTMEH

SEQ ID NO: 10507 - DNA, 726 bp, Bacillus subtilis
  CDS (1)..(726)
atgtctacaaaagctgataatcggcacttgtatttgaaagtaattgaacgaattaaagaggatataaaaaatgggatctacactgagaaggaaaagctgccttctgaatttgagctttccaaaaagcttggtgtcagcagagcgacgctaagagaagccttgcggatactggaagaagagcatgtgattatcagaaggcatggtgtaggcacttttgtccattctaagccgttatttctttcgggtattgaacagctgaacagtgtaaccaagatgatagaacaggcgaatatgacccctggcacgatttttctatcatcacaagtgcttatgccgtctgaagatgatacgaagagatttcacttggcagaagggcaagaacttttttaccttgaacgagtcaggacagctgacggacagccgattgtgtattgtatagacaaaattccgatgaatattttgccgaattctttttctcatcagcaagaatctatgtttgacctgctagagaaaaattcaggctccgtaatcagctatgcagtaactgatatagaaccgatcggctatcacgataccatttctccagtgcttgaatgcgatccggaaacagctcttttgctgttaaaacaaacccattacgatcagcacgataaaccggtgctttattctttaaattattttagagcggataaattcagatttcatgttttgcgtaaacgattctaa

SEQ ID NO: 10508 - protein, 241 aa, Bacillus subtilis
MSTKADNRHLYLKVIERIKEDIKNGIYTEKEKLPSEFELSKKLGVSRATLREALRILEEEHVIIRRHGVGTFVHSKPLFLSGIEQLNSVTKMIEQANMTPGTIFLSSQVLMPSEDDTKRFHLAEGQELFYLERVRTADGQPIVYCIDKIPMNILPNSFSHQQESMFDLLEKNSGSVISYAVTDIEPIGYHDTISPVLECDPETALLLLKQTHYDQHDKPVLYSLNYFRADKFRFHVLRKRF

SEQ ID NO: 10509 - DNA, 729 bp, Bacillus subtilis; identical to SEQ ID NO: 421
  CDS (1)..(729)

SEQ ID NO: 10510 - protein, 242 aa, Bacillus subtilis; identical to SEQ ID NO: 422

SEQ ID NO: 10511 - DNA, 720 bp, Pseudomonas aeruginosa
  CDS (1)..(720)
atgccggtcgatcaatctcgtcagtacctgcgcatccgcgaccagctcgccgcggatatcgcccagggtgtgctgcaagtgaaacttccctccgagcgggagttggccgagcgcttcctgtgtacccgcatcacccttcgcgaagccctgcagcaattggaaaccgaaggcctggtctatcgcgagaaccgccgcggctggttcgtcgcgccgccgcggatccgctacaacccgacccgtaccaccggcttcatggaatacgtcagcgcccagggacgccagccgcgtaccgagacgctgcacgccgagcggcgtgcagccggcgcctggctggccaagcggatggggctggaggacagcgcgccggtgtatttcctgcaacggcgccgctgggtggacgagcgtccggtgctgatcgaactgatcgccctggatgccgggtggtgcccaggcctgctggaccacgacctcgatacttcgctgatgagcctgctgcgcgagcgtttcggcctgcagccgacgcgctgccaactggcgatgcacccgaccgcgctgaacgcggcccaggccgagccgctgcaactggcgccgggttcgccggcgctgtacctggagcgactgagttacgcggaggggcagagggtggtcgagttcgaccaggagttctggcgcccggacgctctggagatcgtgctcgacgcggcctatccgggcgcctga

SEQ ID NO: 10512 - protein, 239 aa, Pseudomonas aeruginosa
MPVDQSRQYLRIRDQLAADIAQGVLQVKLPSERELAERFLCTRITLREALQQLETEGLVYRENRRGWFVAPPRIRYNPTRTTGFMEYVSAQGRQPRTETLHAERRAAGAWLAKRMGLEDSAPVYFLQRRRWVDERPVLIELIALDAGWCPGLLDHDLDTSLMSLLRERFGLQPTRCQLAMHPTALNAAQAEPLQLAPGSPALYLERLSYAEGQRVVEFDQEFWRPDALEIVLDAAYPGA

SEQ ID NO: 10513 - DNA, 747 bp, Bacillus halodurans; identical to SEQ ID NO: 445
  CDS (1)..(747)

SEQ ID NO: 10514 - protein, 248 aa, Bacillus halodurans; identical to SEQ ID NO: 446

SEQ ID NO: 10515 - DNA, 732 bp, Sinorhizobium meliloti
  CDS (1)..(732)
atggcgaaggtcgtcgaacggcagatgggcgtggcgctatggcggcagattgccgacaggatacggctcgcgatcagcaatggcgactatgacgccaccggcatggtgccgccggagacggcccttgcggcggaattcggcgtcaatcgccacaccgtccgcagcgcgctggccgcactcgcggaagaaggtctggtgcgcgcggtgcaggggcgcggcacgatgatcgagcgcaaggatcgcgtgagctatccgatctcgcggcgcactcgcttctcgcagggtctcggccgccaggtgagagaaatcggaaccgagctcctggggcacgcccaagtgccggcaagcggcgaaatcgccactgcgcttggcgttcccccaggcacccctctcatcgagctcagcaccgtcagcagcggcgacgggcggccgctttcgacggcggtcagctactaccccgccgagcgctttgcgaggatggcggaggaatatgcgcagctcggctcggtcaccaaggcctttgccgcgcatgggctcgacgactacgtccgggtctcgacggagatcgtcgcgcggcacgcggaggcagaggaactctcgcttctgaaactatcgccgggggcgatcgtcatggagacgcaatcggtcaacgccgatctagaaggccgcccggtcgaatattcgcgaacgcgctttgcagccgaccgggtgaagctccggatcgagacttga

SEQ ID NO: 10516 - protein, 243 aa, Sinorhizobium meliloti
MAKVVERQMGVALWRQIADRIRLAISNGDYDATGMVPPETALAAEFGVNRHTVRSALAALAEEGLVRAVQGRGTMIERKDRVSYPISRRTRFSQGLGRQVREIGTELLGHAQVPASGEIATALGVPPGTPLIELSTVSSGDGRPLSTAVSYYPAERFARMAEEYAQLGSVTKAFAAHGLDDYVRVSTEIVARHAEAEELSLLKLSPGAIVMETQSVNADLEGRPVEYSRTRFAADRVKLRIET

SEQ ID NO: 10517 - DNA, 810 bp, Mycobacterium tuberculosis
  CDS (1)..(810)
atgacatctgtcaagctggacctggacgctgccgatctgcggatatcgcgtggcagcgtgccggcgagtacccagcttgccgaggcgctaaaggcccagatcatccagcagcggctgccgcgcggcgggcgcttgcccagcgaacgagaattgatcgaccgttccggtttgagccgcgtgaccgtgcgcgcggcggtcggcatgctgcaacgtcagggatggctagtgcgccggcaaggcttgggtaccttcgtcgccgatccggtggaacaggagctcagttgcggcgtgcgcaccatcacagaggtgttgttgagctgtggtgttaccccgcaggtcgacgtgctgtcacaccagaccggaccggcgccgcaacggatttccgagacgctgggtttggttgaggtcctctgtattcgccggcgcatccgcactggcgatcaacccttggccctggtcacggcctatcttccgcccggcgtgggcccagccgtcgagccgttgctatcgggcagcgcggacaccgaaaccacatatgcgatgtgggagcggcgactgggtgtacgcattgcacaggctacccacgaaatccatgccgccggggcctcccccgacgtagccgacgcgttgggtctggcggtgggttcgccggtactggtcgtcgaccgcaccagctacaccaatgacggcaagccccttgaagtggtcgtgttccaccatcgccccgagcggtaccagttctccgtcacgttaccccgaacgttgcccggatcaggtgccggaattatcgagaaacgagatttcgcatga

SEQ ID NO: 10518 - protein, 269 aa, Mycobacterium tuberculosis
MTSVKLDLDAADLRISRGSVPASTQLAEALKAQIIQQRLPRGGRLPSERELIDRSGLSRVTVRAAVGMLQRQGWLVRRQGLGTFVADPVEQELSCGVRTITEVLLSCGVTPQVDVLSHQTGPAPQRISETLGLVEVLCIRRRIRTGDQPLALVTAYLPPGVGPAVEPLLSGSADTETTYAMWERRLGVRIAQATHEIHAAGASPDVADALGLAVGSPVLVVDRTSYTNDGKPLEVVVFHHRPERYQFSVTLPRTLPGSGAGIIEKRDFA

SEQ ID NO: 10519 - DNA, 717 bp, Pseudomonas aeruginosa
  CDS (1)..(717)
atgcgtgacgaagcgctacccaccgtaacggcgatctgccgggcgctcagcgagcagatcggccatggtctgctgccggcgggtggcaagctgccggccgagcgcaagctcagcgagctgttcgcgacgacccggatcaccctgcgcgaggcgctaatccaactggagtcgcagggcctgatctatcgcgaggagcgccgcggctggttcgtctcccccgagcggctggcctacaacccgctggtccgcagtcacttccatgcgatggtcagcgaacagggccgggtgccggcgaccgaggttctgtcggcccggcagatgccggcgagcgcggcggtctgcgagctgctggagctgccggcgctgtccagcgtctaccagatccgccgggcgcggcgggtggacgggcggctggtgctgtatgtcgagcactacctgaacgcgcagtacttccccggaatcctcggccacgacctgacccgctcgctgaccgaactctatgccagcgagtacggcatccactatgggcgggtgcgtttcgacatggtgcccaccgcactgcatgccgaggctgcggcgccgctgaaggtggcggtgggcagcccggccctgcgcatcagccggatcaaccgcgaccagcgtggtcggctgatcgactgcgacctggagttctggcgccacgacgccatccatatcagcgtcgaggtaccgcagtaa

SEQ ID NO: 10520 - protein, 238 aa, Pseudomonas aeruginosa
MRDEALPTVTAICRALSEQIGHGLLPAGGKLPAERKLSELFATTRITLREALIQLESQGLIYREERRGWFVSPERLAYNPLVRSHFHAMVSEQGRVPATEVLSARQMPASAAVCELLELPALSSVYQIRRARRVDGRLVLYVEHYLNAQYFPGILGHDLTRSLTELYASEYGIHYGRVRFDMVPTALHAEAAAPLKVAVGSPALRISRINRDQRGRLIDCDLEFWRHDAIHISVEVPQ

SEQ ID NO: 10521 - DNA, 723 bp, Bacillus halodurans; identical to SEQ ID NO: 433
  CDS (1)..(723)

SEQ ID NO: 10522 - protein, 240 aa, Bacillus halodurans; identical to SEQ ID NO: 434

SEQ ID NO: 10523 - DNA, 714 bp, Bacillus halodurans; identical to SEQ ID NO: 427
  CDS (1)..(714)

SEQ ID NO: 10524 - protein, 237 aa, Bacillus halodurans; identical to SEQ ID NO: 428

SEQ ID NO: 10525 - DNA, 705 bp, Staphylococcus aureus
  CDS (1)..(705)
atgttaaagtatgaacatattgctaagcaacttaatgcgtttatacatcaatctaatttcaaacccggtgataaattgccaaacgtgacgcaattaaaagaacgttatcaagtaagtaagagtactatcattaaagcattaggcttattggaacaagatggtttgatctatcaagcacaaggcagtggtatttatgtgagaaatattgcagatgccaatcgtatcaacgtctttaagactaatggtttctctaaaagtttaggtgaacatcgaatgacaagtaaggtacttgtttttaaggagatggcaacgccacctaaatctgtacaagatgaactccaattaaatgcagatgataccgtctactatttagagcgattaagattcgtggacgatgatgttttatgtatcgaatattcttattatcataaagaaatcgtgaaatatttaaatgatgatattgctaagggctctatcttcgattatttagaatcaaacatgaaacttcgtattggtttttcagatattttctttaatgtagataaactcacttcaagtgaagcttcattactacaattgtctacaggtgaaccatgtttacgttaccaccagactttttatacaatgactggcaaaccctttgattcgtctgacatcgtatttcattatcgtcatgcacagttttatattcctagtaaaaagtaa

SEQ ID NO: 10526 - protein, 234 aa, Staphylococcus aureus
MLKYEHIAKQLNAFIHQSNFKPGDKLPNVTQLKERYQVSKSTIIKALGLLEQDGLIYQAQGSGIYVRNIADANRINVFKTNGFSKSLGEHRMTSKVLVFKEMATPPKSVQDELQLNADDTVYYLERLRFVDDDVLCIEYSYYHKEIVKYLNDDIAKGSIFDYLESNMKLRIGFSDIFFNVDKLTSSEASLLQLSTGEPCLRYHQTFYTMTGKPFDSSDIVFHYRHAQFYIPSKK

SEQ ID NO: 10527 - DNA, 747 bp, Escherichia coli
  CDS (1)..(747)
atggaacaagcgcatacccagctgattgcccaactgaacgagcgtattttagcggcggataacacgccgctttatattaagtttgccgaaacggtaaaaaatgccgtgcgcagcggggtgctggagcatggcaatattttgcccggtgagcgtgatttaagtcagttaaccggcgtttcgcgcattacggtgcgcaaggcgatgcaggcgctggaagaagagggtgtggtgacgcgttcgcgcggttacggcacgcagatcaacaacatcttcgaatactcgttgaaagaagcgcgaggtttttctcagcaggtggtattgcgcgggaaaaagcccgatacgctatgggttaacaagcgtgtcgtgaaatgtcccgaagaagtcgcgcagcagctggcggtcgaagcaggaagtgatgtctttttgcttaagcgtattcgctatgtcgatgaagaagcggtatcgattgaggaatcgtgggttccggcgcatttaattcatgatgttgatgccatcgggatttcactttatgactatttccgcagccagcacatttacccacaacgtacgcgttcccgcgttagcgcccggatgccggatgccgagtttcagtcacatattcagttagatagcaaaataccggtgctggtgatcaagcaagtggcgcttgaccaacagcaacggcctattgagtacagcattagccactgtcgcagcgatctatacgtttttgtgtgcgaggagtag

SEQ ID NO: 10528 - protein, 248 aa, Escherichia coli
MEQAHTQLIAQLNERILAADNTPLYIKFAETVKNAVRSGVLEHGNILPGERDLSQLTGVSRITVRKAMQALEEEGVVTRSRGYGTQINNIFEYSLKEARGFSQQVVLRGKKPDTLWVNKRVVKCPEEVAQQLAVEAGSDVFLLKRIRYVDEEAVSIEESWVPAHLIHDVDAIGISLYDYFRSQHIYPQRTRSRVSARMPDAEFQSHIQLDSKIPVLVIKQVALDQQQRPIEYSISHCRSDLYVFVCEE

SEQ ID NO: 10529 - DNA, 732 bp, Bacillus subtilis; identical to SEQ ID NO: 425
  CDS (1)..(732)

SEQ ID NO: 10530 - protein, 243 aa, Bacillus subtilis; identical to SEQ ID NO: 426

SEQ ID NO: 10531 - DNA, 750 bp, Pseudomonas aeruginosa
  CDS (1)..(750)
atgggcaaactgctcccgctttctcccgtgccgctgtacagccagctcaaggagctgctgcgcgggcgcatcctcgacggcgtctacccgccgctcagccgcatgccctcggagaacgagctgggcaaggccttcgacgtcagccgcatcaccgtgcgccaggcgctcggcgacctgcagaaggaagggctgatcttcaagatccacggcaagggcaccttcgtcgcccggccgaaggcgttccagaacgtcagcaccctgcaaggcctgggcgagtccatgacgcagatgggctacgaggtcatcaaccgcctgcacggcctgcgctacgtgccggccggcgcgcgggtggccgagcgcctgcgggtggaagagggcagccctgtgtgcgagatcaagcgggtgcggctggtcaaccgcgagccggtttcgctggaagtcacctacctgccgcaggcgctcggcgagcgcctggagaaggccgacctggtgacccgcgacatcttcctgatcctcgagaacgattgcggcattcccctcggccatgccgacctggccatcgacgcggtgctcgccgatgccgacctgacccgcgccctggcggtcgaggagggcgcgccgatcatgcgtatcgagcgcctgacccatgccgccgacggcgcgccgctggacttcgaatacctctactaccgcggcgacgctttccagtatcgcctgcgcatcgatcggcagaagggagagcgggcatga

SEQ ID NO: 10532 - protein, 249 aa, Pseudomonas aeruginosa
MGKLLPLSPVPLYSQLKELLRGRILDGVYPPLSRMPSENELGKAFDVSRITVRQALGDLQKEGLIFKIHGKGTFVARPKAFQNVSTLQGLGESMTQMGYEVINRLHGLRYVPAGARVAERLRVEEGSPVCEIKRVRLVNREPVSLEVTYLPQALGERLEKADLVTRDIFLILENDCGIPLGHADLAIDAVLADADLTRALAVEEGAPIMRIERLTHAADGAPLDFEYLYYRGDAFQYRLRIDRQKGERA

SEQ ID NO: 10533 - DNA, 744 bp, Caulobacter crescentus; identical to SEQ ID NO: 2076
  CDS (1)..(744)

SEQ ID NO: 10534 - protein, 247 aa, Caulobacter crescentus; identical to SEQ ID NO: 442

SEQ ID NO: 10535 - DNA, 729 bp, Streptococcus pneumoniae
  CDS (1)..(729)
atgagtacaaaatatttatttatttacaatgagattcgtgaaaagattctttgtaataaatataccatgaacgaacaattgcctgatgaaatgacattagctaaacagtttgcctgtagtcgaatgacgatcaaaaaagctttagacttgttagtttctgagggcttaatttttagaaaacgtgggcagggaacctttgttctctctcgtggcagctcaaaaagaaaattaatcgttccagaaagagatatccggggactgacaaaaatatctgaagatgctcattctacaattgactcgaggattattcacttcaaattagaatttgcaaatgaatttttagcagaaaaactacaggtcgctttgcagagtccagtttataatatttaccgcctgcgtattattgacggtaaaccttatgttctggaacaaacttatatgagtaccgatgttattccaggtattactgaagatattttacaaaaatcgatttacaattacattgaaggaaagttaggattgcatattgccagtgctacaaaaatcttgcgagcttcttctagttcagaaaatgagcaacattacttgcagctccttccaacggaaccggtatttgaagtagaacaagtggcttatttggataacggaactccgtttgagtactcgattagtcgtcatcgctatgatttatttgaatttaattcttttgcattacgacattcctcctag

SEQ ID NO: 10536 - protein, 242 aa, Streptococcus pneumoniae; identical to SEQ ID NO: 438

SEQ ID NO: 10537 - DNA, 708 bp, Streptococcus pneumoniae; identical to SEQ ID NO: 2082
  CDS (1)..(708)

SEQ ID NO: 10538 - protein, 235 aa, Streptococcus pneumoniae; identical to SEQ ID NO: 450

SEQ ID NO: 10539 - DNA, 714 bp, Bacillus subtilis
  CDS (1)..(714)
atgaataaatacgaaatcattgcaaatgaaatgagaaatagaattaaaaataacgtatatccgatcgatcagcccattcctgatgaagtatctcttgcaaaagaatttaactcaagccgcatgacgatgaagagagccttggataatttagttgccgagggtctgctgtttagaaaacgaggccatggcacgtttattattcaatctgcaatacaggatgaccatgtccatgtagtcagcaatgagattctcggattgaccaacttgctgaaagataaaaaaatcaaaagcaaggtcattcagtttgaagtgcaatttcccactgaggaagtggccgcccatttgtctattgatcagaaaacaccggtttattatgtcgttcggctgcgaattgtagaaggtgaaccctatgtattagaaaaaacatatatgccgactcatttaataccgggcattaatgacgatgtccttcatgattcgatctacaatcatattacaaatgtgctgcagctcaaaatcgccggaacgcatcggaaaatcagagcctgcaaatctgatcatattgaccagcagcatctgggctgtaaacaggatgatccaattcttgaagtggaacatgtgggcttcttagataccgggattccatttgaatattccttttcacgtcatcggcatgacaagtttgttgtgacttctgtaaacatacggcgctga

SEQ ID NO: 10540 - protein, 237 aa, Bacillus subtilis
MNKYEIIANEMRNRIKNNVYPIDQPIPDEVSLAKEFNSSRMTMKRALDNLVAEGLLFRKRGHGTFIIQSAIQDDHVHVVSNEILGLTNLLKDKKIKSKVIQFEVQFPTEEVAAHLSIDQKTPVYYVVRLRIVEGEPYVLEKTYMPTHLIPGINDDVLHDSIYNHITNVLQLKIAGTHRKIRACKSDHIDQQHLGCKQDDPILEVEHVGFLDTGIPFEYSFSRHRHDKFVVTSVNIRR

SEQ ID NO: 10541 - DNA, 840 bp, Deinococcus radiodurans
  CDS (1)..(840)
atgtggtccaataacaagaccttttcagaattggtccgcaagtggtacggttgcgccgtgtcctcgcctgcccctttgccgcccgagccgcccgcgtggtgggtcgcgctcgaccctgccgacgcggcccccgcctacgtgcagctcgcgcaggggctgcggcggcgcatcgagagtggcgagctgagcgcgggcaccgccctgcccgccgaacgcgaactcgcggcgcggctcggcgtgtcgcgggtcacgctgcggcaagggctggggctgctcgaagccgagggactgctgaggcggcggcgcggcagcggcaccttcgtagcgggcacgccgcacacctcgcgccagcttgggctgctgagttccttttccgacgaggtgcgcgcccagggcggggtgccgggtgcccgcgtcctgagcttcacgcagggccgccccacgccccaggaagcgctgagtctgggcctgaccgccgccgagcaggtctaccgcctgcgccggcttcgcacctcggacggcgacccgctggcggtggaagacagcacgctgcccgccgccctgattggcccgctgacggcgcaggacgtgaccgacgccagcctgtacgggctgctgggccagcggcacctcgccccggcgcgcgccattcggcacctgcgggcgcaaaacgcctcggcggaactcgcgcacctcctcggcgtgccgctcggcgccgcgctgctcaccaccgagcgggtgtcgtggctcgcctccggacgcccggtggagtacgcccgcgcctgctaccggggcgaccgctacgacttcgtgatggacctgcgcggagaggaccactga

SEQ ID NO: 10542 - protein, 279 aa, Deinococcus radiodurans
MWSNNKTFSELVRKWYGCAVSSPAPLPPEPPAWWVALDPADAAPAYVQLAQGLRRRIESGELSAGTALPAERELAARLGVSRVTLRQGLGLLEAEGLLRRRRGSGTFVAGTPHTSRQLGLLSSFSDEVRAQGGVPGARVLSFTQGRPTPQEALSLGLTAAEQVYRLRRLRTSDGDPLAVEDSTLPAALIGPLTAQDVTDASLYGLLGQRHLAPARAIRHLRAQNASAELAHLLGVPLGAALLTTERVSWLASGRPVEYARACYRGDRYDFVMDLRGEDH

SEQ ID NO: 10543 - DNA, 717 bp, Pseudomonas aeruginosa
  CDS (1)..(717)
atgcgcgacgagccgtcccgccccctgacggtgatctaccagtccctgcgcgagcagatcgagcgcggcctgctcgcgcgcggcagcaagctgcccagcgaacggcaattgagcgagctgttctcgaccacccgcatcaccctgcgcgaggcgctcggccagttggaggaccagggcctgatctaccgcgaggaacgccgcggctggttcgtctcgccgcagcggctgctgtacaacccgctggtgcgcagccacttccacgcgatggtcgccgaccagggccgggtgccggagaccgaggtgctcggcgcggcgatgatcccggccagcgtcgacatctgccagcgcctggagctgccggcgctgtcgcgggtgttccagatccgccgggcgcggcgggtcgacgggcggctggtgctgtacgtcgagcactacctgaatcccgcctactttcccggcatcgagcgcttcgacctgactcgctcgctgaccgatctctacgccaaccactacggcatccgctacggccgggtgcgcttcgagatggtcccgaccatcctcccggcggaagccgccgggccgctgcgggtttcggtgggcagcccggcgctgcagatcgtgcgggtcaaccgcgaccaggcgggccgcctgatcgactgcgacctggagtactggcgccacgacgcgctacaggtcaacgtcgaggtgcccgagtag

SEQ ID NO: 10544 - protein, 238 aa, Pseudomonas aeruginosa
MRDEPSRPLTVIYQSLREQIERGLLARGSKLPSERQLSELFSTTRITLREALGQLEDQGLIYREERRGWFVSPQRLLYNPLVRSHFHAMVADQGRVPETEVLGAAMIPASVDICQRLELPALSRVFQIRRARRVDGRLVLYVEHYLNPAYFPGIERFDLTRSLTDLYANHYGIRYGRVRFEMVPTILPAEAAGPLRVSVGSPALQIVRVNRDQAGRLIDCDLEYWRHDALQVNVEVPE

SEQ ID NO: 10545 - DNA, 786 bp, Bacillus halodurans
  CDS (1)..(786)
atggtcgaccctgaccatctttttttacggatcaatcaaagtcttttgcaaaaggtgggtggggatgcgatgaaaaagtacgaggccatttcaatggaaataaaaaagagaataaaagaaaacgactatcctgtagatcaaccgataccagatgaaatctccctttcaaaagagtttggctgtagccggatgacgatgaaaagagcgctggacattttggttatggaagggcttctttatcgaaagcgagggcatgggacgtttattgttcaatcggccatccatacgagccgtgtcaatgtactgaccaatgaagttaaagggttgtccaatttgttaaaggataaacaggtaacgagtaaagtaatccaatttaatgtggagtttccagcggaagaagtggcagcccatttagccattgaccaaaaaacgccagtctatcatattatccgcttacggctcgtcgacggtgagccttatgtgatagagaaaacgtacatgccgaccccgctcattccagggattaatgatgaggtgttgcacggctcgatctattcttatctgattgacaagttagggttaacgatagccggatctcaccggaaaattcgtgcctgtaaagcagaggcgttagagatagaacatttgcattgtgaagcggatgatccgattttggaagtggaacatgtaggtttcttaaataatggtgtgccgttcgaatattccttttctcgtcatcggtacgataaatttgaggtgacgaccatcaatatgaaacggtcctag

SEQ ID NO: 10546 - protein, 261 aa, Bacillus halodurans
MVDPDHLFLRINQSLLQKVGGDAMKKYEAISMEIKKRIKENDYPVDQPIPDEISLSKEFGCSRMTMKRALDILVMEGLLYRKRGHGTFIVQSAIHTSRVNVLTNEVKGLSNLLKDKQVTSKVIQFNVEFPAEEVAAHLAIDQKTPVYHIIRLRLVDGEPYVIEKTYMPTPLIPGINDEVLHGSIYSYLIDKLGLTIAGSHRKIRACKAEALEIEHLHCEADDPILEVEHVGFLNNGVPFEYSFSRHRYDKFEVTTINMKRS

SEQ ID NO: 10547 - DNA, 708 bp, Lactococcus lactis subsp. lactis; identical to SEQ ID NO: 443
  CDS (1)..(708)

SEQ ID NO: 10548 - protein, 235 aa, Lactococcus lactis subsp. lactis; identical to SEQ ID NO: 444

SEQ ID NO: 10549 - DNA, 708 bp, Bacillus subtilis
  CDS (1)..(708)
atgacagctttatattctgttatcaagtttaaaatcattgagttaattaaatcgggcaaatatcaggcgaatgatcagctgccgacggagagtgagttttgcgaacaatatgatgtcagcagaacaactgtgagactggctctgcagcagctagagcttgagggatatattaaaagaattcaaggaaaagggacatttgtatcggcggccaaaatacaaacgccgattccgcataagattacgagctttgcagaacaaatgagaggacttcgttctgaatcaaaagtgcttgagcttgtggtgattcctgccgatcattccatcgccgagcttttgaaaatgaaagagaatgaacctgtcaacaagcttgtcagagtcagatacgccgagggggaacctttgcagtatcatacctcatatattccctggaaggcggcaccggggctggcgcaggaggaatgcaccggctcgctgtttgaattgttaaggacaaaatacaatattgaaatcagcaggggcacggaatcgatcgaaccgattttaacggatgaaacgatcagcggacacttattaaccaatgtcggagcgcctgcgtttttatcagaatcccttacctatgataaaaatgaagaagtggtggaatatgcgcaaattattacacggggagaccgaacgaaattcaccgtagaacagtcatatcattcataa

SEQ ID NO: 10550 - protein, 235 aa, Bacillus subtilis
MTALYSVIKFKIIELIKSGKYQANDQLPTESEFCEQYDVSRTTVRLALQQLELEGYIKRIQGKGTFVSAAKIQTPIPHKITSFAEQMRGLRSESKVLELVVIPADHSIAELLKMKENEPVNKLVRVRYAEGEPLQYHTSYIPWKAAPGLAQEECTGSLFELLRTKYNIEISRGTESIEPILTDETISGHLLTNVGAPAFLSESLTYDKNEEVVEYAQIITRGDRTKFTVEQSYHS

SEQ ID NO: 10551 - DNA, 726 bp, Escherichia coli
  CDS (1)..(726)
atgcacttgtctacacatccgaccagctacccaacacgctatcaagagatagccgcaaaacttgagcaggagcttcgtcaacactaccgctgcggcgactatcttcccgccgagcagcaactggcagcgcgctttgaggtgaatcgccacaccctgcgccgcgccatcgaccaactggtggaaaaaggctgggtacagcgccgtcagggcgtcggcgtgctggtgctgatgcgcccgttcgattacccgctcaacgcccaggcgcgttttagccagaatctgctggatcagggcagccatcccaccagcgaaaaactgctttcggtattgcgccccgcgtccggccacgtcgctgacgcactggggattaccgagggggagaacgtcatccacctgcgcaccctgcgtcgtgtcaacggcgtcgcgctctgtttaatcgaccactacttcgcggacctcaccctctggccgacgctgcaacgcttcgacagcggctcgctgcacgattttctgcgcgagcaaaccggaattgcgctgcgccgcagccagacgcggatcagcgcccgccgcgcccaggccaaagagtgccagcgtcttgaaatcccgaatatgtcgccgctgctgtgcgtgcgcacccttaaccaccgtgacggtgaaagcagcccggcggagtactccgtcagcctgacgcgcgccgacatgattgaattcactatggagcactga

SEQ ID NO: 10552 - protein, 241 aa, Escherichia coli
MHLSTHPTSYPTRYQEIAAKLEQELRQHYRCGDYLPAEQQLAARFEVNRHTLRRAIDQLVEKGWVQRRQGVGVLVLMRPFDYPLNAQARFSQNLLDQGSHPTSEKLLSVLRPASGHVADALGITEGENVIHLRTLRRVNGVALCLIDHYFADLTLWPTLQRFDSGSLHDFLREQTGIALRRSQTRISARRAQAKECQRLEIPNMSPLLCVRTLNHRDGESSPAEYSVSLTRADMIEFTMEH

SEQ ID NO: 10553 - DNA, 723 bp, Pseudomonas aeruginosa
  CDS (1)..(723)
atgcgccctttccaaaccatgcacttgtctagacaaagcgaaccgctgtaccgcgaactggccgaacggctgcgccaggaactgctggcctaccgccccggcgactacctgcccggcgagatccagctggcccagcgcttcgcggtgaaccgccataccctgcgccgggcgctcgacgaactggtgctcgaaggccgcgtgctgcggcgccagggcaagggcacccaggtcctggaggcgccgacgatctacccgatgggcgccgccaacgcctacaccgagtcgctctcggcccagggccaccgggtcgaggcccggctgctggaggcgcgccagcgtccggccggcgccgtcgaggccacccacctggggatcggcgagggcgggcgggtgctggaactgaccaccctgcgttacctcgacggacagccagtgagcctgatccgccattgctacgccgtttcccgcagcgagctgctcgccgactaccagggcggttcgctgcgtcgctacctggccgacaaaggcctgccgctgacccgcacctacagcctgatcggtgcgcgcctgcccaatcgcgaggaggcggcgcgcctgctgatgccccgccatgcgccgttgctcaccgtcctcaccctgtcccgcgaccgtaccggccaaccggtggaactggcccagtcgatcagccgcgccgatcgcttccagtaccaggtcgccccctag

SEQ ID NO: 10554 - protein, 240 aa, Pseudomonas aeruginosa
MRPFQTMHLSRQSEPLYRELAERLRQELLAYRPGDYLPGEIQLAQRFAVNRHTLRRALDELVLEGRVLRRQGKGTQVLEAPTIYPMGAANAYTESLSAQGHRVEARLLEARQRPAGAVEATHLGIGEGGRVLELTTLRYLDGQPVSLIRHCYAVSRSELLADYQGGSLRRYLADKGLPLTRTYSLIGARLPNREEAARLLMPRHAPLLTVLTLSRDRTGQPVELAQSISRADRFQYQVAP

SEQ ID NO: 10555 - DNA, 906 bp, Caulobacter crescentus
  CDS (1)..(906)
atggcaaggacaccctttcatggcccgcgaatttgctgctataacggcatatgttcgcgaggcttcgaggtcagccgtcttgatctaccgatggtcgattggtctcacattggcatcccgcgaagccacctttcggaagcccccgaacgcaggagtcggcgcgacgtgtctctttccaagcgcataggcttcgcccacggcgcggtgcccgctcctctgtacctgcaactgcagcgcgcgctgcgcgaggcgatcgaagtcaaggtgctggcgcccgacgacgcccttccgccggaacgcgacatggccgaggacttcgccgtgtcgcggatcacggtccgcaaggcgctggagggcctggtcagcgaaggcctgctgacccgtcgccagggcgcgggcactttcgtggccgcccgggtcgagaagaacttttcgaagctgacctgcttcaccgaggacatgcgctcacgcggccgtgcgcccgccagcgagtggatcacccgcgccgagggcgcggtgaccccggaagaggccttgatgctgggcgtctcgcccaacacgccggtctatcgctttcaccgcattcgcatcgccgacggcgcgccgatggcggtcgagtatacgaccatcgccggcttcgccctgccctcggccgacgccgtcaaggactccctctacgaggccatggccgcgacgggccatcgaccaacccgcgccctgcagcgcctgcgcggggtgctgatctcgcgagagcacgcctcgctgctgggcgtgaagccgaaggacgccgggctgctggtcgagcgacgcggctacctgcgggacgggcgggccgtcgaaatctcgcattcctactatcgaggcgacgcctacgatttcgtcgccgaactgaacgacgcaacctga

SEQ ID NO: 10556 - protein, 301 aa, Caulobacter crescentus
MARTPFHGPRICCYNGICSRGFEVSRLDLPMVDWSHIGIPRSHLSEAPERRSRRDVSLSKRIGFAHGAVPAPLYLQLQRALREAIEVKVLAPDDALPPERDMAEDFAVSRITVRKALEGLVSEGLLTRRQGAGTFVAARVEKNFSKLTCFTEDMRSRGRAPASEWITRAEGAVTPEEALMLGVSPNTPVYRFHRIRIADGAPMAVEYTTIAGFALPSADAVKDSLYEAMAATGHRPTRALQRLRGVLISREHASLLGVKPKDAGLLVERRGYLRDGRAVEISHSYYRGDAYDFVAELNDAT

SEQ ID NO: 10557 - DNA, 732 bp, Clostridium acetobutylicum; identical to SEQ ID NO: 2090
  CDS (1)..(732)

SEQ ID NO: 10558 - protein, 243 aa, Clostridium acetobutylicum; identical to SEQ ID NO: 448

SEQ ID NO: 10559 - DNA, 720 bp, Salmonella typhimurium
  CDS (1)..(720)
atgaaatctatcccgggcgatatcccgcagtacctgttgatcaaggcgcagcttcaggcgcgtattcagagcggtgcgttgaaaagcggtgataaactgccgtctgaacgcgaactgtgcgcgatcttcaacaccacgcgcattactattcgcgaaagtctggcacagctggagtccagtgggcttatctggcgcgccgatcgtcgcggttggttcgttacgccggaacgcctgtggctggatccgacccagaacaccaacttccataagctttgccgcgagcaggggcgggagccaaaaaccgcgctactgagcggcgtgttaaccaccgtgcctgtcgaggtcatggagcccctccagctccagccgtttgatcaaatctatctgctgacccgtctgcgttacgccgatggccgcgccgtgtgctactgcgaaaaccattgtttgcccgcccgcgtgcctgagctgctgcagtacgatctcaacggcagcctgaccgaggtatacgagtcgcactacaacctcgtctataccagcatgcatctgtcgttctaccccaccgccatgcctgcgcaggccgcacaggcgctgggcgttatggaagggcgcccggcgctgttgctgcgccgtctgaactacgatcaacacgggcgagtgctggatctggatatcgaatactggcgtcacgacagcctgcgtattgaggtagatacccactag

SEQ ID NO: 10560 - protein, 239 aa, Salmonella typhimurium
MKSIPGDIPQYLLIKAQLQARIQSGALKSGDKLPSERELCAIFNTTRITIRESLAQLESSGLIWRADRRGWFVTPERLWLDPTQNTNFHKLCREQGREPKTALLSGVLTTVPVEVMEPLQLQPFDQIYLLTRLRYADGRAVCYCENHCLPARVPELLQYDLNGSLTEVYESHYNLVYTSMHLSFYPTAMPAQAAQALGVMEGRPALLLRRLNYDQHGRVLDLDIEYWRHDSLRIEVDTH

SEQ ID NO: 10561 - DNA, 768 bp, Yersinia pestis
  CDS (1)..(768)
atggcagaacaatcaacggttttacaattgagcgcagcaatggacgacattcctgcaccaatttaccaacgggttaaattggccattattcgccagatcagaacaggaacctggcagccccaccaacgcgtgccatcagaaagtgaactggtgaccgagttaggggtcagccgtatgacgatcaaccgtgctctacgtgaactcaccaatgaaggtttccttatccgcatgcaaggtgttggtactttcgttgctgaagcgaaagcccacagtgctctacttgaagttcataatattgccgatgaaatcgccgcccgtggtcaccgccatagcagtcaagttctgcatctggaggctcgccctgcaagccccgaagaagccatcgcgctaggcattcaaccgggtcaacaactgttctattcacaaatagtgcactatgagaatgatttccccgttcaggttgaaaaccgttgcgtaaacccaagtaccgcccccgattatatgaaacaggatttcaaccaaatcaccccgtacagctacctgacacaagccgccccgctcaccgaaggtgaacacattgttgaagccgtaatgccaagcccaatcgagcgacaactactggaactgagtgaacatgaaccttgcttgttgatccgccgtagaacttggtatgggaaagccatcgtcaccgccgcacaattgctctatccaggccctcgttatcagctctatggtcgttttaccccacaaggtacggtgacgtcctga

SEQ ID NO: 10562 - protein, 255 aa, Yersinia pestis
MAEQSTVLQLSAAMDDIPAPIYQRVKLAIIRQIRTGTWQPHQRVPSESELVTELGVSRMTINRALRELTNEGFLIRMQGVGTFVAEAKAHSALLEVHNIADEIAARGHRHSSQVLHLEARPASPEEAIALGIQPGQQLFYSQIVHYENDFPVQVENRCVNPSTAPDYMKQDFNQITPYSYLTQAAPLTEGEHIVEAVMPSPIERQLLELSEHEPCLLIRRRTWYGKAIVTAAQLLYPGPRYQLYGRFTPQGTVTS

SEQ ID NO: 10563 - DNA, 726 bp, Lactobacillus rhamnosus
  CDS (1)..(726)
atggcacatctggatataggtcagttggttcaacggattttagctgacattcaggttggtaagttggcggatggacaacgtaaattacctgccgaaccagtcttaatggaaaggtatcaagtaacccgttatacattgcgccaagcgttaaagcagcttagcaacatgggttatacttatcaaatgcatggtatcggaacattcgtccgacagcaacagactaataattcaatagctttacaacatgatggtggactatcagaagctgctgcgcgtgcaggattgaaacttgcaactaagaaggcagtgatggcgatgactactgttgctgatgctgagttcttaccggaagcaggtcatcttaaagataatgaggaattaattgatattcggcgttttcgagaattggatggtcaaccatatttgatggaacattcgtactatataaaagcaatcgtagatacgattcctgaagaagcattgtatggttcattgttcaattattttgaacaacaacgagacgtcaatattggctttattgatcaattactgatgagtgagccactaccagaaattgccggggagtttatgaatctagcaaatggggcacccagtctagtagttaaggatgaaacatatttaactaccggaaagatgttggcattttcaaagcaatattatgattatcgacgagcacggttatttatggttaagaagattcgttag

SEQ ID NO: 10564 - protein, 241 aa, Lactobacillus rhamnosus
MAHLDIGQLVQRILADIQVGKLADGQRKLPAEPVLMERYQVTRYTLRQALKQLSNMGYTYQMHGIGTFVRQQQTNNSIALQHDGGLSEAAARAGLKLATKKAVMAMTTVADAEFLPEAGHLKDNEELIDIRRFRELDGQPYLMEHSYYIKAIVDTIPEEALYGSLFNYFEQQRDVNIGFIDQLLMSEPLPEIAGEFMNLANGAPSLVVKDETYLTTGKMLAFSKQYYDYRRARLFMVKKIR

SEQ ID NO: 10565 - DNA, 705 bp, Vibrio vulnificus
  CDS (1)..(705)
atgcaatacgtaaaaattaaagattcgattgttgaacagattgaagcgggcatgttagcgccaagacaaaagttgccagcagagcgcaaattggcagagtcgtttgataccacacgagttacgctacgcgaggcgttgtctttattggaagcggaaggtcgaatctatcgcgaagaccgccgaggttggtttatctcgcctgtaccgttgcgttacgacccaactcaaacactgaattttaccaatatggcgttagcgcagaatcgagtgccgaaaacacaactgctcggcgcaaaagcgattttagctaacaaagtggcggctcgcttacttaaccttcagccattttctgatgtgttccgtgttgatcgtgtgcgttatcttgaagaccgcccggtagtgtacgtaacaaattacgttcgccctgagttgtttcccaatctgttagaccacgatttatcgaactcactgacggatatctatcgtgagcactttggggtcagctatcaaaaaacgcgctaccgcatttctaccagtaccttgctcggagagatggctcaggcgctacgtgcaacttctgggacaccagcaatggtggtggagcgcattaactacaatcagcatggcgagctcattgactgcgatattgaatattggcgtcatgatgccatttgtatcgagtctctcgcagaattggcaagatga

SEQ ID NO: 10566 - protein, 234 aa, Vibrio vulnificus
MQYVKIKDSIVEQIEAGMLAPRQKLPAERKLAESFDTTRVTLREALSLLEAEGRIYREDRRGWFISPVPLRYDPTQTLNFTNMALAQNRVPKTQLLGAKAILANKVAARLLNLQPFSDVFRVDRVRYLEDRPVVYVTNYVRPELFPNLLDHDLSNSLTDIYREHFGVSYQKTRYRISTSTLLGEMAQALRATSGTPAMVVERINYNQHGELIDCDIEYWRHDAICIESLAELAR

SEQ ID NO: 10567 - DNA, 705 bp, Chromobacterium violaceum
  CDS (1)..(705)
atgaacaaataccatcaaatctattccgacatcgtcgccgacatcgacaaccggcgctacgcccagggcgagcgcatcccgtcagaatccgagctgatgcaccactacgacgccagccgcggcaccgtgcgcaaggcggtggacatgctgcaggaacggggctacgtgcagaaaatccacggcaagggcatgttcgtgctcaagccgggcaatatcgaattccagctcagcggcatcgtcagcttccaggaaatgaacgagcgcatggggcgcaaggtggtgtcgcgggtggcggagctggcgcagctgccggccgacacggcgctggcccaggccaccggcctggccgagggcaccgccatggtcaagatcaagcgggtgcgcaatatcgacggcgagaacgtgatcctggacatcaaccacttcgtcgccggcctggtgccgggcctgaacgcggacatcgccgccggctccatctaccgctacatcgagcaggatctggggctgaccatcagctacgcccagcgcatcatcgaagcccagccctgcaacgacgacgaccgccgctacctggacctgaacggcatggaccacgtgatcgtggtcaagaacctgacccacctctacgacggcaggctgttcgaatacaccgagtcgcggcatcgattggacaagttctattttacggatattgcgaggcggtag

SEQ ID NO: 10568 - protein, 234 aa, Chromobacterium violaceum
MNKYHQIYSDIVADIDNRRYAQGERIPSESELMHHYDASRGTVRKAVDMLQERGYVQKIHGKGMFVLKPGNIEFQLSGIVSFQEMNERMGRKVVSRVAELAQLPADTALAQATGLAEGTAMVKIKRVRNIDGENVILDINHFVAGLVPGLNADIAAGSIYRYIEQDLGLTISYAQRIIEAQPCNDDDRRYLDLNGMDHVIVVKNLTHLYDGRLFEYTESRHRLDKFYFTDIARR

SEQ ID NO: 10569 - DNA, 735 bp, Chromobacterium violaceum
  CDS (1)..(735)
atggaaaaccgctggcaagcattgaaaccggatgaaaacctgagcactccgctgtatctgcagctgtcgcgcaagctggccgacgcgatcaacgccggctggtggcaggcggacgaggcgctgccgtcggagcggacgttttcggaagagctgggcatctcgcgggtgaccgcgcgcaaggcgatggacgtgttgctggagcagggcatgatccgccggcgccagggatcgggcaccttcatcacgcccaggctggagcagccgctgtcgcggttgaccggcttcaccgagcagctgaggctgcgcggcttcgtgccgtcgtcggtgtggctggagcgcggggtattcccgcccagcaatgaggaagtgatcaagctggggctgtcgccgacctcgatggtggcgcggctgaagcgccagcgcctcgccgacggcgtggtgatggcgatagaaatgagcacgatgccggtcgcgtatctgcccgacccgcaggcggtgggcacttcgctgtacgcccatctggacgcgaccgggcattcggtggtgcgggcgctgcagcacatccgggcggtgaacgcttccggggacgtggcccagcttgcgggcatccgtcccggcgaggcgatgctgctgatcacccgcatcggcttcaacgccgacaatgtggcgatcgagctgaccgacacctattgccgcaacgattattacgatttcgtagcagaactgaaacgatga

SEQ ID NO: 10570 - protein, 244 aa, Chromobacterium violaceum
MENRWQALKPDENLSTPLYLQLSRKLADAINAGWWQADEALPSERTFSEELGISRVTARKAMDVLLEQGMIRRRQGSGTFITPRLEQPLSRLTGFTEQLRLRGFVPSSVWLERGVFPPSNEEVIKLGLSPTSMVARLKRQRLADGVVMAIEMSTMPVAYLPDPQAVGTSLYAHLDATGHSVVRALQHIRAVNASGDVAQLAGIRPGEAMLLITRIGFNADNVAIELTDTYCRNDYYDFVAELKR

SEQ ID NO: 10571 - DNA, 807 bp, Chromobacterium violaceum
  CDS (1)..(807)
atggttcgcctccctttatctgcgctggatcagccagcgatgcggccgctcgcgctacaatcgctcattcccgtcaagactggagccaaggtgtcagacgccgcccaaccccgttaccagcgcatcaaggactatatcctgtccggcatccgcgaccgccatttcctgcccggctgcaagattccgccggagctggagctggcgcggcagttcggcgtgtcccgcatgacggtcaacaaggcggtgcgcgatctggccgaggccggcatcctgctgcgcttcgccggcgacggcacctatgtggccgagcgcaaggcggagtcgccgctgctggacatcaacaacatcgccgccgagatcgaggcccgcggccatcgccacaccgcccaggtgatcctgctggaggccgttccggccagcgaggaggtggcgctgcggctcagcatgcgcgccggcggcatcgtctaccattcgctgattgtccattgcgaggacgatgtgcctatccagctggaggaccgctacgtcaacccggccttcgcgcccgactacctgcggcaggacttctccgagcgcacgcccaacgattacctgatgcagagctgtccgctcaccgatatcgagcatagcgtggaagcggtgctgccgggcgtggcggagcagacgctgctgggcatcgccgccgccgagccctgcctgctggtgctgcggcgcacctggtcgcacaagaagctggtcagcttcgcgcggctcacccatccgggactgcgttacaaactgcggtcgcagacgcgcgtgaagaagtaa

SEQ ID NO: 10572 - protein, 268 aa, Chromobacterium violaceum
MVRLPLSALDQPAMRPLALQSLIPVKTGAKVSDAAQPRYQRIKDYILSGIRDRHFLPGCKIPPELELARQFGVSRMTVNKAVRDLAEAGILLRFAGDGTYVAERKAESPLLDINNIAAEIEARGHRHTAQVILLEAVPASEEVALRLSMRAGGIVYHSLIVHCEDDVPIQLEDRYVNPAFAPDYLRQDFSERTPNDYLMQSCPLTDIEHSVEAVLPGVAEQTLLGIAAAEPCLLVLRRTWSHKKLVSFARLTHPGLRYKLRSQTRVKK

SEQ ID NO: 10573 - DNA, 795 bp, Bordetella pertussis
  CDS (1)..(795)
atgcaacatgcgtcaagcgccgggcgccgacccgccgtgcctgtctatctcaagatccgcaacgccattcgcgacgcgatcagcaacgccgcgtacgcgccgggcgacctgctgccgtcggaaaccgagctcgccaagcgctacgccaccacgcgcgcgacggtggtgcacgcgatccagcaactggtgttcgaaggcctggtcgagcgcaagcgcggcgtgggcagcttcgtcgcgcagcccaagctgtcgtccacggtggacacgcaccgggtggcctatttcgagcaggatgccttcgcgcgcgatctcacctatgaggtgatcggctacggcaaggccgtggtcgaagaccacgtgcgcgatacgctgcggcttgggcgcggcgagccggtctaccggctgcagcgcctgtgcctgctttcgggcaagccgatcgccttcgagctgcgctacctgcccgcgctggtgggcgcgcggctgaccgccgagatgctggcgcggcgctcggtccagtcgctgctggacgaggaggtcggcatgccgatcacgcgctttctcaatgcggtgcgcgtcgcgctggtgccggcggcggtggccaggcacctgcagctggagaagggccggccggtcatggtgcgcacgcataccttcctggacgcggccgacacgccgctgctgtggggcgagaccctgtaccgcgaggagtaccagatcaactacgtcctgacggccatgcaagcgcccgacgaagccgtgggcgggcgaccgcgcaagggcgccggccgcgcgtag

SEQ ID NO: 10574 - protein, 264 aa, Bordetella pertussis
MQHASSAGRRPAVPVYLKIRNAIRDAISNAAYAPGDLLPSETELAKRYATTRATVVHAIQQLVFEGLVERKRGVGSFVAQPKLSSTVDTHRVAYFEQDAFARDLTYEVIGYGKAVVEDHVRDTLRLGRGEPVYRLQRLCLLSGKPIAFELRYLPALVGARLTAEMLARRSVQSLLDEEVGMPITRFLNAVRVALVPAAVARHLQLEKGRPVMVRTHTFLDAADTPLLWGETLYREEYQINYVLTAMQAPDEAVGGRPRKGAGRA

SEQ ID NO: 10575 - DNA, 819 bp, Bordetella pertussis
  CDS (1)..(819)
atggcggccgggcggataccgaacacacacgactccgacatggcagaagcacggcccgattccctcacgcgttcgcgtgccgcaaaaccggcaggcgagggggccgctttcagtccgctttaccgccagatcaaggaactgctggtccagagcctggaccgcggcgaatggaaacccggcgaactcattcccagcgagatcgacctggcggcccgtttccaggtcagccagggcaccgtgcgcaaggcggtcgacgaactggccgccgagcatctgctgctgcgccgccagggcaagggcacctttgtcgccacccatcacgaagcgcgcgtgcgctatcggttcctgcgcctggcgcccgacgaagagggcgagggcgggcgggccgaaagccgcatcctcgaatgccgccgcctgcgcgcgccggccgagatcgcccgcgccctcgagctgcgggccggcgagaccgtggtgaccatacggcgccagttgtccatgaaccacatgccgacggtcatcgacgatctctggttgcccggcacgcattttcgcgggctcaccctcgaactgctgaccgccagcaaggcgcccctgtatggattgttcgagtccgaattcggggtcagtatggtccgagccgacgaaaaactgcgcgccgtcgccgcctcgcctgaaatcgctccgctcctgggtgtcgagcccggccggcccttgctgcaggtcgatcgcatttcatatacctatggcgatcggcccatggaagtgcgccgcggcttataccttaccgatcattaccactaccgcaatagcctgaattga

SEQ ID NO: 10576 - protein, 272 aa, Bordetella pertussis
MAAGRIPNTHDSDMAEARPDSLTRSRAAKPAGEGAAFSPLYRQIKELLVQSLDRGEWKPGELIPSEIDLAARFQVSQGTVRKAVDELAAEHLLLRRQGKGTFVATHHEARVRYRFLRLAPDEEGEGGRAESRILECRRLRAPAEIARALELRAGETVVTIRRQLSMNHMPTVIDDLWLPGTHFRGLTLELLTASKAPLYGLFESEFGVSMVRADEKLRAVAASPEIAPLLGVEPGRPLLQVDRISYTYGDRPMEVRRGLYLTDHYHYRNSLN

SEQ ID NO: 10577 - DNA, 903 bp, Bordetella pertussis
  CDS (1)..(903)
atggcgttgtccgccattgaaccctttgcgctggaccgttccggcgcaacgcccctgcatgcgcaggtggcggacgcaatccgcaaccatatccgcgatcaccggctgaccgccggtaccgtgctgcccagcgaagcggcgctgtgccacagcttcggcgtggcgcgcagcgtggtgcggcaggccctgggcgccctggtggccgaagggctgatccgtcgcgacccgggccgcgcgccggtggtggcgccgccgcgcgaacaccggcgcatggtgcagcgctcggccggcctgtacgagcagttcgccggcctgggcgtggcgctgcgcacgcgcgtgctggcctgccggcccgccgagccgccgcccgaggtggcggccttcttcggcacgaccgagacgctgctgctggagcgtttgcgcagcgtcgacgcccagccgctggcctacgtgcgcacctggctgccgcgcgcggccatcgccgggttggcggcggaccacctgcaggacgcctcgctgcaccgcgtgctggcgcagcgcttcggcctgcgcccgggacgcggccgcaaccgcatccgggccgtggccgccgaagcggcgctggcgcaggcgctggacgtggcgccaggcagcccgctgctgatgctggaagggcaggggctggaccaggacggccatccgctggagtggttcaccacctggcatcgccccgagaacctggtgttcgacgtggacgtggggcaggagcgggaaagcgtgcagcccgcgctcacctgcggcacggccgccgtggcgccgccggcggtggccgcgccgccgtccggcgcgctggacgccgtcgaacagtcgctgctgcaggcgctgcaggccgtgcggcgggcccgcgaggaccagcaggagtag

SEQ ID NO: 10578 - protein, 300 aa, Bordetella pertussis
MALSAIEPFALDRSGATPLHAQVADAIRNHIRDHRLTAGTVLPSEAALCHSFGVARSVVRQALGALVAEGLIRRDPGRAPVVAPPREHRRMVQRSAGLYEQFAGLGVALRTRVLACRPAEPPPEVAAFFGTTETLLLERLRSVDAQPLAYVRTWLPRAAIAGLAADHLQDASLHRVLAQRFGLRPGRGRNRIRAVAAEAALAQALDVAPGSPLLMLEGQGLDQDGHPLEWFTTWHRPENLVFDVDVGQERESVQPALTCGTAAVAPPAVAAPPSGALDAVEQSLLQALQAVRRAREDQQE

SEQ ID NO: 10579 - DNA, 747 bp, Bordetella parapertussis; identical to SEQ ID NO: 2092
  CDS (1)..(747)

SEQ ID NO: 10580 - protein, 248 aa, Bordetella parapertussis; identical to SEQ ID NO: 510

SEQ ID NO: 10581 - DNA, 792 bp, Bordetella parapertussis
  CDS (1)..(792)
atggctcaaatgaaagataacaacgtctcgaatcgcgcgaccctcgtcctgtatgagaaccgcttcatcccgctctatcggatgatcaaggaggagctgatccggttcgtgcagaagaagggcatcaagtccggcatggcgctgcccggcgacaacgagctggccagccagttcggcgttagcgtgggcaccgtgcgccgggccattgccgagctggtctcggagcgcatcgtcatccggcagcaagggcgcggcaccttcctggctccctacgacaccagccgcatgctcaattcgttctggcacatcgagcggcgcgatggcgtggtagacgtgccgctggtgtcgacgcacggcttttcccaggcgtcggccaccgaggaggtggcgcagaaactggcgctgcagcctggcgacccggtcttcgtcatcaagaactcgatgacgatgcagggcacgccggtgctgctcgacacgatttatgttccggtgcgcacgttcgagggcctgacccgcgagaagctgagcgcgcgcgacgccaccatctatgacttctaccgcgaacagtacggcatcaatatcgtcaagacgatagaccgcgtcagcgcgaccgttgccgacaaggacacggccaagcgcctgggttgcaagctgggcgcgcccatgctgcgcatcctgcgcgtggcgtacagctttggagatacgccgatcgagtatcgctgcagcctgctcgattcggagaatcacgaatacgtcgatgtcaccggcggagacaccagccgctacggttga

SEQ ID NO: 10582 - protein, 263 aa, Bordetella parapertussis
MAQMKDNNVSNRATLVLYENRFIPLYRMIKEELIRFVQKKGIKSGMALPGDNELASQFGVSVGTVRRAIAELVSERIVIRQQGRGTFLAPYDTSRMLNSFWHIERRDGVVDVPLVSTHGFSQASATEEVAQKLALQPGDPVFVIKNSMTMQGTPVLLDTIYVPVRTFEGLTREKLSARDATIYDFYREQYGINIVKTIDRVSATVADKDTAKRLGCKLGAPMLRILRVAYSFGDTPIEYRCSLLDSENHEYVDVTGGDTSRYG

SEQ ID NO: 10583 - DNA, 780 bp, Bordetella bronchiseptica
  CDS (1)..(780)
atgcccgacagccccttgcccctgtatcacaaggtctatctgctgctgaagcagcgcctgcaatcgggcggcttcgccctgaacgcggcgatgcccggcgagaacgcgctggcggccgaatacggcgtctcgcgcctgacgatacggcgctcgctcgaggcgctggagtccgaaggcctgatcgagcgccgccaggggcggggcactttcgccgccgagggcgcgatcctgtcggcgccgcagcacagcgccgacatcgacacgctgatggcgcacctggcccgcatgggcatgcatacccaggtgaacctgctcgaactcgacaccgtgccggccaccccgcaggtggcggcgcagctcgaactgccggccggcgcgccggtacagcgggcggtgcgggtacgcagccaccagggcctgccgttttcgtacctggtcacgtacgtgccgggcgaaatcggccagcgcatccgccgcgaggacctgggcgccaagcccctgctggcgatcttccgcgacctgggcgtgcgcgtggcgcgcgcccagcaatcgatctcggcggtgctggccgagcccggcacggccggcgcgctggacgtgccggtcggctcggccctgctcagcctgcaacgcctggtgcgcgacgacgccggccggccggtggaatggctgcatgccctgtaccggcccgaccgctacgaataccgcctggatatgcaggcccacgatacgccgggccagcctacctggctgcccgccggcgcgccgcggcgcgcctga

SEQ ID NO: 10584 - protein, 259 aa, Bordetella bronchiseptica
MPDSPLPLYHKVYLLLKQRLQSGGFALNAAMPGENALAAEYGVSRLTIRRSLEALESEGLIERRQGRGTFAAEGAILSAPQHSADIDTLMAHLARMGMHTQVNLLELDTVPATPQVAAQLELPAGAPVQRAVRVRSHQGLPFSYLVTYVPGEIGQRIRREDLGAKPLLAIFRDLGVRVARAQQSISAVLAEPGTAGALDVPVGSALLSLQRLVRDDAGRPVEWLHALYRPDRYEYRLDMQAHDTPGQPTWLPAGAPRRA

SEQ ID NO: 10585 - DNA, 726 bp, Bordetella bronchiseptica
  CDS (1)..(726)
atggccatcaatttccacgacagtcccatcccgcgctacctgcaattggccgacctgatgcgccagcgcattgcccggggccagtggggccaggggcaccgcctgccgtcgctggaggaactggtggcggagttcggcgtggcgcgcgtgacggtgcgccaggccatcgacgtgctcacgcgcgaggggctggtgtcgccgcagcaggggcgcggcaccttcgtcaccggcctgccgcccaacgaccgctggctgcaggtgcagaccacgctggccgagctggccaaggtctaccgcgacaccaagcccaagatcgtcaacatcgacgaaaccatcaccaatccgccgctgaccgcgcaggatggcgtggcggccgagcgctatgtctacatgcgccgcgtgcacgagcgcgaagggcggccgtattgcgtcatcaatatctacctggacgaacagatcttccgccgcgatccggtgcgctaccgcaacgaaaccgtcatcccgctgctggtgtccgacccggccctgcgcatcgcccgcgcgcaccaggtgctgaccatcggcaccgccgacatggaagtcgccggccatctgcaggtgccggtcaatacgccgatcgccgaagtgcggcggctgttcctcgacgaggccggcaaggtggtgtacctgagcgaagtctcgtatcgcggcgatttcatccacctggaaatgaacctgatcccctga

SEQ ID NO: 10586 - protein, 241 aa, Bordetella bronchiseptica
MAINFHDSPIPRYLQLADLMRQRIARGQWGQGHRLPSLEELVAEFGVARVTVRQAIDVLTREGLVSPQQGRGTFVTGLPPNDRWLQVQTTLAELAKVYRDTKPKIVNIDETITNPPLTAQDGVAAERYVYMRRVHEREGRPYCVINIYLDEQIFRRDPVRYRNETVIPLLVSDPALRIARAHQVLTIGTADMEVAGHLQVPVNTPIAEVRRLFLDEAGKVVYLSEVSYRGDFIHLEMNLIP

SEQ ID NO: 10587 - DNA, 792 bp, Bordetella bronchiseptica
  CDS (1)..(792)
atgacggcccggggcggttggcgcccgcggcccggcccgcctgccccagccttcccggaacccgctttgcgctatacagaactcgccaataccctggtcaaacgcatcaccgagggccaatacgaaatcggcgaccagcttcccaacgaactggcgctggccgcccaattccagagcagccgcagcacggtgcgcgccgcgctcgatatcgtcgaagggctgggcctggtgacgcgcaaacgccgctccggcacggtagtgtgttcgcgcaccaccaacaaccagtacaccaagtcggtccacaccatcgaggatctggtcaattacgccagccacaccgaacgccagatcctggaggtcagcccggtggtggccgacgaggcgctggcccaggcgctcgaatgcaagcccggcacgacctggctgcgcgtgcgcatgctgcgcgtcgagaaggacgcggcccatacgccgctatgctggaacgacgcctatatgctgcccgacgtggggcagcgcatcgtcggcaagatcccgaacggttcgggcctgctgtgccgcatcatcgagaacgaggccggcatcgcggtggccgacatcaagcagagcatcggcgccaccgccatcgaaggcgagatggcaagccggctgggcgtggcgcccggcaccccgggcctggaaatcacccggctgtacgtggaccgcgccaacacgcccttcctgattaccgtcaacacctattcggcgcacaagttccgcttcacgttctggatgcaccgctcggactcgcactga

SEQ ID NO: 10588 - protein, 263 aa, Bordetella bronchiseptica
MTARGGWRPRPGPPAPAFPEPALRYTELANTLVKRITEGQYEIGDQLPNELALAAQFQSSRSTVRAALDIVEGLGLVTRKRRSGTVVCSRTTNNQYTKSVHTIEDLVNYASHTERQILEVSPVVADEALAQALECKPGTTWLRVRMLRVEKDAAHTPLCWNDAYMLPDVGQRIVGKIPNGSGLLCRIIENEAGIAVADIKQSIGATAIEGEMASRLGVAPGTPGLEITRLYVDRANTPFLITVNTYSAHKFRFTFWMHRSDSH

SEQ ID NO: 10589 - DNA, 768 bp, Streptomyces avermitilis
  CDS (1)..(768)
atgtcccgtcacaggaaccccgccacccccgtacgcctcgacttcgcactcgaccgcaacagtccggtgccgctctactaccagctcgcccagcagctggagcatgcgatcgagcacggcgcgctgggcccgggcagcctcctcggcaacgagatcgagttcgccgggcggctcggtctgtcccggcccaccgtgcgccaggccatccagtcgctggtcgacaaggggctgctcgtgcgccgccggggcatcggcacccaggtggtgcacagtcaggtcaagcgcccgctggagctcagcagcctgtacgacgacctggaggccgccggccagaaccccgcgacgcgggtgctgcgcaacgaggtccagccggcgtccgccgaggtcgcggccgccctgggcctcgccgagggcggcgatgtgcaccacatcgaacggctgcgcctcgcccacggccagccggtggcgttcctgtccaaccacgtgccggccggcctgctggacctcggcaccgcccggctggaggcgaccggcctgtaccggatgatgcgcgccgtcggcatcaccctgcacagcgcccgccagtccgtgagcgcccgcggcgcgaccgcccaggaggccgagcggctggacgagcacgagggcgccgccctgctcaccatgcggcgcaccgcctacgacgacaccggccgcgccgtcgaatacggcacccacatctaccgcgcgtcacggtacgccttcgagttccagctcctcgtacggccctga

SEQ ID NO: 10590 - protein, 255 aa, Streptomyces avermitilis
MSRHRNPATPVRLDFALDRNSPVPLYYQLAQQLEHAIEHGALGPGSLLGNEIEFAGRLGLSRPTVRQAIQSLVDKGLLVRRRGIGTQVVHSQVKRPLELSSLYDDLEAAGQNPATRVLRNEVQPASAEVAAALGLAEGGDVHHIERLRLAHGQPVAFLSNHVPAGLLDLGTARLEATGLYRMMRAVGITLHSARQSVSARGATAQEAERLDEHEGAALLTMRRTAYDDTGRAVEYGTHIYRASRYAFEFQLLVRP

SEQ ID NO: 10591 - DNA, 780 bp, Streptomyces avermitilis
  CDS (1)..(780)
atgcccgccgaacgcatccgagaccacgccggccagggcgcgaccaccgtcgccgcccaccggcgaaggctgcgcgcggaccgggccaggcaactcgccgacctgctccgtcaccaagtgctgaccggcggtttcccggacggcaccctcccccacgaggccgccctcggcgccgactaccgcgccacgcggggcaccgtccgccaggccctcgacctcctcagggccgagggtctcgtggaacggctccccggcgtcggcacggtcgtcgtcgcccagaagtacccgcacgggctcgaccggctgatgggactcgcggagaccctgcgcgaacacggccaggtcagcaacgagatccgtacggtcggccccgtcgccgcccccgccccggtcgccgaacgcctgcgcgtaccccccggcgccgacgtcctctacatcgagcggctgcgccgcctcgacggcctccccctctccctcgacctcacctacgtcccgctcgacctcggcaccgccctgctcggcgccgacctggagaacaccgacgtcttccggctcctggaagcgatcaccggacagcccctcgggcacgccgagatcaccctggaggcggtgaacgcggacgcgcactcggccgccgtactccaggcaccacgcggcgcggccgtactgatgctggaacggctcacccacctcgccgacggccgccccgtcgacctggagttcatccgcttccgcggcgaccgcatcacgatgagcggcctgctgcaccgctcccggtag

SEQ ID NO: 10592 - protein, 259 aa, Streptomyces avermitilis
MPAERIRDHAGQGATTVAAHRRRLRADRARQLADLLRHQVLTGGFPDGTLPHEAALGADYRATRGTVRQALDLLRAEGLVERLPGVGTVVVAQKYPHGLDRLMGLAETLREHGQVSNEIRTVGPVAAPAPVAERLRVPPGADVLYIERLRRLDGLPLSLDLTYVPLDLGTALLGADLENTDVFRLLEAITGQPLGHAEITLEAVNADAHSAAVLQAPRGAAVLMLERLTHLADGRPVDLEFIRFRGDRITMSGLLHRSR

SEQ ID NO: 10593 - DNA, 765 bp, Streptomyces avermitilis; identical to SEQ ID NO: 2102
  CDS (1)..(765)

SEQ ID NO: 10594 - protein, 254 aa, Streptomyces avermitilis; identical to SEQ ID NO: 498

SEQ ID NO: 10595 - DNA, 750 bp, Streptomyces avermitilis
  CDS (1)..(750)
atggatccgaccgtctcgctccagctcagcgtcgaccgcagcagtccggtcccgctctacttccagctgtcccagcagttggaggccgcgatcgagcacgggacgctgacccccggcagcctgctgggcaacgagatcgagctcgccgcgcggctcggcctgtcccgccccacggtccgccaggccatccagtccctcgtcgacaagggcctgctcgtacgccgacgcggcgtcggcacccaggtggtgcacagccaggtcaagcgcccactggaactgagcagcctgtacgacgacctggaggccgccggtcagcgcccggccacccaggtgctgctcaacaccctcgtgccggcctccgccgaggtcgcggccgcgctcggggtggccgagggcagcgacgtgcaccaggtggagcggctgcgcctggcccacggcgagccgatggcgtacctctgcaactacctgccgaccggactgctcggcctggacagcgagcagctggaggcgaccggcctgtaccggctgatgcgggccgccggcatcacgctgcacagcgcccggcagtccgtcggcgcgcgggccgccacggcggtggagggcgagcggctcggcgagcccgagggcgccccgctgctcacgatgcagcgcaccaccttcgacgacacgggccgggccgtcgagttcggcacccacacctaccgcgcctcgcgctactccttcgagttccagctgctcgtacggccctga

SEQ ID NO: 10596 - protein, 249 aa, Streptomyces avermitilis
MDPTVSLQLSVDRSSPVPLYFQLSQQLEAAIEHGTLTPGSLLGNEIELAARLGLSRPTVRQAIQSLVDKGLLVRRRGVGTQVVHSQVKRPLELSSLYDDLEAAGQRPATQVLLNTLVPASAEVAAALGVAEGSDVHQVERLRLAHGEPMAYLCNYLPTGLLGLDSEQLEATGLYRLMRAAGITLHSARQSVGARAATAVEGERLGEPEGAPLLTMQRTTFDDTGRAVEFGTHTYRASRYSFEFQLLVRP

SEQ ID NO: 10597 - DNA, 732 bp, Enterococcus faecalis
  CDS (1)..(732)
atggataaattagaatcaaataaaaaagcaccgctttatcaacaattatacgatgctattttaaataaagttagaagtggtgaatatcaagtaggagaaaaaatcccttcagaagaacaattgatgaccatttacggagtgagccgagtaaccgttcgtaatgcgattaaacaattagttgatgaaaatattttaattaaacggcatggaaaagggacatttgtttcaatgccatcctatgttgagagcatgacagctggtgggagttttactgagtcaggtttaaaaatgaatcgtaaaccaacaactaagatcatatcaatttgtttgaaaaaagcaacagggcatgttgcagaagcattgggtgttgaaaaagcgacagaagttattgttattgagcgcctccgttcgttagataacatgcctgcaattttcgagattgattattttagaaaagaagatcagtttatgttggacttagaattaacagatacttcattattagatattttacggcaatatagaggagtaattgctagctattttgataatatcattgaaattgccttggccgatgaaaagttggcagaagcattagcgattagtgaagaagaagcgttggtcaaaattaatcaaacagttgtggataatgataatcaaattttatattttaatgagcaatatatccttagcgaatcctacaaagtagccattcgttcatataataaataa

SEQ ID NO: 10598 - protein, 243 aa, Enterococcus faecalis
MDKLESNKKAPLYQQLYDAILNKVRSGEYQVGEKIPSEEQLMTIYGVSRVTVRNAIKQLVDENILIKRHGKGTFVSMPSYVESMTAGGSFTESGLKMNRKPTTKIISICLKKATGHVAEALGVEKATEVIVIERLRSLDNMPAIFEIDYFRKEDQFMLDLELTDTSLLDILRQYRGVIASYFDNIIEIALADEKLAEALAISEEEALVKINQTVVDNDNQILYFNEQYILSESYKVAIRSYNK

SEQ ID NO: 10599 - DNA, 756 bp, Enterococcus faecalis; identical to SEQ ID NO: 2104
  CDS (25)..(756)

SEQ ID NO: 10600 - protein, 243 aa, Enterococcus faecalis; identical to SEQ ID NO: 496

SEQ ID NO: 10601 - DNA, 708 bp, Enterococcus faecalis; identical to SEQ ID NO: 2106
  CDS (1)..(708)

SEQ ID NO: 10602 - protein, 235 aa, Enterococcus faecalis; identical to SEQ ID NO: 494

SEQ ID NO: 10603 - DNA, 1246 bp, Enterococcus faecalis
  CDS (192)..(905)
caaaaagtaccaatcagatcaataagttcttctgtttacttttaaaactatatagttttaaaaagaataagtcaactacttttatttaagtacttgattattaagtggttacgttaaaaataaatatatagttttaacacgttaaattcatggtataatgagagaaatactggtgataaaggaggactctgatgcggacaaatacacgttataaagaaatttatgcagctataaaacaggatattgaagcaggtgtttatccaattaaccaaaagttaccccaaggtcgtcttcttgcagaaaaatatcaggtcagcgaactaaccattacaaaagccttacatttgcttgtgcaagaaggttatgttgtcagacgacgtggctcgggcagctttgttcaagactttcaaaatcgaaccattactaaattttctccgttaaccggcacttactcaacctacgatggaaaagttgaatccgtggttttaggctttgcaacagaagtacctgagccttgggtgactgaaaaattaagtattacagaagaagagttagtctacaaaattattcgcttacggattatcgaagatgtgccctcaattattgaatacacttggatgcccgttgctttaattccgaacttgacaatgaaagaattgaaagtctccatttatcaatatatttcggaacaattgcatcaaaaaattcaaagtgcgcgggtcagcatttctgggattcgtccttctccgttggaaaaaaaatatttaaacttaaccgataatgatttcctgatgcgtgcagaacaaattgcttacctaggcaatgggcatatttttgaatactcaattgcgaatcatattcctagtgaattcacttttgaaactgtcttaattgcagaaaaatagaaaacttttatgttgccatttctcatttctaacaaaacgatctctttactttgagccaatactttttgttagaaatgtttttctgctagttaaaaatatttttcaaattatatttccaaacatgaattttgataaaagtattgctatttactagaactacgattaaaatattgcttgtagcactctttttaatatagatacaagcaatttgttttttacatagtcaattaaccaaagtgaggactttatatgaggaaaccctacattttaatgagcttactcgtctaagtaccttattaagtgcttgttcactgtaagtggcagcccagcaagtcaagtgc

SEQ ID NO: 10604 - protein, 237 aa, Enterococcus faecalis
MRTNTRYKEIYAAIKQDIEAGVYPINQKLPQGRLLAEKYQVSELTITKALHLLVQEGYVVRRRGSGSFVQDFQNRTITKFSPLTGTYSTYDGKVESVVLGFATEVPEPWVTEKLSITEEELVYKIIRLRIIEDVPSIIEYTWMPVALIPNLTMKELKVSIYQYISEQLHQKIQSARVSISGIRPSPLEKKYLNLTDNDFLMRAEQIAYLGNGHIFEYSIANHIPSEFTFETVLIAEK

SEQ ID NO: 10605 - DNA, 765 bp, Enterococcus faecalis
  CDS (1)..(765)
atgacagaaaatgcacccaaatttaagcaaatttctgcagaaattgaaaagaagattagagacggtctgtatgtaagtgcacaaaaattaccttcagaatatgatttagctaaagaatataactgcagtcgcttgaccatccgtaaagcgattgatgatttgatccgcaaaaatattttggtaaaacgacatggtaaaggtagttatgtgatgtcgcaagcgaaaattcaaagtggtcgcgctggcttacaaggttttactgaggcagccaaagcttacgggaaaaaaagccagacagaagtcatttcctttgaagaagtagtacatcccgctgaaaaaattcgggaggcgctccaagtgggcaaaaatgaggcaatttatgaactgattcgccgccgaatgttagacggcgagccaatgacagttgaaaaaatttatttgccacaggcatacgtacaaggccatacgaagcaagacttcgagggctctcttttctgcttaatcgagaagaacgtcgagattgcttattcgcatcaagaaattgaagcaatcttagttgaagcggaaatttcagaattattgaatgttcctgtgggccaaccacttttacaagtccactctatcacttatgcgcttgatgcaactcctattttatatgatgtctctttatatcgagcagatcggtacacgtttaaaaacacactgacccgctatagcccgtctgaaaacaaccaagtggagctaggaggttcttggaacgaatga

SEQ ID NO: 10606 - protein, 254 aa, Enterococcus faecalis
MTENAPKFKQISAEIEKKIRDGLYVSAQKLPSEYDLAKEYNCSRLTIRKAIDDLIRKNILVKRHGKGSYVMSQAKIQSGRAGLQGFTEAAKAYGKKSQTEVISFEEVVHPAEKIREALQVGKNEAIYELIRRRMLDGEPMTVEKIYLPQAYVQGHTKQDFEGSLFCLIEKNVEIAYSHQEIEAILVEAEISELLNVPVGQPLLQVHSITYALDATPILYDVSLYRADRYTFKNTLTRYSPSENNQVELGGSWNE

SEQ ID NO: 10607 - DNA, 723 bp, Shigella flexneri; identical to SEQ ID NO: 491
  CDS (1)..(723)

SEQ ID NO: 10608 - protein, 240 aa, Shigella flexneri; identical to SEQ ID NO: 492

SEQ ID NO: 10609 - DNA, 729 bp, Vibrio parahaemolyticus
  CDS (1)..(729)
atgaaaacaacaggtgcgggccagttagggacgcagttaggaaaaattaaaaccagcttgagacagcaaattcacactggcgtggtttctcaagggcaaaaactgccttcagaaagagagttaagtgagctgttttctaccacccgaatcacgattaaagatgcgttagtctcgttggaaactgaagggctgatttatcgagaagaacgccgtggttggtatgtgtctcctgagcgaatctgctacaacccgttgtcgcgttctcactttcatcaaatgattcgtgagcagcatcggattgcagccacccaattgatcagcgtgcgcagtgaaatggcggcaggggattacgcaaaagcgcttgatatcgagcagatgacgccaatccacatcattgagcgtttgcgttgtattgatgggcgagccgtgctgtttgttgaaaacgttctaaaagcgagtttgtttgatggtattttggcagagaatctgactatgtcgctgacgggcatttaccgtgagaaatatggctacgaaacaatgcgttctcgattcgatgtcattccaacgtcagcgcccgcacatgtggcgaaagcattgaatctggctgaaggacaacctgtactgaaaatttgtcgcgtgaactacaagcaagatggcgagctaatggattgcgagttggaatactggcgacctgacgcggtgatgattcgcatagacagcgtgggataa

SEQ ID NO: 10610 - protein, 242 aa, Vibrio parahaemolyticus
MKTTGAGQLGTQLGKIKTSLRQQIHTGVVSQGQKLPSERELSELFSTTRITIKDALVSLETEGLIYREERRGWYVSPERICYNPLSRSHFHQMIREQHRIAATQLISVRSEMAAGDYAKALDIEQMTPIHIIERLRCIDGRAVLFVENVLKASLFDGILAENLTMSLTGIYREKYGYETMRSRFDVIPTSAPAHVAKALNLAEGQPVLKICRVNYKQDGELMDCELEYWRPDAVMIRIDSVG

SEQ ID NO: 10611 - DNA, 705 bp, Vibrio parahaemolyticus
  CDS (1)..(705)
atgcagtacgtaaaaattaaagattcgattgttgaacagattgaagcgggcatgctatcaccgcgtcagaaattgcctgcggagcgcaagttggcggagtcgttcgacacaacccgagttacgttgcgcgaagcgttgtcgttattggaagccgaagggagaatttatcgtgaagatcgcagaggctggtttatttcacctgagccactacgctacgaccctactcaaacacttaattttccgaacatggcgaaagcgcaaaatcgcgtgccaaaaacggagctgattgcggcaaagggcactttagctaacaagcaatctgcgcgcttgttacaactgcagccgttctctgatgtttttcgtgtcgaccgcgttcgatatttggaagacagacctgtggtgtatgtgaccaactatattcgcccagagatcttccccaatttattgagctttgatttgaccaactcgctgaccgacatttatcgcgagcactttggtgtggtgtatcagaagacgcgttaccgtatttctaccagtaccttgcttggtgaagtcgcgcaagcattgcgagcaacctctggcactcctgcaatggttgttgaacgtactaactataaccaacatggcgagttaattgactgcgatattgaatactggcgtcacgatgccatcagtattgagtcggtagcagagctcaatcaataa

SEQ ID NO: 10612 - protein, 234 aa, Vibrio parahaemolyticus
MQYVKIKDSIVEQIEAGMLSPRQKLPAERKLAESFDTTRVTLREALSLLEAEGRIYREDRRGWFISPEPLRYDPTQTLNFPNMAKAQNRVPKTELIAAKGTLANKQSARLLQLQPFSDVFRVDRVRYLEDRPVVYVTNYIRPEIFPNLLSFDLTNSLTDIYREHFGVVYQKTRYRISTSTLLGEVAQALRATSGTPAMVVERTNYNQHGELIDCDIEYWRHDAISIESVAELNQ

SEQ ID NO: 10613 - DNA, 720 bp, Pseudomonas syringae
  CDS (1)..(720)
atgcagttgtctagacaagacgagccgttatacctcgggctggccgaaaccctacgcgacgagctggccggctaccagcccggcgactacctgcctgccgagtttcagctggccgagcgcttcagcgtcaatcgccacaccattcgccgcgcggtcgatgaactggtgcgtgaaggcagcgtattgcgccgtcagggcaagggtactcaggtgctggagcgtccgctgatctacccgatgcaggccgacagtgcctacagccagtcgttgtcggcgcagggcgttggcgtggaagccattctgctgctgcgtcgcgagtgccaggccagccatgaagacgcgctgcatctgggcctggccgagcacgcgccagtgatcgagctgcagaccttgcgcaaattggacggtcaggcggtaagcctgattttccaccgttacagcgccgtttaccacgagttgctggctgattatcagggcggctcggtgcgtcagtacctggctgagtgcgggctaccgttgagtcgcgcgcaaagtctgatcggcgcgcgattgccgtcacgcgaagaagccgggttgctgttgatgccccggcacatgcctgcactgacggtgctgaccgtttcctgcgacggagcggggcagccggtcgagctttcccgctcggtcagccgctccgaccgcttccagtaccaggtggcgactgccattccaaccagatga

SEQ ID NO: 10614 - protein, 239 aa, Pseudomonas syringae
MQLSRQDEPLYLGLAETLRDELAGYQPGDYLPAEFQLAERFSVNRHTIRRAVDELVREGSVLRRQGKGTQVLERPLIYPMQADSAYSQSLSAQGVGVEAILLLRRECQASHEDALHLGLAEHAPVIELQTLRKLDGQAVSLIFHRYSAVYHELLADYQGGSVRQYLAECGLPLSRAQSLIGARLPSREEAGLLLMPRHMPALTVLTVSCDGAGQPVELSRSVSRSDRFQYQVATAIPTR

SEQ ID NO: 10615 - DNA, 714 bp, Pseudomonas putida
  CDS (1)..(714)
atgcagtcgacgcccccgcgtgcggtaacagccatctgccatgccctgcaggagcagatcgagcatggcctgctggcgccgggcggcaagctgccggccgagcggcggctcagcgaggtgttcgacaccacgcgcattaccctgcgtgaggccttggtgcagctggaggcccaaggcttgatttaccgcgaagagcgccgaggctggttcgttgcgccgcagcgcttgacctacgacctcatcgagcgcagccacttccatgccatggtgcgcgatcaggggcgggtggccagtaccgaactgctgtcggcgaggctgcagccggcttcggcggccatctgtgcacgcttgcagctgccggcgttgtccagtgtggtgcgcgtctgccggttacggcggattgacgggcgggcggtgctgtatgccgagcattacctcaacccccggtactttccaggcattctcgaacacgacctggcgcagtcactgaccgagatttatgggcgggtgtatggcatcgagtacgggcaggtgtgcttcgagatcctgccgacagcgttgccggtggaggcggcaagcgccttgaaagtgtcggcgggcagcccggggttgcacattacccgggtcaacagcgaccagcatgggcacttgatcgactgtgacctcgagtattggcggcacgatgcgatccgcattcgtgcccaggctggatga

SEQ ID NO: 10616 - protein, 237 aa, Pseudomonas putida
MQSTPPRAVTAICHALQEQIEHGLLAPGGKLPAERRLSEVFDTTRITLREALVQLEAQGLIYREERRGWFVAPQRLTYDLIERSHFHAMVRDQGRVASTELLSARLQPASAAICARLQLPALSSVVRVCRLRRIDGRAVLYAEHYLNPRYFPGILEHDLAQSLTEIYGRVYGIEYGQVCFEILPTALPVEAASALKVSAGSPGLHITRVNSDQHGHLIDCDLEYWRHDAIRIRAQAG

SEQ ID NO: 10617 - DNA, 927 bp, Pseudomonas putida; identical to SEQ ID NO: 489
  CDS (1)..(927)

SEQ ID NO: 10618 - protein, 308 aa, Pseudomonas putida; identical to SEQ ID NO: 490

SEQ ID NO: 10619 - DNA, 750 bp, Pseudomonas putida
  CDS (1)..(750)
atggccgaactgctccccctgtccccggtaccgctctatacccagctcaaggaactgctacgcgagcgcatcctcgacggtacttatccatcacatagccgcatgccctcggaaagcgaactgggcaaggccttcgacgtcagccgcatcaccgtgcgccaggcgctgggcgacctgcaaaaggaagggctgatcttcaagatccacggcaaaggcacgttcgttgccaagcccaaggcgttccagaacgtcagtaccttgcagggcttgggcgagtcgatgacgcagatgggttacgaagtgatcaaccgcctgcgcagctttcgccatgtgccggccaacgcattggttgccgcccggctgcaggtcgaggagggtagcttggtcaccgagatccgccgggtgcgcctgatcaaccgcgagccggtgtcgctggaactgacgtggctgcccaaggccgtcggcgaaaaactggagaaggccgatctggtcacccgtgacatcttcctgctgttggaaaacgactgcggcatcgctcttggccacgccgacctggccatcgatgcggtattggccgacagcgacctgacccaggccctggatgttgaagaaggctcgccgatcatgcgcatcgagcgcctgacccatgctgccgacggcacgccgctggacttcgaacacctttactaccgcggcgatgccttccagtaccgcctgcgcattgatcgtcagaaagggggcaaggcatga

SEQ ID NO: 10620 - protein, 249 aa, Pseudomonas putida
MAELLPLSPVPLYTQLKELLRERILDGTYPSHSRMPSESELGKAFDVSRITVRQALGDLQKEGLIFKIHGKGTFVAKPKAFQNVSTLQGLGESMTQMGYEVINRLRSFRHVPANALVAARLQVEEGSLVTEIRRVRLINREPVSLELTWLPKAVGEKLEKADLVTRDIFLLLENDCGIALGHADLAIDAVLADSDLTQALDVEEGSPIMRIERLTHAADGTPLDFEHLYYRGDAFQYRLRIDRQKGGKA

SEQ ID NO: 10621 - DNA, 708 bp, Lactobacillus plantarum
  CDS (1)..(708)
atgtatcgtgacattgcaaccaaactcgttgccgccattcaagacggcatttttaccgtcaaactccccacggaagcccagttaatggaacgttaccaagccagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttccaagattctgacttttgatacgatccacggcgatagtgccctgagccgcaaactcaacattcccgtcgacgaagaactgtatcgtatcattcgcctccgctactggcacgaccaactgtattgtttggaaaaggcctactacttacgctctgtcgtcccctatctatcgaccgaagctgtcaatacgtcaatttgggacttcatcaacgaagcttacggcatcgggattgctaacagtgatgattatctttcactcaccaatcttaacaaggaagaggccgaactaatgaatttggcacagggcgcaactcacttggccttggattcttgtaactattataagaataatggcttactagatttttctcacaccatctttgtttatcccgacctcgcattgtattttcatacgacaaatcttgcaaataattaa

SEQ ID NO: 10622 - protein, 235 aa, Lactobacillus plantarum
MYRDIATKLVAAIQDGIFTVKLPTEAQLMERYQASRNTIRKAIDLVYQQGLLRRVQGSGYYITNIQLQHKTVVNLSARSLFNSHVHPRTLTSKILTFDTIHGDSALSRKLNIPVDEELYRIIRLRYWHDQLYCLEKAYYLRSVVPYLSTEAVNTSIWDFINEAYGIGIANSDDYLSLTNLNKEEAELMNLAQGATHLALDSCNYYKNNGLLDFSHTIFVYPDLALYFHTTNLANN

SEQ ID NO: 10623 - DNA, 726 bp, Lactobacillus plantarum
  CDS (1)..(726)
atggctgacctagtttatcaacaagtcatcaatgatctcaataaacggatcatggcgaatgaatttgttgataagaagcttccagatgaacgtagtcttagcgaacagtatcaggtaagtcgtagctcgattaagcgcgcgcttaacgtgctagccaataagggcctgattttcaagaagcggggttcgggaacgttcattaatccattatatcttaaaaatcaatcttcgtttaagtatgaaggaactaacctaggaattacggacagtttaaatactgagggtgctaagcccagtattcaattattagactttcgcgtcattcctgcaagtcaagagttgcaacaagacttatttttaactgctgacgagtttgtttatgaaatcaaacggctgcgattactggatgaccagcctttcatgattgaaagtggctatattccaatcaagcttgtgccccagttgaaccggcaagtggtcagtggctcgatctttaattacgtgcaaaagaccttgcacgccgcagtgaccaaatcattcttatcgattgcggccgatgcgtccaatacgactgatcaagagttgttacatttgcagccaaatgaaccggtgggcctgatgagtgggattttcttcttagatgatgggacaccctttgaagtgtctaatatgcgactacattatcaatatatgaagtatacaacgtttgtgtcaacgaatagttag

SEQ ID NO: 10624 - protein, 241 aa, Lactobacillus plantarum
MADLVYQQVINDLNKRIMANEFVDKKLPDERSLSEQYQVSRSSIKRALNVLANKGLIFKKRGSGTFINPLYLKNQSSFKYEGTNLGITDSLNTEGAKPSIQLLDFRVIPASQELQQDLFLTADEFVYEIKRLRLLDDQPFMIESGYIPIKLVPQLNRQVVSGSIFNYVQKTLHAAVTKSFLSIAADASNTTDQELLHLQPNEPVGLMSGIFFLDDGTPFEVSNMRLHYQYMKYTTFVSTNS

SEQ ID NO: 10625 - DNA, 711 bp, Lactobacillus plantarum; identical to SEQ ID NO: 487
  CDS (1)..(711)

SEQ ID NO: 10626 - protein, 236 aa, Lactobacillus plantarum; identical to SEQ ID NO: 488

SEQ ID NO: 10627 - DNA, 711 bp, Lactobacillus plantarum
  CDS (1)..(711)
atgtatcaggcaattgcgcaggcaatcattaaatcgataatggcggatgaatatccgactaagttaccaaccgaaaaagtgttaatggcgcagtacaacgccagtcgcaatacgattcgtaaagcgattgatgtggtcttccggcatgggttgttacgtcgcgtgcaggggagcggcaattttattatcaaacaaccgcagaacacgaagaaagtgctcaacttatcgattggatttgaccagtccgccatggttgacggtggaccattagtatcaaaagttgtcacgtttgataaagtgacagcggatgaaactttagcacaacaggggaacattgcgcttggtgacgaggtttatcgggtggtgcgattacgttatttgaatgacatcttgtatgacctggaagagtcttattttccgcgaacggtcgtcccgttcttatcgagtgagagcgtgcagcattcaatcttcgccttcttgcgagaggcatatggtattacggggagcaccacggaaaactacgtccatcaagtgcgggtggacgcgcaacgggcggagttgatcggttgcccagatggtgacaaaacgttgtgcttggaagcaatcaattacttggctaatgggacggtctttaacttctccaggacgttcttcgtctatccagatttggaactctattaccataccgaaaatattgatttacaaaactag

SEQ ID NO: 10628 - protein, 236 aa, Lactobacillus plantarum
MYQAIAQAIIKSIMADEYPTKLPTEKVLMAQYNASRNTIRKAIDVVFRHGLLRRVQGSGNFIIKQPQNTKKVLNLSIGFDQSAMVDGGPLVSKVVTFDKVTADETLAQQGNIALGDEVYRVVRLRYLNDILYDLEESYFPRTVVPFLSSESVQHSIFAFLREAYGITGSTTENYVHQVRVDAQRAELIGCPDGDKTLCLEAINYLANGTVFNFSRTFFVYPDLELYYHTENIDLQN

SEQ ID NO: 10629 - DNA, 696 bp, Lactobacillus plantarum
  CDS (1)..(696)
atggaaacaaaaattctatatcaaaaagtttccgcagatcttaaacgacggattctagatggtgactatgaagtaggcggcttaattccaagtgaaggggaacttgaacgttactatcaagtcagcaagattaccattcgcaaggcggtcgaagttttggtcagtgagggctacttggagaagaagagtggtattggcacgcgcgttattagtaacgatctatttaacaagttgacgcagacgcagtcgtttacggcaacggtcggccagcaaggaaagttgaccaaagagttgatcaaaattgaacgcgtgccagctgtccctgcattgctacccagcgagtctcaagggacgatgttacgtattaagcgccgttatttattagatggaaaaccatttgcggttgtcgatcattatttaccgaatactttggttcctactaaactaacggcccttcggcatcgttcactgtataagattttacaggagaatggtcagacgattacacattttcaagataaattcagtgctgtcaccctggcggatagtgagcgggcgttgcttgaaagtcaaacgccattagcgattcggcgcgaacgtaaggggtatgatggtcaccagcggctagttgaattttctattgcgacttatcaaacggatgttgtcccgtatcaaataaattatgacgttttataa

SEQ ID NO: 10630 - protein, 231 aa, Lactobacillus plantarum
METKILYQKVSADLKRRILDGDYEVGGLIPSEGELERYYQVSKITIRKAVEVLVSEGYLEKKSGIGTRVISNDLFNKLTQTQSFTATVGQQGKLTKELIKIERVPAVPALLPSESQGTMLRIKRRYLLDGKPFAVVDHYLPNTLVPTKLTALRHRSLYKILQENGQTITHFQDKFSAVTLADSERALLESQTPLAIRRERKGYDGHQRLVEFSIATYQTDVVPYQINYDVL

SEQ ID NO: 10631 - DNA, 753 bp, Lactobacillus plantarum
  CDS (1)..(753)
atgacaagaccaaatgatgaaggggatgtgagtagtttggcttataagtatgaaacgattgcggatagtctgcgacaagacataaaatccggtaaatatacgccgggcgaattgatgcccgaccagaataaattagctgaaacttttgatacgacacgaattacgattcacaaggccattcaattactgattattgaagggatggtttactccaagcgtggcgcggggacctttgttcgcaaggactttggtttgactgaacggcgccaagaaacgctggtagacaagcccctgggaacaacgcaaacgaatgccggtaaaaaggtgacgagtaaggtgttggaattacaagctcgcttgcctactaagcgggaagcggaacagttgttaatcgatgagatggatccggtgtacgttattcggcggacccgctacgttgatggtaaggtgtgggcgtatgagcatacgattatgccaacgagtatcgtgacgttgacgaagcaagtcctcgaaggctcggtctacggttacttagagcaacatagtggcaagaaaatcgcgggttcacaccgtattatctcggcagcccgagtgacggctgatgacgttgccgcaatgggcgcgactctgaatgatcccgtgttggtcattaatcagattagttacatggatgatggtcaaccctttgaagtctccgaatcacatttcccatacgagacaagtacggtcgtagcggatgttcaaattcattaa

SEQ ID NO: 10632 - protein, 250 aa, Lactobacillus plantarum
MTRPNDEGDVSSLAYKYETIADSLRQDIKSGKYTPGELMPDQNKLAETFDTTRITIHKAIQLLIIEGMVYSKRGAGTFVRKDFGLTERRQETLVDKPLGTTQTNAGKKVTSKVLELQARLPTKREAEQLLIDEMDPVYVIRRTRYVDGKVWAYEHTIMPTSIVTLTKQVLEGSVYGYLEQHSGKKIAGSHRIISAARVTADDVAAMGATLNDPVLVINQISYMDDGQPFEVSESHFPYETSTVVADVQIH

SEQ ID NO: 10633 - DNA, 732 bp, Bradyrhizobium japonicum
  CDS (1)..(732)
atgaattcagcgccgctcgacgaccgcctgccacgctaccagcgcctgcgcgacgacctcgccgcgcggatcaaccgcaatgaatggcggccgggcgagccgatcccgtcggaagccgagttggctgcgcattacggcgttgccatcggcaccgtgcgcaaggcgatcgaccagctcgtcgcggatgccgtgctggagcgccagcagggccgcggcaccttcgtgcgccgcgcgcgcttcaactcctcgctgttccgcttctttcgcttccagtcggagagcggcgagcggcgcgtgccgaagagccgcatcatcaggcgcaagagcgtgccggcgacatcggcggtcgcatccgcactccgcatcccggtcggcgagcccgtgatcagcctgtcgcgcctgcgcctgattgacgacgtcccgctgctcgccgaagagatctggctgcagcaatcgcgctttgcgccgatcctcgacatcgacacagccgagttcggcgacctcctgtatccgctctacgaggagcgctgcggcgaggtcgtggtctccgccgaggaaatcctgacggtcgagaccgccaacgagatgcaggcacgcctgctgcggctcgaggcgcatgcgcctctgattgtcatcgagcgtctcgcgctcgacctcgaacggcggccgatcgaatggcgccgttcgcgcgggccggccaaccgcttccgctaccacgccgagatcaggtga

SEQ ID NO: 10634 - protein, 243 aa, Bradyrhizobium japonicum
MNSAPLDDRLPRYQRLRDDLAARINRNEWRPGEPIPSEAELAAHYGVAIGTVRKAIDQLVADAVLERQQGRGTFVRRARFNSSLFRFFRFQSESGERRVPKSRIIRRKSVPATSAVASALRIPVGEPVISLSRLRLIDDVPLLAEEIWLQQSRFAPILDIDTAEFGDLLYPLYEERCGEVVVSAEEILTVETANEMQARLLRLEAHAPLIVIERLALDLERRPIEWRRSRGPANRFRYHAEIR

SEQ ID NO: 10635 - DNA, 708 bp, Vibrio vulnificus
  CDS (1)..(708)
atgccatcaccgctgtatattcagatcaaacagttcattgaaacaaaaatcgacagtggcgagtggcacatcggctttaagatcgcaactgagctagagctgaccgagcaatttggcgtcagccgcatgaccgtcaataaagccattcgcgatttggtcaatgaggggaaattgcaaaggcgaccacgtttaggcacgtttgtctgtgataaaccagaaaaggcagaatctccactgctcgatgtccgtaacattgccgaagaagtggtcaatcgcggcaagacgcatcacagcaaagtcattcaacagttggtcctcaaagcggatgatacgattgcaaccaaactcggtgtaatgctaggaaccaaagtgttctacagtgaaattattcactacgaggataaggagcctatccagctcgagttgcgctgggttaatagcctctatgcaccccgctatttgcaacaagatttcacccaaatgacccccaaccagtatctttcggagaactgccctttgagtgcgatggaacatacggttgaagccatcatgcccgatacccgtattcgccaagagctcaacatgaaagtcaatgaaccttgtctgctgctcaaccgtcgtacttggagtgaagacaaactcgtcagcaccgcactgctgtatcatccgggtaatcgctacaagctgagctctaagattttgttgtaa

SEQ ID NO: 10636 - protein, 235 aa, Vibrio vulnificus
MPSPLYIQIKQFIETKIDSGEWHIGFKIATELELTEQFGVSRMTVNKAIRDLVNEGKLQRRPRLGTFVCDKPEKAESPLLDVRNIAEEVVNRGKTHHSKVIQQLVLKADDTIATKLGVMLGTKVFYSEIIHYEDKEPIQLELRWVNSLYAPRYLQQDFTQMTPNQYLSENCPLSAMEHTVEAIMPDTRIRQELNMKVNEPCLLLNRRTWSEDKLVSTALLYHPGNRYKLSSKILL

SEQ ID NO: 10637 - DNA, 699 bp, Streptococcus mutans; identical to SEQ ID NO: 485
  CDS (1)..(699)

SEQ ID NO: 10638 - protein, 232 aa, Streptococcus mutans; identical to SEQ ID NO: 486

SEQ ID NO: 10639 - DNA, 699 bp, Streptococcus agalactiae; identical to SEQ ID NO: 2118
  CDS (1)..(699)

SEQ ID NO: 10640 - protein, 232 aa, Streptococcus agalactiae; identical to SEQ ID NO: 484

SEQ ID NO: 10641 - DNA, 708 bp, Shewanella oneidensis
  CDS (1)..(708)
atggctacgcctaagtttgcagaaataaagcaatacatcactggctgtatcgagtccggtgagtgggaagaaaatgcccgcgtgccctcggaaaatcagctggctgagctgtttgtctgtagccggatgacggcgcgtcgcgccttgacagagctgacagataacggcgtgcttgagcgttcgcaggggcttggcacctttgtggcggggcgtaagtcgcaatcctccatgttggcgatccgcaatatcgccgatgaaattaaagaccgtggccatggttacagtgtgcagcaattagcacttgagcaagtgaacgctaccgcgccgattgctatcgcattggcgctcgacgtcggcagtccggtatttcattcaatattagtgcattgcgagcagggcgtgccgctgcaagtcgaggagcgttatgtaaatcccgcctttgcgcctgactacttagtgcaggattttagcgagcaaacaccccatgaatacctgtcgcaggtggctccgctgaccgaggcgcaccacaccatcgaagccattatcgccagtagcgaattgcagcagaggttagccattccggcgaccgaaccctgcttacagatttcacgccgcacttggtcacgccaaggggtggtgagttttgccaaattagtacatccgggtagccgctttaaactcggtggtcacctgacattcaataaataa

SEQ ID NO: 10642 - protein, 235 aa, Shewanella oneidensis
MATPKFAEIKQYITGCIESGEWEENARVPSENQLAELFVCSRMTARRALTELTDNGVLERSQGLGTFVAGRKSQSSMLAIRNIADEIKDRGHGYSVQQLALEQVNATAPIAIALALDVGSPVFHSILVHCEQGVPLQVEERYVNPAFAPDYLVQDFSEQTPHEYLSQVAPLTEAHHTIEAIIASSELQQRLAIPATEPCLQISRRTWSRQGVVSFAKLVHPGSRFKLGGHLTFNK

SEQ ID NO: 10643 - DNA, 729 bp, Oceanobacillus iheyensis
  CDS (1)..(729)
atggagaaaaaccaatctttacatgcttatattaagcaggagctgttacaacgaattaagactaatcaatacaaaaaaggagaaaaaatcccacctgagttagaactttgcaaagattttaatgtaagccgtactactgttcgcacagcgttaaatcaacttacactagaaggttacttagttcgacagcaaggaagtggaacatatgtagctgatgagaaagtgaagcagacattaacgcagactgttaaacgatatagtgatcagttagctgttcaggggaaagtgtcagatattaatgtattagatatttctgttattgctgctgatgaaatgataacttccagtctgaatgtaaatataaaagacccaatacagcgaattgaacgagtacgtaaagcaaatggtcagccaacgcagtatgaaattgcgtttattccttggtccattgcatcaggaattacttacacagatgcggaaacttctttatataaatcgcttaaggaaaagtttaatgtttttatagctaaaacttatgaaaatatggaaataacttttgcagatgatcaaatttgtaaatatcttgaatgtgaacctgggcttccatgtttttacatagaaacaattgcagaagatgaagaaggaaggaaaatagaattttcaaagtcatttttccgtggtgataagactaactttacgatagaacgaacttatccagaatcaaattaa

SEQ ID NO: 10644 - protein, 242 aa, Oceanobacillus iheyensis
MEKNQSLHAYIKQELLQRIKTNQYKKGEKIPPELELCKDFNVSRTTVRTALNQLTLEGYLVRQQGSGTYVADEKVKQTLTQTVKRYSDQLAVQGKVSDINVLDISVIAADEMITSSLNVNIKDPIQRIERVRKANGQPTQYEIAFIPWSIASGITYTDAETSLYKSLKEKFNVFIAKTYENMEITFADDQICKYLECEPGLPCFYIETIAEDEEGRKIEFSKSFFRGDKTNFTIERTYPESN

SEQ ID NO: 10645 - DNA, 726 bp, Oceanobacillus iheyensis
  CDS (1)..(726)
atgtctattcgtgcggatgcaaggcatttatatttgcaagtaatcgatgaaattcggaaagaaattgataacggcgtttatcttgagaatgagaaactcccatctgaatatgaattatcaaaacatttaggtgtttcacgggctacattgagggaagcacttcgaattctagaagaagataatgtagtgacaagaagacatggtgtaggaacttttgtaaatccaaagcccattttctcatctggaattgaagaacttaccagtgttacgcagatgattgaacaatctgggaaatcggcagggtcgcaatatttatctgctgaagttgtccaagcaacggatgaagatcgctcaaaattcaacaatccctctctatcatcgttatctaaaattgaacgtgttcgtacggctgatagtgttcccgtagtattttgtattgataagattcccactgaattgattccaatcgaggtattacgtgaagaggcgtctatatttaatgtatttgaatcctatacaaagaaacgtgttgcatatgcggttacatatattgaaccagtaagttaccatgatcgaatttataatatattaaattatgcttctgaccaaccgttactcttattaaaacaagtgcattatacaagcgatgacgagcctgtactgtactcatctaattattttcgagcagatacatttagtttttatgtcttacgaaaacgtgtttaa

SEQ ID NO: 10646 - protein, 241 aa, Oceanobacillus iheyensis
MSIRADARHLYLQVIDEIRKEIDNGVYLENEKLPSEYELSKHLGVSRATLREALRILEEDNVVTRRHGVGTFVNPKPIFSSGIEELTSVTQMIEQSGKSAGSQYLSAEVVQATDEDRSKFNNPSLSSLSKIERVRTADSVPVVFCIDKIPTELIPIEVLREEASIFNVFESYTKKRVAYAVTYIEPVSYHDRIYNILNYASDQPLLLLKQVHYTSDDEPVLYSSNYFRADTFSFYVLRKRV

SEQ ID NO: 10647 - DNA, 747 bp, Oceanobacillus iheyensis; identical to SEQ ID NO: 481
  CDS (1)..(747)

SEQ ID NO: 10648 - protein, 248 aa, Oceanobacillus iheyensis; identical to SEQ ID NO: 482

SEQ ID NO: 10649 - DNA, 699 bp, Escherichia coli O6; identical to SEQ ID NO: 477
  CDS (1)..(699)

SEQ ID NO: 10650 - protein, 232 aa, Escherichia coli O6; identical to SEQ ID NO: 478

SEQ ID NO: 10651 - DNA, 798 bp, Corynebacterium efficiens
  CDS (1)..(798)
atgaccagatgcgctagagttgtggatatgtctgctgctgagcgcacggaagatggcgccaccctgccccaccgggttctgactgatgggcccaaaccaaaacaccagcagctgcgtgagatcctcgaggagctgtgcaccacccagttgcaaccgggtgacatgctgcccggggaacgcgtgttggaggacacctacggtgtcagccgcatcaccgtgcgtcgtgccatcggggatctggtggcgtccggtcgcctcaaacgtgcccgtggcaagggcaccttcgtggcacatgcgccactggtctcccggttgcatctggcgtccttctcggcggagatggccgcccagaacctggtggccaccagccgcatcctgtcgtcgtcacgtggcgcggcaccggatgagatcgcggagttcttcggcaccgagcgcggcgcccagcacatcaccctgcgccggctgcgtctgggtaatggccgcccctatgccatcgaccacggatggtataacgccgtatatgcccctgacctgctagaaaatgatgtctacaactccgtctacgccatcctggaccgcgtgtacaacgtgcccgtgacccacgcggagcagacggtcaccgccgtcgcggcggacgaggacaccgccaagcttctcgacgtcccgaccggcgccccactgctgcggatcctgcggcagtccatgtcgggggagaaacccatcgaatggtgtgtctcggtgtaccggacagatcgttactccctgaaaactatggtcacccgttccgaagatctctga

SEQ ID NO: 10652 - protein, 265 aa, Corynebacterium efficiens
MTRCARVVDMSAAERTEDGATLPHRVLTDGPKPKHQQLREILEELCTTQLQPGDMLPGERVLEDTYGVSRITVRRAIGDLVASGRLKRARGKGTFVAHAPLVSRLHLASFSAEMAAQNLVATSRILSSSRGAAPDEIAEFFGTERGAQHITLRRLRLGNGRPYAIDHGWYNAVYAPDLLENDVYNSVYAILDRVYNVPVTHAEQTVTAVAADEDTAKLLDVPTGAPLLRILRQSMSGEKPIEWCVSVYRTDRYSLKTMVTRSEDL

SEQ ID NO: 10653 - DNA, 792 bp, Corynebacterium efficiens
  CDS (1)..(792)
atgggggtttcaccccctccccttgcgctgcgcaacctccgggttgacggcactataaggaccatgacttcccgttctggtcccgcctacgcccggatcgccgctgagatcatcgcccggatcgaggccaatgccctctcccccggcgaccggttgccggcggaacgtgacctcgccgaggagttcggcgtcgcacgcatgacggtgcggcaggccctggaccagctgcagatggatggggtcatcggccggaaacgtgggcgctcggggggtagtttcgtcctgggcaaccgccccgtggtggaactcacccaccgtcggggcattctcccccagcttgatgcccgcggccatgcggtggtgaccgaggtgctcacggtggaggagttcaacgccccggccacgctcgccgcgaaactgcgggtgcccttccgggagccggtggtgaggatcgtgcgggtccaccatgccgcggacaccccggtgttgatcagcgattcccacttccccgcccacctggtgcccggcatcgcacacatggacctcaacgggtccctggcggagttattggaccgtcactggtccctgtccccggcgcgcaaggaggagaccctggccccgggcgtggccacccccttcgagcaggaacacctgggcgtgagccccgccatgccgctgctgcggatccagcggatcaccgagctgcacaaccaccgtgtgctggagtactccgaggatgtgctgcgctcggatgctgcggcggtgcgggtgtccacggcgttctccaactag

SEQ ID NO: 10654 - protein, 263 aa, Corynebacterium efficiens
MGVSPPPLALRNLRVDGTIRTMTSRSGPAYARIAAEIIARIEANALSPGDRLPAERDLAEEFGVARMTVRQALDQLQMDGVIGRKRGRSGGSFVLGNRPVVELTHRRGILPQLDARGHAVVTEVLTVEEFNAPATLAAKLRVPFREPVVRIVRVHHAADTPVLISDSHFPAHLVPGIAHMDLNGSLAELLDRHWSLSPARKEETLAPGVATPFEQEHLGVSPAMPLLRIQRITELHNHRVLEYSEDVLRSDAAAVRVSTAFSN

SEQ ID NO: 10655 - DNA, 723 bp, Streptococcus pyogenes
  CDS (1)..(723)
atgccaaaagaacaaccactctatctacagattgttgatgacttggaagtgaaaatcaaaaagagcatgacagaaaacgataagttgttgtcagaacgagaattaagtgacctttacggtgttagtcgtatcacgattagactggctcttaaggaattggaattacgagacttaatttataaaaagcagggcaaggggacttatgtttcaggaatcaaagaacctgtcactgatttatcaagtacttacagctttacagagcaaatgaaaaaagtggggaaaactcctaaaacagagattctttcttttgaacagtatcaggtaacaccttacttgtctggtctcttagagtttgatctcgatacagaagtttttgaattagaacgcctaaggattgcagatgatatgcccttgatgtttgaacgatcctatattcctgcgcagctttttcaggggttaagcattgcggacttgaagcgtaaagctttgtacgatatctttgcaaaggactatcaagagacaatccgtcttgcagaagaagagttttatgccagcattgccttggactatgaagcagaccttttgggaatcaaaaaaggagatcctgtcttacatattattcgtaaaacttataacgataaaaatattttgatcgaatttactttcagtattgcaagagcagaccagtttaggtatagggtacaacatcaccccaatggttaa

SEQ ID NO: 10656 - protein, 240 aa, Streptococcus pyogenes
MPKEQPLYLQIVDDLEVKIKKSMTENDKLLSERELSDLYGVSRITIRLALKELELRDLIYKKQGKGTYVSGIKEPVTDLSSTYSFTEQMKKVGKTPKTEILSFEQYQVTPYLSGLLEFDLDTEVFELERLRIADDMPLMFERSYIPAQLFQGLSIADLKRKALYDIFAKDYQETIRLAEEEFYASIALDYEADLLGIKKGDPVLHIIRKTYNDKNILIEFTFSIARADQFRYRVQHHPNG

SEQ ID NO: 10657 - DNA, 765 bp, Streptomyces sp; identical to SEQ ID NO: 2126
  CDS (1)..(765)

SEQ ID NO: 10658 - protein, 254 aa, Streptomyces sp; identical to SEQ ID NO: 468

SEQ ID NO: 10659 - DNA, 762 bp, Corynebacterium glutamicum
  CDS (1)..(762)
atgaccaccgaagctcccatttggccagccgaactcttcgaagacctcgaccgcaacggaccaatccccctctacttccaagtagcccaacgcctcgaagacggcatccgcagcggagtcctcccacccggagcacgcctagaaaacgagatctccgtggcgaaacacctcaacgtatcccgccccaccgtccgacgcgccatccaagaagtcgtagacaaaggcctcttagttcgccgccgcggtgttggcacccaggtcgtccaaagccacgtcacccgcccagtcgaactgaccagtttcttcaacgacctcaaaaacgccaacctggaccccaaaacccgagtcctcgagcaccgcctccttgcagcaagttccgccatcgcagaaaaactcggagtttccgcaggtgacgaagtcctcctcatccgccgcctccgctccaccggagacatccccgtagcgatcctggaaaactacctccccccagcgttcaacgacgtctccctcgacgaactagaaaagggtggactctacgatgcgctgcgcagccgaggtgttgtcttaaaaatcgccaaccagaaaatcggtgcgcgccgagcagtcggtgaagaaagcaccctcctcgacatcgaagacggcggaccacttctcaccgtcgaacgcgttgcattggataattccggccaagtaatcgagttgggaagccactgctaccgcccagatatgtacaactttgaaaccactctggtggccaggtaa

SEQ ID NO: 10660 - protein, 253 aa, Corynebacterium glutamicum
MTTEAPIWPAELFEDLDRNGPIPLYFQVAQRLEDGIRSGVLPPGARLENEISVAKHLNVSRPTVRRAIQEVVDKGLLVRRRGVGTQVVQSHVTRPVELTSFFNDLKNANLDPKTRVLEHRLLAASSAIAEKLGVSAGDEVLLIRRLRSTGDIPVAILENYLPPAFNDVSLDELEKGGLYDALRSRGVVLKIANQKIGARRAVGEESTLLDIEDGGPLLTVERVALDNSGQVIELGSHCYRPDMYNFETTLVAR

SEQ ID NO: 10661 - DNA, 699 bp, Streptococcus pyogenes
  CDS (1)..(699)
atgttaccagcttatataaaaattcatgatgcaattaaaaaagacattgatctgggcatctggccaattggtagtcgcttaccaagtgaacgacatttagcggaacatttcaccgttagtcgaatgactctacggcaggctattacattactagtagaagaagggattcttgaaaggcggataggaagtggtacttatgttgccagtcatcgtgttcaagaaaaaatgcgaggaacaacaagtttcacagaaattatacgctcccaaggacgacaaccctcctctaaattattatcctatcaaaagcaattagctagtgataccgaagttaaagaattgaacttagacaaaacagacttggtcattcgaatggaacgtatccgctatgcagacagtgtccctttggtgtacgaaattgcttcaatcccagaaaaatttataaaaacggttaaacgagctgatattacagaacacttttttcactcattgatagcaaatggttacgagattggtaaaagtaaacagacaatctacgctaagctagcaagtgagcgtgtagcctcctacttggaagttgctaaaggacatgccattttggctctaactcaggtgtcttactttacagacggcaaaccttttgagtatgtccgcagtcagtatatcggtgaccgttttgaattttacttagaaaataattag

SEQ ID NO: 10662 - protein, 232 aa, Streptococcus pyogenes
MLPAYIKIHDAIKKDIDLGIWPIGSRLPSERHLAEHFTVSRMTLRQAITLLVEEGILERRIGSGTYVASHRVQEKMRGTTSFTEIIRSQGRQPSSKLLSYQKQLASDTEVKELNLDKTDLVIRMERIRYADSVPLVYEIASIPEKFIKTVKRADITEHFFHSLIANGYEIGKSKQTIYAKLASERVASYLEVAKGHAILALTQVSYFTDGKPFEYVRSQYIGDRFEFYLENN

SEQ ID NO: 10663 - DNA, 723 bp, Streptococcus pyogenes
  CDS (1)..(723)
atgccaaaagaacaaccactctatctacagattgttgatgacttggaagtgaaaatcaaaaagagcatgacagcgaacgataagttgttgtcagaacgagaattaagtgacctttacggtgttagccgcatcacgattagactagctcttaaagaattagaactacggggcttaatttataaaaagcagggcaagggaacctatgtttctggtatcaaggaacccgccactgatttatcaagtacatatagctttacagagcagatgaaaaaaatgggaaaaatgcctaaaacagaaattctttcctttgaacagtatcaagtgacaccctacttatctggtctcttggagatagatgttgatactgacgtttttgaattagagcgtctaaggattgcagatgatatgcccttgatgtttgaacgatcctatattcctgctcagccttttcaggggttaagcattgcggacttgaagcgtaaagctttgtacgatatctttgcaaaggactatcaagagacaatccgtcttgcagaagaagagttttatgccagcattgccttggactatgaagcaggtctcttaggcattaaaaagggagatcctgtcttacatattattcgtaaaacttatgatgataaaaatatcttaattgaattgactttcagtattgcaagagcagaccagtttaggtatagggtacaacatcaccccaacggttaa

SEQ ID NO: 10664 - protein, 240 aa, Streptococcus pyogenes
MPKEQPLYLQIVDDLEVKIKKSMTANDKLLSERELSDLYGVSRITIRLALKELELRGLIYKKQGKGTYVSGIKEPATDLSSTYSFTEQMKKMGKMPKTEILSFEQYQVTPYLSGLLEIDVDTDVFELERLRIADDMPLMFERSYIPAQPFQGLSIADLKRKALYDIFAKDYQETIRLAEEEFYASIALDYEAGLLGIKKGDPVLHIIRKTYDDKNILIELTFSIARADQFRYRVQHHPNG

SEQ ID NO: 10665 - DNA, 768 bp, Xanthomonas campestris
  CDS (1)..(768)
atgagaacacccatggccaaggccaacgcggagggggacaagcgactggacgacctgcgtcttgacgcctccgcgcccacaccgctgtacctgcagctggccgccaagctcggcgaggcgatccgcggtggccactggaaggccggcgaagcgctgcccgccgagcgccagctgtgcgagcggctgcagatttcgcgggtcaccttgcgccaggcggtggatgcgctggtcgagcaaggcctggtctcgcgtcgccagggcgccggcacctttgtcacctcgcatatccagcaccagctcagcggcttgaccagtttcagtgagacgctgcgcatcaaaggctacgagcccggcaccaagtggctggaacggcgcctgcggcccgcgcatggcgaggaaatcctgcgcctggggctgtcgccggatgcggcggtcgcctcgctcacccgcctgcgcagcgccgatgaccgcgtcatggcctacgaacacgccgtgttgccgcagcgcgtggtcgccgacccggagcaggtgggcgattcgctctacagttttctcgatgcgcaaggcaccccggtggtgcgtgcgctgcagtacttccgcgcgatcaatctgccggcacggctggccgaacacctgcgcatgaagaccggcgaggcgatcctgcatgtggtgcgcgtgggctacacccgcgacggcagcgcgatcgaactcaccgacacctattgccacaacgacttctacgacttcgtcgccgaactgcgccgctga

SEQ ID NO: 10666 - protein, 255 aa, Xanthomonas campestris
MRTPMAKANAEGDKRLDDLRLDASAPTPLYLQLAAKLGEAIRGGHWKAGEALPAERQLCERLQISRVTLRQAVDALVEQGLVSRRQGAGTFVTSHIQHQLSGLTSFSETLRIKGYEPGTKWLERRLRPAHGEEILRLGLSPDAAVASLTRLRSADDRVMAYEHAVLPQRVVADPEQVGDSLYSFLDAQGTPVVRALQYFRAINLPARLAEHLRMKTGEAILHVVRVGYTRDGSAIELTDTYCHNDFYDFVAELRR

SEQ ID NO: 10667 - DNA, 729 bp, Xanthomonas campestris
  CDS (1)..(729)
atgaacgtctcacgccagtccgccatcaccgatgccatcagcgcgcagatcgctgcgggcgaatggggcccggaccagcgcctgccagtggagcgcgcgttggccgagcgtttcggctgcacgcgcatcaccctgcgtgaagccctgcagcaactcgaagccgaaggccgcatctaccgcgagaatcggcgtggctggttcgtcagcgcaccgcgcgtgcgctacgaccccaccagcattgccggcttcatgcagtacgtggccgcgcaagggcgcaagccgcgcaccgagctgttgagcgccaccctgcagccagccggcgcggcgtatgccgccgcgctgcgcctgcaccgcctgcaagagccggtgttcgtgctgcagcggcggcgctggatcgatcgccgcgcggtgctgctggaaaccaacgtggtgctggccgcctgggcacccggcctgctcgagcatgatctggccggctcactgtcgagcgtgttcaaccagaaactgggcctgttcctgagccgcagccagttgtcgatgcacccggccggcctggatgcggcgcaggcaatcctgctgcagtccaccaccggcacgccgtgctttcgcctgcagcgggtgagctttgccgaggacggcagcgcggtggaactggatatcgaatcctggcgccacgatgcgctggatgtggtggtgcgcaccgaggcgccgacgcattcggcgctgtag

SEQ ID NO: 10668 - protein, 242 aa, Xanthomonas campestris
MNVSRQSAITDAISAQIAAGEWGPDQRLPVERALAERFGCTRITLREALQQLEAEGRIYRENRRGWFVSAPRVRYDPTSIAGFMQYVAAQGRKPRTELLSATLQPAGAAYAAALRLHRLQEPVFVLQRRRWIDRRAVLLETNVVLAAWAPGLLEHDLAGSLSSVFNQKLGLFLSRSQLSMHPAGLDAAQAILLQSTTGTPCFRLQRVSFAEDGSAVELDIESWRHDALDVVVRTEAPTHSAL

SEQ ID NO: 10669 - DNA, 726 bp, Thermoanaerobacter tengcongensis
  CDS (1)..(726)
atgttattgcctgagaaaaagccgctgtatgagcttgctttaaaaaagatggaggaacttataaagacgggacaatggaaggaaggcagtaaacttccttctgagtcccagcttgcaaaacagtttggcataagcagagccactttgagagaagctatgaggattctggaagaggaaggattaattgtaaagcagcaaggggtcggtacttttgtgagaagaaaaccgctcataaaaagcggtttggaggagttgttcagcgttactgctttaattgaaaggcagggaatggtgcctggtaccaaagattttactgtgtataaattgcctgcaactgagaatgaagcaaagcatttgaggataaagccgggggatataatatacaaagtagagagaattaggacggctgacaatgttcctgttgtttactgcatagatagattgccagagaacatcgtaggagagtcttttaccggatttgaacagtcaatttttagttatcttgaggcagagcattctataagaattacttatgctatttcccacatcagagttataaagcacgaccctgtagttgagaaaaagctcatgatggacaaaaacgattcgatattgcttttagaacaagttcattatgatgaaaataacacgccaattttgttttcgtcaaattattttaatgcctctaaatttgacttttacattgtcagaaaaagaacattgtga

SEQ ID NO: 10670 - protein, 241 aa, Thermoanaerobacter tengcongensis
MLLPEKKPLYELALKKMEELIKTGQWKEGSKLPSESQLAKQFGISRATLREAMRILEEEGLIVKQQGVGTFVRRKPLIKSGLEELFSVTALIERQGMVPGTKDFTVYKLPATENEAKHLRIKPGDIIYKVERIRTADNVPVVYCIDRLPENIVGESFTGFEQSIFSYLEAEHSIRITYAISHIRVIKHDPVVEKKLMMDKNDSILLLEQVHYDENNTPILFSSNYFNASKFDFYIVRKRTL

SEQ ID NO: 10671 - DNA, 726 bp, Clostridium perfringens; identical to SEQ ID NO: 471
  CDS (1)..(726)

SEQ ID NO: 10672 - protein, 241 aa, Clostridium perfringens; identical to SEQ ID NO: 472

SEQ ID NO: 10673 - DNA, 723 bp, Clostridium perfringens
  CDS (1)..(723)
atgatagataaaaatagtcctatacctgtgtattaccaattaaaagagatgataaaagaaaagatagcagatggcacttggcaagtaggacagtgtatagcaagcgaaagagagttaacagaggcttatggagtaagtcgaatgactgtcagacaggctttaggagaactagtacaagaaggtcttcttgttagagaaaaaggaaaaggaaccttcgtatgtgaacctaaagtaaagcaagaagatatgatgagtttctcagaaattataaaaaaagcaggaagaagtttaataactaaagttatagattttgaagttattaatacccctgaagaattagcagatacttttgatgtagaaaaaatatataaaataaatagattaagattagttgatggtgaagctgttgctaatgaggttgtttatattccttgtgaatattgtggctttgtaactagagatgatttagaggggtccttatttaagttattagaagaaaagggacatattatagaaagtacagaatcatctttagcagctgtaataatggatgatgagctaaaagctttatttaatgtgaataaacaagtacctcttttaaaaagtcataacacagctttaaattcagaaggcgaaataatttacgttgaagatgcaatttataggtcagacaaatatatattagaaattaatatttctaaaagagaggggaaattgaaatga

SEQ ID NO: 10674 - protein, 240 aa, Clostridium perfringens
MIDKNSPIPVYYQLKEMIKEKIADGTWQVGQCIASERELTEAYGVSRMTVRQALGELVQEGLLVREKGKGTFVCEPKVKQEDMMSFSEIIKKAGRSLITKVIDFEVINTPEELADTFDVEKIYKINRLRLVDGEAVANEVVYIPCEYCGFVTRDDLEGSLFKLLEEKGHIIESTESSLAAVIMDDELKALFNVNKQVPLLKSHNTALNSEGEIIYVEDAIYRSDKYILEINISKREGKLK

SEQ ID NO: 10675 - DNA, 708 bp, Clostridium perfringens
  CDS (1)..(708)
atgtctagtaagtatttaaaaatatataatgatattgttgggaaaatagatagtggaatttttgaagcgaatactaaattaccttcagagtcacaacttatggatgaatataatgtatctagagatactgtaagaaaatccttgaatttattagagcaaaatggatatattgaaaagtctaaaggtaagggatcttttgtacttgatatgaataaatttgattttcctgtgtcaggtataaagagttttaaagagattgaaaatagcttaggaaaagagtgcgaaactatattagaggaattaacattaaaaagtcctagtgatagccttatgaaaaaactagaggtttctcctaataaatatgtttggagtgtagtaagagttagaaatatagatggtgaaaagataattttagataaggactatttaaattcagagtttgttccaagacttacagaagaaatatgcaaggattctttatataaatatatagagggagaattaggattaaaaatagcctatgctgaaaaagaaataacagtacaaactgctactgaggaagatcaaagacttttagatttaagaggatatgatatggtagctgtggttaaaagctatacatatttagaaggaagaaaattatttcaatatacagagtcaagacatagaccagataaatttaagtttgtagattttgcaagaagatag

SEQ ID NO: 10676 - protein, 235 aa, Clostridium perfringens
MSSKYLKIYNDIVGKIDSGIFEANTKLPSESQLMDEYNVSRDTVRKSLNLLEQNGYIEKSKGKGSFVLDMNKFDFPVSGIKSFKEIENSLGKECETILEELTLKSPSDSLMKKLEVSPNKYVWSVVRVRNIDGEKIILDKDYLNSEFVPRLTEEICKDSLYKYIEGELGLKIAYAEKEITVQTATEEDQRLLDLRGYDMVAVVKSYTYLEGRKLFQYTESRHRPDKFKFVDFARR

SEQ ID NO: 10677 - DNA, 723 bp, Ralstonia solanacearum
  CDS (1)..(723)
atgcccgccgacctccgcctgccccgctatcagcaattgcgcgacgacctggccgcgcaggtcgcccggcagcagtggcgcccgggcgacgccatccccaccgaggccgagctggccaagctctacaacgtggcggtcggcaccgtgcgcaaggcgatcgacgtgctcgtcgccgaggggctgctggagcgcttccaggggcgcggcaccttcgtgcgccgggccagcttcgccagttcgctgttccgcttcttccgcttccagaacgagcgcggcgagcggcgcatccccgagagccgcatcctcaagcgcgacgtgctcgacgcaccgtccgcgccggccgccggactgcagatcgagaccggtgccccggtcatccgcctgacgcgcctgcggctgctcgatgccgcaccgctgctggccgaagagatctggctgccatacgaccgcttcgaaccgctggccacgctggagcccggtgccttcggcgacctgctgtacccgctctacgaaaagcagtgcggccagatcgtcgccagcgccgaagagacgctcaccgccgaggccgtcaatgcgacctacgcacgcctgctgcgcatcaagccgggcgatccggtgatggtgatcgagcgcatcgcgcgaggctacgaccgcgtgccgctggagtggcggcgctcgcgcggcgcggcggcgcatttccggtaccacgtcgacatccggtag

SEQ ID NO: 10678 - protein, 240 aa, Ralstonia solanacearum
MPADLRLPRYQQLRDDLAAQVARQQWRPGDAIPTEAELAKLYNVAVGTVRKAIDVLVAEGLLERFQGRGTFVRRASFASSLFRFFRFQNERGERRIPESRILKRDVLDAPSAPAAGLQIETGAPVIRLTRLRLLDAAPLLAEEIWLPYDRFEPLATLEPGAFGDLLYPLYEKQCGQIVASAEETLTAEAVNATYARLLRIKPGDPVMVIERIARGYDRVPLEWRRSRGAAAHFRYHVDIR

SEQ ID NO: 10679 - DNA, 729 bp, Ralstonia solanacearum
  CDS (1)..(729)
atgacgcctcgcctgcccaaataccttgaactggctgaccgcatccggctcgatatcctgcacggtgccttgccggccggcagtgtcgcgcccagcgagaacgaagtcgcgcagtgctacggcgtgtcgcgcctgaccgcgcgtcgtacgctcaacgagctggcgcagcgcggcctgctcaagcgctcgcgcgggcagcgcagcgtggtgctcgatcgtgccgggccgcatcgccccgtgctgtacgctccggggcagtcggacgcggcgctcgaatacgtgccgggggcggtttacagcgtcagcgcgttccgccaggagacggccgacgcgaccgtggcggccgcgctggatctgcaggtgggtgcgccggtggcgcatgtggagcgccgggctcgggtcgacggagcccccatcatgctgctgcggacatggctgacatcgcggctggcggccatgctggaggcgcgcgatttcgaggaccgcctgttcgtccaggtcttccagcgcgccaacctgaccatcgcgcgctcgcgcgaggcgccgctggcctgcgtggcggacgcgcaccaggcgcgcgagcttgatgtggcgccgggggtgcccctggtgcgcgtgcgccgtatcggctacagcgtcgccgatgtgccgatttccctgacttattgcgacttttcccccgagcgctatacgcgcgaagtggatatccgcgtattgcagaccgattga

SEQ ID NO: 10680 - protein, 242 aa, Ralstonia solanacearum
MTPRLPKYLELADRIRLDILHGALPAGSVAPSENEVAQCYGVSRLTARRTLNELAQRGLLKRSRGQRSVVLDRAGPHRPVLYAPGQSDAALEYVPGAVYSVSAFRQETADATVAAALDLQVGAPVAHVERRARVDGAPIMLLRTWLTSRLAAMLEARDFEDRLFVQVFQRANLTIARSREAPLACVADAHQARELDVAPGVPLVRVRRIGYSVADVPISLTYCDFSPERYTREVDIRVLQTD

SEQ ID NO: 10681 - DNA, 822 bp, Ralstonia solanacearum
  CDS (1)..(822)
atgcccgatgccgtggtaccgctttaccaccagatttacgtcgtgctgcgccagcagattctcgaaggcaagttcggtgacggaccgatgcccggcgagatcgaactggcgcggcagttcggtgcatcgcgcgtcaccatgcggcgcgtgttcgactacctcgtcaaggaaggcctggtgcgccgccatcgcggcatgggcaccttcgtcgtgcgcccggacgatccggaggcggccggcggcagccagaccctgctgcagaacatcatcgacgtcggcgagcggacgtccgccgtggtggtcgaattcgaagacgtgatggcgccgcccgacgaagccaagctgctcgaggtcgcccccggcacgccgatcaagaagctggtccgcgtgcgccacctggaagacacgccgatggcgctcatcaccacctggctgccgctggatgtgaccgtcaagctgacgccggagcgcctgacgaaccagtcgctgctgcggctgatcgaggcctcgggtgtgcgcatcgaccgggcctcccaggtggtatcggcgcgcctggcggacgtggcgacggcgcaatacctggacatcgccgtgggcgcgccgttgctgtccgtgcagcgcatcgtgcgcgcgatgagcgggcgcccggtgcagctgctgcagggcctctaccggcccgaccgctacgagtaccgcatggagctgtcgcgcgtgggcgaagaccgtgcccgcctgtggatcgacaacgccggccgcggccgcagcgaggacgaagacgaggaagacgaacagggctccccgcgcgacggccggcggggctga

SEQ ID NO: 10682 - protein, 273 aa, Ralstonia solanacearum
MPDAVVPLYHQIYVVLRQQILEGKFGDGPMPGEIELARQFGASRVTMRRVFDYLVKEGLVRRHRGMGTFVVRPDDPEAAGGSQTLLQNIIDVGERTSAVVVEFEDVMAPPDEAKLLEVAPGTPIKKLVRVRHLEDTPMALITTWLPLDVTVKLTPERLTNQSLLRLIEASGVRIDRASQVVSARLADVATAQYLDIAVGAPLLSVQRIVRAMSGRPVQLLQGLYRPDRYEYRMELSRVGEDRARLWIDNAGRGRSEDEDEEDEQGSPRDGRRG

SEQ ID NO: 10683 - DNA, 825 bp, Ralstonia solanacearum
  CDS (1)..(825)
atggtgaaatcgacagctatgtcgagtgcctccacttccaattccgccgccgtgccgccgtctccgggcagcgaggcgggcgcgtcgcccgcgggcgtgggagccggggcgcccaccttcagcccgctgtaccagcagatcaagacgctgatcctgcagagcctgcaggccggcgagtggaagccgggcgagatgatcccctccgagatggaactggcggcccgctacaaggtcagccagggcacggtgcgcaaggccatcgacgaactggcggccgaaaacctggtcgcgcggcggcagggcaagggcaccttcgttaccacgcattacgaagagggcgtgcagttccgcttcctgcggttgatgccggagcagggcgagcagcactatccgagcagccgcgtgctggagtgcaagcgcctgcgcgcgcccgccgagatcgcccgcctgctcgacctcaagccgggcgacagcgtggtgcagatccgccgcgtgctgttcttctccggcgagccgaccgtgttcgaagagatctggctgcccggctcgagcttcaagggtctgacggccgaaaagctcaccgactggaaggggccgatgtacgcattttttgaggccgagttcggtgtgcgcatgttgcgtgccaccgagcgcatccgcgccgtggccgcggatgcgggcacggccgggctgctgtcggtggcgccgggttcgccgttgctgtcggtcgagcgggtgtcgcacacgtttggtgacaagccggtggagctgcgtcgcggcctgtatgtcacgacgcggcactattaccagaatgaattgagttga

SEQ ID NO: 10684 - protein, 274 aa, Ralstonia solanacearum
MVKSTAMSSASTSNSAAVPPSPGSEAGASPAGVGAGAPTFSPLYQQIKTLILQSLQAGEWKPGEMIPSEMELAARYKVSQGTVRKAIDELAAENLVARRQGKGTFVTTHYEEGVQFRFLRLMPEQGEQHYPSSRVLECKRLRAPAEIARLLDLKPGDSVVQIRRVLFFSGEPTVFEEIWLPGSSFKGLTAEKLTDWKGPMYAFFEAEFGVRMLRATERIRAVAADAGTAGLLSVAPGSPLLSVERVSHTFGDKPVELRRGLYVTTRHYYQNELS

SEQ ID NO: 10685 - DNA, 729 bp, Xanthomonas oryzae
  CDS (1)..(729)
atgagcgtgtcgcgccagcacaccatcaccgaagcgatctccgcacagattgcagcaggcgaatggggtcaggatcaacgcttgccggtggaacgcgcattggccgagcggttcggctgcacccgcatcacgctgcgcgaagccttgcaacaacttgaagccgaaggccgcatctaccgcgagaatcgtcgcggctggttcgtcagcgcgtcgcgcgtgcgctacgaccccaccagcatcgccggtttcatgcagtacgtggccgcgcaagggcgcaagccgcgcaccgaattattgagcgctaccagacaggtcgcgggcgctgcctacgctgcggcattgcgattggatagcccgtacgacgaggttttcgtgctgcaacgtcggcgttggatcgatcgtcgcgccgtgctgctggaaaccaatgtggtgctcgcggcctgggcaccgggcctgctcgaacacgatctggccgggtcgctgtcgacggtgttcaaccagcaactcggcctgtttctcagccgcgcgcaactgtcgatgcacccggccggtttggacgcagcacaggcgatgctgctgcagtccgctcccggcacgccgtgcttccgtctgcagcggatcagctttgccgaagatggccgcgcggtggaactggatatcgaatcctggcgtcatgacgcagtggatgtggtggtgcggacagaggcaccgacgcggtcggcgctgtag

SEQ ID NO: 10686 - protein, 242 aa, Xanthomonas oryzae
MSVSRQHTITEAISAQIAAGEWGQDQRLPVERALAERFGCTRITLREALQQLEAEGRIYRENRRGWFVSASRVRYDPTSIAGFMQYVAAQGRKPRTELLSATRQVAGAAYAAALRLDSPYDEVFVLQRRRWIDRRAVLLETNVVLAAWAPGLLEHDLAGSLSTVFNQQLGLFLSRAQLSMHPAGLDAAQAMLLQSAPGTPCFRLQRISFAEDGRAVELDIESWRHDAVDVVVRTEAPTRSAL

SEQ ID NO: 10687 - DNA, 1010 bp, Streptomyces lividans
  CDS (166)..(924)
ggaagtcatgcgcgacatctctagacaggtactgtggccaacatctctagagacgtcaagtcccctgcttcgtagcgcccttggggaggtcaagtggctactcggagcgagcgagccccggacctgtggcctaaggtgtctagagaaggagaggaggcccacgggatggccaacgccgcagacgaccgacgtcccaagtaccagcggatcgcggacacgctgcgcgaaggattccggtcgggcgagtacggccccggtgatcgactcccgggggagaacgacctcatggccacccacggcgtggcccgcatgacggcctgccaggccttgagcgtcctccgggacgaaggcgtcgccgaggcccgcaagggcgccggagtgttcgtccgggagtttcgcccgcttcgacgccggggcatccagcgtctggcccggcagcaatggggcaacggcaggtccatctggtcggccgacatcgaggaccgctcactcgatgtggaccaggtcacggtgtccgaggaagccgcgcccgacggcgtcgccgcggtcctggacctggccgacggggagacggtgtgcgtgcggcgccggcgcttcgtcctggacggcaagccggtcctgctcgcgacgagctaccttcccgccgccctggtcgccgggtccgcgatcactcaggaggacaccgggaagggcgggacgtacgctcggctcgccgaactcggccacgggccggtgcacttccgtgaggagatccgctcacgcatgccgtcgaaggccgaggcgagccagttgagcgtggcagcgggcaccccggtcatcctcatctgccgcaccgcattcacggacgagggccgcgccgtcgagatcaacgaaatgacgctggacgccgcttcgtacgtcttggagtacgacttcgacgcgtaactcgagcggtctcgccccacgccacggcctgagtcacgaccctgtctgcggcaggctcggtctcacgagtagaagccggtccagta

SEQ ID NO: 10688 - protein, 252 aa, Streptomyces lividans
MANAADDRRPKYQRIADTLREGFRSGEYGPGDRLPGENDLMATHGVARMTACQALSVLRDEGVAEARKGAGVFVREFRPLRRRGIQRLARQQWGNGRSIWSADIEDRSLDVDQVTVSEEAAPDGVAAVLDLADGETVCVRRRRFVLDGKPVLLATSYLPAALVAGSAITQEDTGKGGTYARLAELGHGPVHFREEIRSRMPSKAEASQLSVAAGTPVILICRTAFTDEGRAVEINEMTLDAASYVLEYDFDA

SEQ ID NO: 10689 - DNA, 801 bp, Lactococcus lactis
  CDS (1)..(801)
atggcaagaaaatcagtaccaaattatgtaaaaatacatgatgccttaaaagatgaagttgaaaaaggcatctggaaaattggacaacgtcttccaagcgaacgagatttagccgagcgttttacagtgagtcgtatgacagccagacaagctgtgacagccttagtagatgagggaattctcgaccgtcgagtaggttctggaacctacgttgctagccgacgtgtgcgtgaaaaaatgcgtggaacaacttcttttacagaaattatcagttcgcaaggcaaggttccctcaacagaagttttaagttatattagaactgctcctaatgaagttgaatgtgagaagttgaacatcactaaaaaagattcgattattcgaatggagcggattcgatatgctgacaatgttcccatttgttatgaagtggcaagtattccatttaaattagtgaaatcttttgataaaaaagaaattactagtaatttctttaaaactttggaaagccatgggcatgaaattggtcggagtgaacaaattgtttcggcaaagagagtcagtacagaagtatcagaatacttaaaaacaagagttggagctgctatacttggtttaacacaggtttcttatctagtagatgggactgttttgaatatgttttgtcacaatatgttggtgaccgttttgaattttatttggaaagataaaaaggacttaatgaactcctttttttacttgccgacgatattgatactgacgaagttgaaaatgaatccaacagcccacacaaaagccacttaa

SEQ ID NO: 10690 - protein, 266 aa, Lactococcus lactis
MARKSVPNYVKIHDALKDEVEKGIWKIGQRLPSERDLAERFTVSRMTARQAVTALVDEGILDRRVGSGTYVASRRVREKMRGTTSFTEIISSQGKVPSTEVLSYIRTAPNEVECEKLNITKKDSIIRMERIRYADNVPICYEVASIPFKLVKSFDKKEITSNFFKTLESHGHEIGRSEQIVSAKRVSTEVSEYLKTRVGAAILGLTQVSYLVDGTVLNMFCHNMLVTVLNFIWKDKKDLMNSFFYLPTILILTKLKMNPTAHTKAT

SEQ ID NO: 10691 - DNA, 786 bp, Streptomyces coelicolor
  CDS (1)..(786)
atggcgaagaccggcgaccccgcacgtgccgtgaccccgcccgcgatcggcaccctggacttcgccctggaccggagcagtccggtgccgctctactaccagctggcccggcagttggaggcggcgatcgagcacggcgtcctcgcaccggggaacctgctgggcaacgaggtcgacctctccgtccgcctcggtctgtcccggccgacggtccggcaggccatccagtcgctggtcgacaaggggctgctggtacggcggcgcggggtcggcacccaggtggtgcacagccaggtcaggcgcccgctggagctgagcagcctctacgacgacctggaggccgccggacaggatcccgggacccgggtggtgcgcaacgaggatgtcccggccaccgccgaggtcgcggcggccctcggcgtaacggagggcaccggggtgaccgtcctggagcggctgcgcctcacccacggacaaccggtggcgatgctgtgcaaccaccttccggcgggcctgctggaactcgacgacgcccggctggagtcgaccggcctgtaccggatgatgcgcgcccgcggcatcaccctgcacagcgcccgccagaccgtcggcgcccgcatcgcctcccgcgaggaggccgagcgcctcggcgagcgggagggcgccgcgctgctcaccatgcggcgcatcgcgtacgacgacaccgggcgaccggtcgagtacgggacgcacgtctaccgcgcctcccgctacgcgttcgacttccaactgctggtcaggaactga

SEQ ID NO: 10692 - protein, 261 aa, Streptomyces coelicolor
MAKTGDPARAVTPPAIGTLDFALDRSSPVPLYYQLARQLEAAIEHGVLAPGNLLGNEVDLSVRLGLSRPTVRQAIQSLVDKGLLVRRRGVGTQVVHSQVRRPLELSSLYDDLEAAGQDPGTRVVRNEDVPATAEVAAALGVTEGTGVTVLERLRLTHGQPVAMLCNHLPAGLLELDDARLESTGLYRMMRARGITLHSARQTVGARIASREEAERLGEREGAALLTMRRIAYDDTGRPVEYGTHVYRASRYAFDFQLLVRN

SEQ ID NO: 10693 - DNA, 771 bp, Streptomyces coelicolor
  CDS (1)..(771)
atgacccgggttaccgtgagcgccatggaccaccacgggggacggccgcgcgccgagcgggcccgggcactggccgacgcgctgcggcagcagatcacggacgatgccttcgccgacggggtgctgcccgacgagcgggacctgggccgccggttcggggcctcgcgcaacgcggtgcgggacgccctggccctgctgcgcgaggagggcctgatcacccggcggcgcggggtcgggacgacggtgctgctgccgaagtacgcgcacggtctcgaccggctgaccgggctcgccgaggagctgaccggccgcggcaccgtgaccaacgaggtgcgggtcgcggtggaggtgcccgcgctgcccgccgcgatcgcctcccggctggaggttccggccggggcgggcggtgtgtacgtggagcggctgcgccggctggacgggctgccgttgtcgttggacaccagctatctgaccgtcgacgtcggccgtgccgtgctcgccggcgacctgcgggaccgggacgtgttcggtctgatcgaggaggccgcgggcgcccggctcgggcgcgccgaggtggccgtgcacgcggtcaacgcggaccccggcacggcacggctgctggggatcgggcccggggcggcggtgttcgccctggaacggctgacccggctggcggacggccggccggtggacgcggagtcgatccggatccgcgcggaccggatggccctgcgcgccacgctgcggcgtggcgggccgcggacctcgtga

SEQ ID NO: 10694 - protein, 256 aa, Streptomyces coelicolor
MTRVTVSAMDHHGGRPRAERARALADALRQQITDDAFADGVLPDERDLGRRFGASRNAVRDALALLREEGLITRRRGVGTTVLLPKYAHGLDRLTGLAEELTGRGTVTNEVRVAVEVPALPAAIASRLEVPAGAGGVYVERLRRLDGLPLSLDTSYLTVDVGRAVLAGDLRDRDVFGLIEEAAGARLGRAEVAVHAVNADPGTARLLGIGPGAAVFALERLTRLADGRPVDAESIRIRADRMALRATLRRGGPRTS

SEQ ID NO: 10695 - DNA, 846 bp, Streptomyces coelicolor
  CDS (1)..(846)
atggagatcgacgccgccgcttccggtgcggtgctcaagcgggagcgcgtccgcgacgccgtcctggaactcatcgaggaccggcgccccggggacgcgatcccctcggagcgcaccctgtgcgccgaactcggcgtgtcccgaccgacgttgcgggcggcgatcgacgaactcgtggtcgccggactgctggtgcgcgagcacggccggggcatgttcgtggccgccgagaagatcacccaggaactgctctccgaccgccgggccttcagcctcccgcaggcggccggcgcctggaccagcaggctcctggaggtccgcaccctgcccgcgggcgcccgggtggggcgcaagctgcgcatgtcgccggcggcgcagatccactacgtggcacgtcttcgactggtcgacggctcgcccatggccatcgagtacctgcacgtaccggccgacctcgtctcggacctgaccagtgaggaactggagcagggcgatctgtacgagcacctgggcgagcggcacgacgtccgggtcagcgaggccgtgcagtccatcgaacccaccgtggtcacccgcgcggaggccgacctgctcgacgtgcccgaactctccccggcgctgctcttcgagcgcctgaccaccgacacccggggccgccccgtggagtacgtgcactccctctaccggggcgaccgctaccggatcgtctcccggctcaccctgggcccccgcgaccaggcgccacccccgggcgagggtcaccacccgggcatcccgcccggggacttcgccaccaaggatcccgtcacgctctccacgcgcggagtcgtgcagggcggcatgtag

SEQ ID NO: 10696 - protein, 281 aa, Streptomyces coelicolor
MEIDAAASGAVLKRERVRDAVLELIEDRRPGDAIPSERTLCAELGVSRPTLRAAIDELVVAGLLVREHGRGMFVAAEKITQELLSDRRAFSLPQAAGAWTSRLLEVRTLPAGARVGRKLRMSPAAQIHYVARLRLVDGSPMAIEYLHVPADLVSDLTSEELEQGDLYEHLGERHDVRVSEAVQSIEPTVVTRAEADLLDVPELSPALLFERLTTDTRGRPVEYVHSLYRGDRYRIVSRLTLGPRDQAPPPGEGHHPGIPPGDFATKDPVTLSTRGVVQGGM

SEQ ID NO: 10697 - DNA, 738 bp, Streptomyces coelicolor
  CDS (1)..(738)
atgtcgctggacctcagcgtggatcgcagcagcccggtgccgctgtacttccagctgtcgcagcagctggaggcggcgatcgagcacggcgcgctgacccccggcagcctgctgggcaacgagatcgagctggccgcgcggctcggcctgtcccggcccaccgtccgccaggccatccagtcgctcgtcgacaagggcctgctcgtgcgccgccgcggcgtcggcacccaggtcgtgcacagcaaggtccggcgccccctggaactcagcagcctctacgacgacctggaggcggcgggccagcgccccgccacgaaggtcctggtcaacaccgtcgtcccggccaccgcggagatcgccgcggcgctcggcgtggccgaggacagcgaggtgcaccgcatcgagcggctgcggctgacgcacggggaaccgatggcgtacctgtgcaactacctgccgcccggcctcgtcgacctggacaccggacagctggaggccaccggtctctaccggctgatgcgcgccgccgggatcaccctgcacagcgcccggcagtccatcggcgcccgcgccgcgacctccggcgaggccgagcggctcggcgaggacgcgggcgccccgctgctcaccatggagcgcaccaccttcgacgacacgggacgcgcggtcgagttcggcacccacacctaccggccgtcccgctactccttcgagttccagctgctagtgcggccctga

SEQ ID NO: 10698 - protein, 245 aa, Streptomyces coelicolor
MSLDLSVDRSSPVPLYFQLSQQLEAAIEHGALTPGSLLGNEIELAARLGLSRPTVRQAIQSLVDKGLLVRRRGVGTQVVHSKVRRPLELSSLYDDLEAAGQRPATKVLVNTVVPATAEIAAALGVAEDSEVHRIERLRLTHGEPMAYLCNYLPPGLVDLDTGQLEATGLYRLMRAAGITLHSARQSIGARAATSGEAERLGEDAGAPLLTMERTTFDDTGRAVEFGTHTYRPSRYSFEFQLLVRP

SEQ ID NO: 10699 - DNA, 732 bp, Escherichia coli
  CDS (1)..(732)
atgtcagctacggaccgctactctcatcaactcctctacgctaccgtccgccagcgactgctggatgatatcgcgcagggggtttaccaggccgggcaacagatccctaccgaaaacgagctttgtacacaatataacgtcagccgcattaccattcgcaaagccatcagcgacttagtggcagacggcgtactgatccgctggcagggaaaaggcacctttgtacaaagccagaaagttgaaaacgccctgcttactgtcagtggttttaccgattttggcgtctcacaaggcaaggcgacgaaagagaaagtgatcgaacaggaacgggtcagcgccgcgccgttttgcgaaaagctgaacatccccggaaacagcgaagtgttccatctctgccgggtgatgtatctcgataaagagccgctgtttattgatagttcatggatcccgctgtcgcgttatcctgactttgatgagatttacgtcgaaggaagctccacctatcagttatttcaggagcgttttgacacgcgagtggtcagcgacaaaaagaccatcgatatctttgccgccacccgcccgcaggcaaaatggctgaaatgcgaactgggcgaaccgttgtttcgcatcagcaaaatcgcctttgatcagaatgacaaaccggtgcacgtctccgaactcttctgccgcgccaatcgcatcaccttaactattgataataaaagacattaa

SEQ ID NO: 10700 - protein, 243 aa, Escherichia coli [sequence omitted]

SEQ ID NO: 10701 - DNA, 747 bp, Geobacter sulfurreducens
  CDS (1)..(747)
atgctggacccgcacagtcgcatgccgttgtatcatcaaatcgagagtcatctccgggaggtcatcaggagcggcaagtggcaggccggcgaagcgattcctcccgaaaggctgctgatcgagcagtacggggtcagccggatcacgatccgccaggccctggcaaatctcgtggctgccgggctgctctaccggaagcatgggcgggggacttttgtggccggcgcaaaagagcggcccataaccgagtcgctggccaacctgacgggccacctggaagagttgcagctgcgcggacttgatccccgggtcagggtgctggcgctggagacccgacccatgatcgccgaagtggctgaggccctgcagcgaagtcccggcgccgaagggtggtacctgtaccggatcgtcactgtggagcagcagccgctcatgctttcgaccgtgtggcttccctgcgaccttggggtagagctgaacgaggaactcctgaaacagcacggcatggccctgctgctgacccacaacggcatcgctcctctacgcggcagccagcggatcggcgccatgagtgccggaccggaagaggcgcgcctgctgggggtgcgggccggtgaagcggtcttgcgtgtcagcagggtcatccacggcgctgccgaccgtccgctcgtgtggttcaggacgctctaccgctctgatcgctacgaatacgaagtcgaactgaagagaggcaggccgcacgcatga

SEQ ID NO: 10702 - protein, 248 aa, Geobacter sulfurreducens
MLDPHSRMPLYHQIESHLREVIRSGKWQAGEAIPPERLLIEQYGVSRITIRQALANLVAAGLLYRKHGRGTFVAGAKERPITESLANLTGHLEELQLRGLDPRVRVLALETRPMIAEVAEALQRSPGAEGWYLYRIVTVEQQPLMLSTVWLPCDLGVELNEELLKQHGMALLLTHNGIAPLRGSQRIGAMSAGPEEARLLGVRAGEAVLRVSRVIHGAADRPLVWFRTLYRSDRYEYEVELKRGRPHA

SEQ ID NO: 10703 - DNA, 708 bp, Pseudomonas stutzeri
  CDS (1)..(708)
atgcagttgtctagacaacccagcgaaccgctctacctcgaactggcccaggtgctgcgcggcgagctgcgccactaccgcatcggcgacttcctgcctggcgagatgcagctggcgcgccgcttcgcggtcaaccgccacaccctacgccgcgccgtcgacgagctggtacaggaaggccgcctgctgcgccgccagggcaagggcacccaggtgctgcgacgcccgctggtctatccgctgcaggccgatagtgcctacagcgatgcgctcgccgctctcggcgtgcgcaccgaagcgcgcctgctcgcgcgtcgccagctcagcgccagcgccgaggaagcacgccacctgcaactggccgaaggcgccgcgctgatcgagctgagcaccctgcgcctgctcgacggcgagccggtcagcctgatccgccaccgctactgcgccagccacgccgaacgcctcgccgactatcagggcggctcgctgcgccgctacctcggcgaacgcggcctgccgctgacgcgccgtttcagcctgatcggcgcacgcctggccgatcgcgacgaggccgcacagctgctgatgcccctgcgcatgccgctgctgtcggtattcaccctgtcctgcgatgccgccgggcgaccggtggagatcgccctctcggccagccgttccgaccgcttccagtaccaggtcgccacctga

SEQ ID NO: 10704 - protein, 235 aa, Pseudomonas stutzeri
MQLSRQPSEPLYLELAQVLRGELRHYRIGDFLPGEMQLARRFAVNRHTLRRAVDELVQEGRLLRRQGKGTQVLRRPLVYPLQADSAYSDALAALGVRTEARLLARRQLSASAEEARHLQLAEGAALIELSTLRLLDGEPVSLIRHRYCASHAERLADYQGGSLRRYLGERGLPLTRRFSLIGARLADRDEAAQLLMPLRMPLLSVFTLSCDAAGRPVEIALSASRSDRFQYQVAT

SEQ ID NO: 10705 - DNA, 741 bp, Mycobacterium smegmatis
  CDS (1)..(741)
atggccgaagacgtacgccgccggattttgtcgatgctggcccagggcatgctgcgtccgggttcgcggctgggcaccgagcgcgagatggcggagaccttcgcggtgtcgcggtccaccctgcgcagcgccctgctgccgttgagccaggccggtgtgctggagcgtcgcaccggccgcaacggcggcacgttcgtgcgggccgacgtggtgcagcgcaatgccgccgagctggtcggtctgcccgcacgcctgcacagcggcgggcacaccagcaccagccgtgtactgggcaccgaccgcaggcccgcgaccgccatcgaggccgaggccctcgaagtgcccctgggcacagacattttcacgatccggcggttgcggttcgccgacggggtgcccctgtcggtggacctcgcctgcttcgtcgccggacgcatgaacgacctgctggaacagccgctcggcgggtcgctctacgaactgctgcaggtgcgctacggtctgacacccgccaccacgaccgagaccatcgaggtggtcagcgccagcccccgcgaggcccagtggctcgatgtcgcgcatcgcaaaccgctgctggcgatcacgcgggtgacccgcgacgacacgggcaggccgttcgaatacgcctacgacctgttccgcgccgaccgcgtgcgtctcaccgcgacgagccacggcaccgtcggtgccgtgcagcgctctgtcagcaccaccgcctga

SEQ ID NO: 10706 - protein, 246 aa, Mycobacterium smegmatis
MAEDVRRRILSMLAQGMLRPGSRLGTEREMAETFAVSRSTLRSALLPLSQAGVLERRTGRNGGTFVRADVVQRNAAELVGLPARLHSGGHTSTSRVLGTDRRPATAIEAEALEVPLGTDIFTIRRLRFADGVPLSVDLACFVAGRMNDLLEQPLGGSLYELLQVRYGLTPATTTETIEVVSASPREAQWLDVAHRKPLLAITRVTRDDTGRPFEYAYDLFRADRVRLTATSHGTVGAVQRSVSTTA

SEQ ID NO: 10707 - DNA, 705 bp, Mycobacterium fortuitum
  CDS (1)..(705)
atgttggccgccggcgccctgcgtcccggctcgcgactgggtaccgagcgggagatggcggccgatttcgcggtgtcgcgctccacgctgcgcagcgcactgctgccgctgagtcaggcgggcgtgctggagcgccgcgccgggcggaacggaggcacgttcgtgcgcgccgacgtcatcgaacgcaatgccgccgaattggcgggccttccggcccgactgcgcaccggtggccacaccagcgccacccgggtgctgtccaccgaccgtagaccggccaccgctgcggaagcccacgcactcgaaatcaccgatggggccgacatattcacaattcggcggctgcgcttcgccgacggtgcgcccctgtcggtggatctgtcctgcttcgtcgccgagcacatggaggacctactggagcagcccctcggcggctcgctctacgagttggtgcgggtgcggtacgggctgtcgccggccgccaccaccgagaccatcgaggtggtcagcgccagcccccgcgaggcacactggctcgacatcgcccagcggaaaccgctgctggccatcactcgcgtcacgcgtgacggcaccggccgcccgttcgagtacgcctacgatctgttccgggccgaccgggtgcggctcacagccaccagccacggcgcggtcggcgcggtgcaacgttcggtgagcagcgcctga

SEQ ID NO: 10708 - protein, 234 aa, Mycobacterium fortuitum
MLAAGALRPGSRLGTEREMAADFAVSRSTLRSALLPLSQAGVLERRAGRNGGTFVRADVIERNAAELAGLPARLRTGGHTSATRVLSTDRRPATAAEAHALEITDGADIFTIRRLRFADGAPLSVDLSCFVAEHMEDLLEQPLGGSLYELVRVRYGLSPAATTETIEVVSASPREAHWLDIAQRKPLLAITRVTRDGTGRPFEYAYDLFRADRVRLTATSHGAVGAVQRSVSSA

SEQ ID NO: 10709 - DNA, 945 bp, Mycobacterium paratuberculosis
  CDS (1)..(945)
atgaccgggccggcagttctgctcatccggatcacaaacccgcccggtggccgcgggtggcgcaatgacccggcgcgccgcggttttggctggtcgggcccgaacgccacccggcgcaatgccgtcggtcgccggctgcgaccccggtcgccggcccggaaaacgcccctgagctgcgttagcgtgaccgtcgtggcgcatccagtaccgatcgggggaccgcgggccgaccgggcccgtcgggtggccgacgtgttgcgccagcagatccacgccgacgcctacccggacggcctgcccgccgaactggagctggccgacgaattctcggtgtcgcgcaacacgattcgcgaggcgctggccgtgctcaagcgcgaaggcctgatcgaccgcgggcccagggtgggcacccatgtcgcgcagcgcaaatacgaccacgccctggacgcgctgctggggctgaaggagacgttcaaggacctcggcgaggtgcgcaacgaggtgcgcgcggcgatgccggtcacggcgccgccgtcggtggcccgccgactgcggctggcgccgggggagcaggcggtgttcatcgagcggctgcgctacctcggcgagctgccgctcagcctggacctcacgtacctggcccccgcgatcggccgccaggtgctggagcattcgctggagaccaacgacgtgttcgccctcatcgaacaggtcagcgggcagcggctgggctcggcggcgctggcgctcgaggccatccccgccgacgcgcattcggcggccacgctgcaggtgcccgacggcgcggcgctgctcatgctggagcggctcaccagcctggccgacggcactcccgtcgacctcgagtacatccggatgcggggcgatcgaatcaccatgcgcggcaacctgttcagagccgagccgatgaggagcaactcatga

SEQ ID NO: 10710 - protein, 314 aa, Mycobacterium paratuberculosis
MTGPAVLLIRITNPPGGRGWRNDPARRGFGWSGPNATRRNAVGRRLRPRSPARKTPLSCVSVTVVAHPVPIGGPRADRARRVADVLRQQIHADAYPDGLPAELELADEFSVSRNTIREALAVLKREGLIDRGPRVGTHVAQRKYDHALDALLGLKETFKDLGEVRNEVRAAMPVTAPPSVARRLRLAPGEQAVFIERLRYLGELPLSLDLTYLAPAIGRQVLEHSLETNDVFALIEQVSGQRLGSAALALEAIPADAHSAATLQVPDGAALLMLERLTSLADGTPVDLEYIRMRGDRITMRGNLFRAEPMRSNS

SEQ ID NO: 10711 - DNA, 717 bp, Lactobacillus johnsonii
  CDS (1)..(717)
atgaaaaaaccactttatcagcaagttatttcagatctcgaaaagaaaattaagactgaaatgaagccaaatgatcgattaccgagtgaacgacaacttttgaaagaatatggtgttagtcgaaatacgattcgattagcattaaatgatttagaagaacgtggcattatttatcgattgcatggaaaaggtacatttgtttcgacaatttatctagatcaaactaacttgggaagtatgtattcttttagtgagcaaatgtctgaagcaggccacaagccaacaacacaaaaccgcacattagaacttgtgacacctgaagaagacgttgcaaatcagcttaatttaaaagctggtgagaaagcatacaaattagttaggttacgtctagctgatggagtaccactaatgtatggagaaacttatttacctgaaaaaattttccctaatctaaaaatgtcagacctaaaggaaaacttatatacagtgatgaagcaaaaatataatgaacaaagtattcttgcttttgaagatgtacaagccgttaatttagacgaaaatgacagcaagattttaggtgttaagcctggggatgcaagtttgaagatttttagacgggcaatcaatgataaaaatgtgccgatcgagttcactatttctctcgctagaggagatagatttatttatcgatcacgtcaatataatcatttagtttaa

SEQ ID NO: 10712 - protein, 238 aa, Lactobacillus johnsonii
MKKPLYQQVISDLEKKIKTEMKPNDRLPSERQLLKEYGVSRNTIRLALNDLEERGIIYRLHGKGTFVSTIYLDQTNLGSMYSFSEQMSEAGHKPTTQNRTLELVTPEEDVANQLNLKAGEKAYKLVRLRLADGVPLMYGETYLPEKIFPNLKMSDLKENLYTVMKQKYNEQSILAFEDVQAVNLDENDSKILGVKPGDASLKIFRRAINDKNVPIEFTISLARGDRFIYRSRQYNHLV

SEQ ID NO: 10713 - DNA, 699 bp, Lactobacillus johnsonii
  CDS (1)..(699)
atgaaaaaatatgaattagttgcggataaaataaaagcttatatcaccaaaaacaaacttcatcatggagataaattaccaacaattaccgaattaatgaaagaatatcaagttggtaaatctactatcttacaggcgattactttgttaactcaacgaggaatagtttataaagttcaaggttctggcgtttttgtcagacctacagggcgagatggttatatgtcacttactgataacgccgggtttgctcatgttttaaaagatcctactactgaagtaattgagtttgctgagaaaaggccccctaaacctttatgtgactatctgcattctaatgaagtatgttactttataaaaagattgcgcagacaagaaggaaagccatttgttttagaagaatcgtattatcctaagagcattattccgtttatgagtaaggaaattgctgagggatcgatttttgactatatcaaggatggtttaaagaaagaaattcgtttctctgataaatatatgcgcgttagaaagttaagagccgatgaagcaaaatatctagaattagaagaaggagatccctgtttagaagtttatgatactttctatttagccaatgggacaccatttgatagttctaaattggtatacaattatcaaaactctaaattctatgatcaaagttctgatgatattatttaa

SEQ ID NO: 10714 - protein, 232 aa, Lactobacillus johnsonii
MKKYELVADKIKAYITKNKLHHGDKLPTITELMKEYQVGKSTILQAITLLTQRGIVYKVQGSGVFVRPTGRDGYMSLTDNAGFAHVLKDPTTEVIEFAEKRPPKPLCDYLHSNEVCYFIKRLRRQEGKPFVLEESYYPKSIIPFMSKEIAEGSIFDYIKDGLKKEIRFSDKYMRVRKLRADEAKYLELEEGDPCLEVYDTFYLANGTPFDSSKLVYNYQNSKFYDQSSDDII

SEQ ID NO: 10715 - DNA, 726 bp, Lactobacillus johnsonii
  CDS (1)..(726)
atggctgcagaagcaaaatacttaaaagttgctcgaattctacaaaaaagaattgaagatggagtctataaacctcaaactccccttcctgaccaaaaaacacttgcagaagaattacacgtaagccgtttaaccgttaagaaggccttagatggtctacaaagaaaaggactagtctataaagaatctggtctcggcacttttgtcttaggcccaattccaattcaagataaatttgattcaccagcgaatgcttttagtggcttagctaatctactaggatctaatgaggtcactagcgatatcattgagtttaatgttgaatttccaaatgaagatgttcaacattacttaaaattaaaatctagcgatccagtttacaatattcgtcgtctaagacggcttgaaggtaaacctctgattctggaacatacatttatgccagttaacttagttccagatttaaatgaagatatattacataattctatctataattatcttcatcataatttgaaacttaaatttggcgttgcctatcgtaaaattaaggctactaaggctgatgattgggatcaacagtatcttcaagccaaaaaagacgatccaatcttagagctggaacaaattgtctggttaaacaatggtcaaccagttgaatattcaacaagccgaaatcgctacaatgaacgaaattatgtcgttttagagacaaatagcttttaa

SEQ ID NO: 10716 - protein, 241 aa, Lactobacillus johnsonii
MAAEAKYLKVARILQKRIEDGVYKPQTPLPDQKTLAEELHVSRLTVKKALDGLQRKGLVYKESGLGTFVLGPIPIQDKFDSPANAFSGLANLLGSNEVTSDIIEFNVEFPNEDVQHYLKLKSSDPVYNIRRLRRLEGKPLILEHTFMPVNLVPDLNEDILHNSIYNYLHHNLKLKFGVAYRKIKATKADDWDQQYLQAKKDDPILELEQIVWLNNGQPVEYSTSRNRYNERNYVVLETNSF

SEQ ID NO: 10717 - DNA, 729 bp, Lactobacillus johnsonii
  CDS (1)..(729)
atgactgatttagtctatcgctcagtaatgcgcgatattaaacaaaaaatacttaataatgaatatgaagatatgcgtttgcctgatgagcgaagcctaagtgactattatcatgtaagtcgttcatcgatgaagcgcgctttaggtttgcttgctcagcaagggatagtttttaaaaaaagaggtagcggaacatttattaatccgctctatttgaaaaatcaggcactttttaagtatgagggatcaaatttaggtattaccgattcctttagtgttcccggtaagaagcaaagtattgagctgttagactatcaagtaattaaggccgacgaagatttgagacaggacttgtttttaaaagagtcagattttgtttatcaaataaaacggcttcgtttgttagatgatcaaccatttttaattgaaacaggttttattcctattaagattactccagaattaaatccggatattcttaaaggatcgctctttaactacttagaagatacacaaaataaaactgtaacccgttcattcttaacaattacagttgagccatcaactttagaagatcagtctaaattgatgctggcacctaatgaacctgtaggtgtaatggaaggtattttctttttagatgatggaactccatttgaagtttcaaatatgagaattcattataaatatatgaagtacaatacttttgttaacttaagtcaagaataa

SEQ ID NO: 10718 - protein, 242 aa, Lactobacillus johnsonii
MTDLVYRSVMRDIKQKILNNEYEDMRLPDERSLSDYYHVSRSSMKRALGLLAQQGIVFKKRGSGTFINPLYLKNQALFKYEGSNLGITDSFSVPGKKQSIELLDYQVIKADEDLRQDLFLKESDFVYQIKRLRLLDDQPFLIETGFIPIKITPELNPDILKGSLFNYLEDTQNKTVTRSFLTITVEPSTLEDQSKLMLAPNEPVGVMEGIFFLDDGTPFEVSNMRIHYKYMKYNTFVNLSQE

SEQ ID NO: 10719 - DNA, 714 bp, Lactobacillus johnsonii
  CDS (1)..(714)
atgactgaagcaaaatataaaaaaattgaagctattttaaaacaaagaattatcgatcaaacctatcctcttaatagtttattgccaaaagaaattgaactagctgccgaattcaacacaagtcgcccaacaattaaccatgcgattcacaatcttgttcaacaaggattcttagagcaacgtaaacgattaggtactattgttaaaagaaataagattgcacaagaatttactcacgtaatccaaagctataatcaagaaatgaatgataaaggattaaaagcaagaactaaagtgatctcttttgataaaattaatcctacttcagaaatacaaaacgccttaaacttatatccttctgactcagtctttaaattagttagactaaggtatgtagatactactccaattgttaaagtgaccacttatatccctgctaagcttgttccagagctagataaaatagatttttcccaagtatccttatacgatgaacttaggaaaagaaatttaccggtcacccatgtcacaagaaaattagaagtgaaacaagcttcttcaactatatcgaaaactttaaaaattaaagaaaatgatcctgttttttattttcatagttatggatatgcaaaaagggatcaaaaaatagaatactcaattgccacttatcgtggagatttgaactcgtttattattgatcttaatcttaactaa

SEQ ID NO: 10720 - protein, 237 aa, Lactobacillus johnsonii
MTEAKYKKIEAILKQRIIDQTYPLNSLLPKEIELAAEFNTSRPTINHAIHNLVQQGFLEQRKRLGTIVKRNKIAQEFTHVIQSYNQEMNDKGLKARTKVISFDKINPTSEIQNALNLYPSDSVFKLVRLRYVDTTPIVKVTTYIPAKLVPELDKIDFSQVSLYDELRKRNLPVTHVTRKLEVKQASSTISKTLKIKENDPVFYFHSYGYAKRDQKIEYSIATYRGDLNSFIIDLNLN

SEQ ID NO: 10721 - DNA, 702 bp, Lactobacillus johnsonii
  CDS (1)..(702)
atgcaagaaccgatgtacattaaaattcacaaccaaataaagcgtgatattgaaaataaaaaatataaagttggagagcggatccctgctgagcggcaattagcttcaaaattcaatgtttctagaatgacattgcgccaagcaattaagacattagaagacgaaggaatcctagagagacgcttaggtagtggaacctatgtctctagtcaaaaggttcaagagaaaatgtctgggatcatgagttttaccgatataactcgttctaatggccaggttccttctagtaaattactatcttatcgtataacgaagccatcgttatctgaaaaagaaaagctaaaaattcaagatacagataacgtattaagaatggaacgtgttcgttttgcagataatgtgccgatttgttatgaagtggctacaattccttatgaattagtttcccgtttttctaaagatgaaatttcaagtagtttatatcaaacgcttgaagaaaagggtggctataagattgggagcgttgtagaaaatattggtgcagctgttgctaatgaaaatgaggctcgtttattgtcagttaaaaagggggagccattagtaactagacgccaggtgactgaactcagtaatcattatccttttgaatatgttcgtgcatcatatgtggccgaaagatttgaatttacatttgaaaaataa

SEQ ID NO: 10722 - protein, 233 aa, Lactobacillus johnsonii
MQEPMYIKIHNQIKRDIENKKYKVGERIPAERQLASKFNVSRMTLRQAIKTLEDEGILERRLGSGTYVSSQKVQEKMSGIMSFTDITRSNGQVPSSKLLSYRITKPSLSEKEKLKIQDTDNVLRMERVRFADNVPICYEVATIPYELVSRFSKDEISSSLYQTLEEKGGYKIGSVVENIGAAVANENEARLLSVKKGEPLVTRRQVTELSNHYPFEYVRASYVAERFEFTFEK

SEQ ID NO: 10723 - DNA, 711 bp, Bacillus cereus
  CDS (1)..(711)
atgatgagtaagtatgaacaaatttatacagaaatcagtaattctattgataataggcaattaaaagagggatgcaaaatcccatcagaaactgaattaatgaagcaatatgaagcgagccgcggtactgtaagaaaagctgtagatttattacaagaacgtggatatgttcaaaaaatacacggaaaaggtgtttttgttttaaagcgaaaaaacattgaattcaactttggtggtattgtaagtttccaagaagaaaatgaacgtttaggacgtcattgtattacagaagtcgtagaaatggagaaagtaaaagcaacaaaagaggttgcaaagctattaaatgtgaaagagaaaacagacatagatcatattaaacgcgtacgaaatattgatggagaaaaagtaattttggatattaatcattttgtatcggaatatattcctggattaacgagtgaaattgcagcgcaatccatttataaatatattgagaaagaactaggtcttcatattagttattcacagagagtaattgaagtgcaaccatgtacagaggacgatagaaagtatttagatttaaatggaacagactatgttgttgtcgtgaaaaactttacgcatttgtatgatggaagtcagttcgaatatacagaatcccgccaccgcttagatatttttcatttttcggatgtggcgcggagaaaataa

SEQ ID NO: 10724 - protein, 236 aa, Bacillus cereus
MMSKYEQIYTEISNSIDNRQLKEGCKIPSETELMKQYEASRGTVRKAVDLLQERGYVQKIHGKGVFVLKRKNIEFNFGGIVSFQEENERLGRHCITEVVEMEKVKATKEVAKLLNVKEKTDIDHIKRVRNIDGEKVILDINHFVSEYIPGLTSEIAAQSIYKYIEKELGLHISYSQRVIEVQPCTEDDRKYLDLNGTDYVVVVKNFTHLYDGSQFEYTESRHRLDIFHFSDVARRK

SEQ ID NO: 10725 - DNA, 720 bp, Bacillus cereus
  CDS (1)..(720)
atgattgcaaaagataatcgaacaccattatactaccaactaatggatattattgtggagcaaattgaaactgggaatttacaagaacatgataagcttccatcagaacgtgaactatgcgagattcatgatgtaagtagaacaacagtaaggcagacgatgcaagaattagaaaaagaaggatatatttataaaaaacatggtaaagggagttttgtctcacctcgtgtatttaatcaaagtcttgtccgtttttatagtttcacagaagaaatgaaaaaatttggaaaggttccatcatcaacagtcgtatcattttccataattcattgcgataaaaaaatatcgaaaattatgaatcttaacaatggagaagaggtgtatcaaattacgagattaaggttagctgataaagaacccatgctatttgaaacatcttatattcctgtaaagttctttccatatttaacgaagaaagaattagaagaaacaccaatgtacgagattttccgtaaaaaataccaagttcatatcacacgtgcggtggaaagtttcaaagcgattgcagcagaaaaagagcatgcaacatggctacaagttgaaaagaatgaaccatctttatctctagaacgtattgcatatgcgaaagaaaatataattgaatacacacagaccattgcaagaggagataaatttacttacacagttgaattacaataa

SEQ ID NO: 10726 - protein, 239 aa, Bacillus cereus
MIAKDNRTPLYYQLMDIIVEQIETGNLQEHDKLPSERELCEIHDVSRTTVRQTMQELEKEGYIYKKHGKGSFVSPRVFNQSLVRFYSFTEEMKKFGKVPSSTVVSFSIIHCDKKISKIMNLNNGEEVYQITRLRLADKEPMLFETSYIPVKFFPYLTKKELEETPMYEIFRKKYQVHITRAVESFKAIAAEKEHATWLQVEKNEPSLSLERIAYAKENIIEYTQTIARGDKFTYTVELQ

SEQ ID NO: 10727 - DNA, 738 bp, Bacillus cereus
  CDS (1)..(738)
atggcaagcggatcaacacaagtaaaatacctcggcatttatcaaaaaatgaaacagcaaattttagatggcgaatataaaatcaacgaaaaaattccaagtagtcctatacttgctgaagaatttggcgtttcagtcctgacaataaaaaaagcgctggatctgttagtgagagacggatacattatccgccggcgcggaagtggaacagtcgttcaagattggcgtcagcaggaaaaggcacgaatgattcaaactttaacaggtacgaaagctgtttatggcagcgaggtagaaagtaaaattatcgagtttacgattgtcggtgccgatgaaatcattgctgaaaaattgggcatttcagtaggggatttcgtatataaaatcattcgccttcgtatcattcacagtatcccaacgattatggagcatacatggatgcctattgcggtcattccaggtgttgaagcttcggttttagaggagtcgatctactcatacattcaaaataaactaggtcttaaagtgggaacatccgttgttagggtcaaaggcattcgcccagatgataaggaaaagcagtttatgaacttaacaaatcaagattttctaatgagagtggagcaggtggcctatttaacggatggacgaacttttgaatactcttatgctgatcacctgccagaaacctttgaatttgaaacagttattactgcaaaaagttataaagaggcataa

SEQ ID NO: 10728 - protein, 245 aa, Bacillus cereus
MASGSTQVKYLGIYQKMKQQILDGEYKINEKIPSSPILAEEFGVSVLTIKKALDLLVRDGYIIRRRGSGTVVQDWRQQEKARMIQTLTGTKAVYGSEVESKIIEFTIVGADEIIAEKLGISVGDFVYKIIRLRIIHSIPTIMEHTWMPIAVIPGVEASVLEESIYSYIQNKLGLKVGTSVVRVKGIRPDDKEKQFMNLTNQDFLMRVEQVAYLTDGRTFEYSYADHLPETFEFETVITAKSYKEA

SEQ ID NO: 10729 - DNA, 747 bp, Bacillus cereus
  CDS (1)..(747)
atgaggcgattgctgatgaacatcgacaagtattcaccatttccgatctattatcagattcaagagtgggtgaaacagctaattgaggacggcgaatggaagccgggagataaaatcccatctgagaatgaactttgcgataagttcgaagtgagtcgtatgacaatcagacaggcgattaataatttagtggaacaaggttatttatatcggaaacgtggaatcggtacgtttgtccaacttccgaaagtggaacaaaaattgcaaggaatgacaggattcacagaagatatgatttctcgtggaatgaacccaagtagtcaattgctaagtttccgcctagttccagctactgcgaaaatagcagaccggctgagaatacaggagggagaatcggtttatgaagtgagacgtattcgtttagcggatgatgaaccgattgcttttgagacgacatatttgtcgccagctcttgtaaaagatattaacgaagaaatattgcaacaatctttatatgaacatctagagaaaaaactgggctttaaacttgttagcgctactcaatcaattgaagcttcaattgcaacggataatgaagcggaacatctgcatattcctaaaaaggcgccagtgcttgtaatgcgtcaatggtcatattcagaaggtgaagtaccgttagagtatgtgaaatgtatttatcgcggggatcgttataagtttattacgaacatcgcacgtaacaaataa

SEQ ID NO: 10730 - protein, 248 aa, Bacillus cereus
MRRLLMNIDKYSPFPIYYQIQEWVKQLIEDGEWKPGDKIPSENELCDKFEVSRMTIRQAINNLVEQGYLYRKRGIGTFVQLPKVEQKLQGMTGFTEDMISRGMNPSSQLLSFRLVPATAKIADRLRIQEGESVYEVRRIRLADDEPIAFETTYLSPALVKDINEEILQQSLYEHLEKKLGFKLVSATQSIEASIATDNEAEHLHIPKKAPVLVMRQWSYSEGEVPLEYVKCIYRGDRYKFITNIARNK

SEQ ID NO: 10731 - DNA, 702 bp, Listeria monocytogenes str
  CDS (1)..(702)
atgggagctaaaaagccactttttgaagtaatagcttcagaaataaaagatagtattaatcgcgatgaatataagccgggaatgctaatgccgaacgaaacagccttgcaagaaattttttctagcagtcggacaacgattcgccgcgcggtagatctattagtcgaagaaggtttagttgttcgtaaaaacggtgttgggctatacgttcaaccaaaactaacagctcagaacattttagaaatgacaggtgttatgaaaaccgataccaatgaaaatctaaaaaaagacattaaagacttttacatccgtaaagctgggaaattttacgcagagaagtttggtataaaagagaatgaacttgtgtattctatcaagtttgtccaaaaaagtgagcatggtgtcacactagatcgcttaattttaccgttaagtttataccctgatttacaagcaaaggattttcaaattattaatattattgagcttgttaattcaggtaaatataaattatttgagcttgagcaggaacttcaacttattttagctgggaatgagcaaatcaaaaatatgcatatagacgaaaatgatcctgttttcaaattgagtagtgtcttttatgcagaaaacgagatgccaattgccatccaatatcattatgaagatgctgagtcgaccaaatatgtagttgattttaactaa

SEQ ID NO: 10732 - protein, 233 aa, Listeria monocytogenes str
MGAKKPLFEVIASEIKDSINRDEYKPGMLMPNETALQEIFSSSRTTIRRAVDLLVEEGLVVRKNGVGLYVQPKLTAQNILEMTGVMKTDTNENLKKDIKDFYIRKAGKFYAEKFGIKENELVYSIKFVQKSEHGVTLDRLILPLSLYPDLQAKDFQIINIIELVNSGKYKLFELEQELQLILAGNEQIKNMHIDENDPVFKLSSVFYAENEMPIAIQYHYEDAESTKYVVDFN

SEQ ID NO: 10733 - DNA, 735 bp, Listeria monocytogenes str
  CDS (1)..(735)
atggtgagaaagttaaataaaatgtacgatgcatctccgctctatgcgcaaatagctgatgatttacgagaaaaaatccaaacagaagtttggcaaactggagataaaattccaccagagcttgatttatgtgagttatacaatgtcagtagaattaccgttcgaaaagcaattgatgaactcgttcgtgagaatttactttatagagagcgcgcgaaaggtacttttgtacgtgactgggaagaagcagaggatgagcattttacgttagtgcgcagttttacgaatgagatgaaagaacttggtaaaaaggcggctacgctacatgcggaagtagaagtgatcaatgccgataaaaaaattgcgttacagctagggctttctgtcggggacaaggtgctacaaattaagcggctacgcggtacgaaagacttggcatttgctttatttatcagttttattccttataatcaagattactcacttaaagcagaagattattacggttctttttatgaatatttgaaaggcttcggtattgtcgtgaatcaagaaaaggaatatattgaagcgatgttgcctaatcgtgaagtacaggaagcgctcgcaatcgacaaacaagaaccaattttgaaaagggtgcggatgacgaaacaaaaagaaagtgattttagagaatacagcgaatgtttttatataggaaagcattatcgctattatattgattttgaataa

SEQ ID NO: 10734 - protein, 244 aa, Listeria monocytogenes str
MVRKLNKMYDASPLYAQIADDLREKIQTEVWQTGDKIPPELDLCELYNVSRITVRKAIDELVRENLLYRERAKGTFVRDWEEAEDEHFTLVRSFTNEMKELGKKAATLHAEVEVINADKKIALQLGLSVGDKVLQIKRLRGTKDLAFALFISFIPYNQDYSLKAEDYYGSFYEYLKGFGIVVNQEKEYIEAMLPNREVQEALAIDKQEPILKRVRMTKQKESDFREYSECFYIGKHYRYYIDFE

SEQ ID NO: 10735 - DNA, 801 bp, Corynebacterium glutamicum
  CDS (1)..(801)
atgcctgaccaaccgctcaaccaggacggattccctaccgcatccaaaggggtggaacccgacaacctccccgaccgcgttctcgtggacggccttaaaccaaagcatcagcagcttcgtgaaattttggaggaaatctgcaccacccagcttcagcctggggacatgctgcctggtgagcgcatcctggaagaaaagtatggcgtcagccgaattacggttcgtcgggcgattggtgatctggtcgcgtccggcaggttgaagcgagctcgcggcaaaggtaccttcgtggcccactcgccgttgatttcccgcctgcatttggcctcgttttccgcagagatggccgcccagaagctatcggctaccagcaggattttgagttcttcccgcggtcccgccccagatgatattgctgatttctttggtaccgatcgcgcggcccagcacatcacgttgcgccgcctgcgccttggaaatggtcgaccctatgccattgacaacggctggtacaactccgaattcgcacctgacctgctggaaaatgatgtgtacaactccgtgtactccatcctggaccgcgtctatggcgtccccgtcacccaggccgagcaaacggtcaccgccgtagcagccgacgaagacaccgcacggcttctcgacgtcacccccggcgccccactccttcgtatccttcgacagtcactttctggcgataagcccgtggaatggtgcgtttccttgtaccgaaccgaccgatattctttaaaaacattggttacacgctccgaagatctctga

SEQ ID NO: 10736 - protein, 266 aa, Corynebacterium glutamicum
MPDQPLNQDGFPTASKGVEPDNLPDRVLVDGLKPKHQQLREILEEICTTQLQPGDMLPGERILEEKYGVSRITVRRAIGDLVASGRLKRARGKGTFVAHSPLISRLHLASFSAEMAAQKLSATSRILSSSRGPAPDDIADFFGTDRAAQHITLRRLRLGNGRPYAIDNGWYNSEFAPDLLENDVYNSVYSILDRVYGVPVTQAEQTVTAVAADEDTARLLDVTPGAPLLRILRQSLSGDKPVEWCVSLYRTDRYSLKTLVTRSEDL

SEQ ID NO: 10737 - DNA, 705 bp, Photobacterium profundum
  CDS (1)..(705)
atggctcaatcaccgcgttatttacaaataaaacagtatttaaatgataaaatccaaacaagaacttggccgccgggttttaaaattccgactgaaattgagctgtcagaacaattttcagtgagccggatgacagcaaataaagcgatccgtgatctagtgggcgatggtttattaaaacggacccctagattaggtacgtttgtttgtcataaaaaagctgaatccccattgatggaaattcgaaatattgccaatgaggtgcgtaaccgtggtcatgactattcaagccaggtaataagccaacatagtgtagaagcaaaagatgatattgctttacgtataggcgtaagaaacggcaccatgatttactttacccaaatagtacattatgaaaatggtttgcctattcagctagaagaacgctgggttaaccccgattttgcccctcaatatctcgatcaagattttacggcacaaacacccaatgaatatttggttcaaacctgccctcttagtgatatagaacataccgttgaagctattattcccattggtcgtattatatctttacttgaaatgaacgaaggtgaaccttgtttattgcttaatcgtcgtacgtggagcgacaaaaatttgattagcactgcattgttatatcacccaggtaataaatataagttgagttctcgcactaaggtgtaa

SEQ ID NO: 10738 - protein, 234 aa, Photobacterium profundum
MAQSPRYLQIKQYLNDKIQTRTWPPGFKIPTEIELSEQFSVSRMTANKAIRDLVGDGLLKRTPRLGTFVCHKKAESPLMEIRNIANEVRNRGHDYSSQVISQHSVEAKDDIALRIGVRNGTMIYFTQIVHYENGLPIQLEERWVNPDFAPQYLDQDFTAQTPNEYLVQTCPLSDIEHTVEAIIPIGRIISLLEMNEGEPCLLLNRRTWSDKNLISTALLYHPGNKYKLSSRTKV

SEQ ID NO: 10739 - DNA, 24 bp, Primer
atgatctacaaaagcattgcggag

SEQ ID NO: 10740 - DNA, 22 bp, Primer
ttaactcttttccgggtggagt

SEQ ID NO: 10741 - DNA, 717 bp, Escherichia coli K12
  CDS (1)..(717)
atgcagaccccgcacattcttatcgttgaagacgagttggtaacacgcaacacgttgaaaagtattttcgaagcggaaggctatgatgttttcgaagcgacagatggcgcggaaatgcatcagatcctctctgaatatgacatcaacctggtgatcatggatatcaatctgccgggtaagaacggtcttctgttagcgcgtgaactgcgcgagcaggcgaatgttgcgttgatgttcctgactggccgtgacaacgaagtcgataaaattctcggcctcgaaatcggtgcagatgactacatcaccaaaccgttcaacccgcgtgaactgacgattcgtgcacgcaacctactgtcccgtaccatgaatctgggtactgtcagcgaagaacgtcgtagcgttgaaagctacaagttcaatggttgggaactggacatcaacagccgttcgttgatcggccctgatggcgagcagtacaagctgccgcgcagcgagttccgcgccatgcttcacttctgtgaaaacccaggcaaaattcagtcccgtgctgaactgctgaagaaaatgaccggccgtgagctgaaaccgcacgaccgtactgtagacgtgacgatccgccgtattcgtaaacatttcgaatctacgccggatacgccggaaatcatcgccaccattcacggtgaaggttatcgcttctgcggtgatctggaagattaa

SEQ ID NO: 10742 - protein, 238 aa, Escherichia coli K12
MQTPHILIVEDELVTRNTLKSIFEAEGYDVFEATDGAEMHQILSEYDINLVIMDINLPGKNGLLLARELREQANVALMFLTGRDNEVDKILGLEIGADDYITKPFNPRELTIRARNLLSRTMNLGTVSEERRSVESYKFNGWELDINSRSLIGPDGEQYKLPRSEFRAMLHFCENPGKIQSRAELLKKMTGRELKPHDRTVDVTIRRIRKHFESTPDTPEIIATIHGEGYRFCGDLED

SEQ ID NO: 10743 - DNA, 696 bp, Enterococcus faecium
  CDS (1)..(696)
atgagcgataaaatacttattgtggatgatgaacatgaaattgccgatttggttgaattatacttaaaaaacgagaattatacggttttcaaatactataccgccaaagaagcattggaatgtatagacaagtctgagattgaccttgccatattggacatcatgcttcccggcacaagcggccttactatctgtcaaaaaataagggacaagcacacctatccgattatcatgctgaccgggaaagatacagaggtagataaaattacagggttaacaatcggcgcggatgattatataacgaagccctttcgcccactggagttaattgctcgggtaaaggcccagttgcgccgatacaaaaaattcagtggagtaaaggagcagaacgaaaatgttatcgtccactccggccttgtcattaatgttaacacccatgagtgttatctgaacgagaagcagttatcccttactcccaccgagttttcaatactgcgaatcctctgtgaaaacaaggggaatgtggttagctccgagctgctatttcatgagatatggggcgacgaatatttcagcaagagcaacaacaccatcaccgtgcatatccggcatttgcgcgaaaaaatgaacgacaccattgataatccgaaatatataaaaacggtatggggggttggttataaaattgaaaaataa

SEQ ID NO: 10744 - protein, 231 aa, Enterococcus faecium
MSDKILIVDDEHEIADLVELYLKNENYTVFKYYTAKEALECIDKSEIDLAILDIMLPGTSGLTICQKIRDKHTYPIIMLTGKDTEVDKITGLTIGADDYITKPFRPLELIARVKAQLRRYKKFSGVKEQNENVIVHSGLVINVNTHECYLNEKQLSLTPTEFSILRILCENKGNVVSSELLFHEIWGDEYFSKSNNTITVHIRHLREKMNDTIDNPKYIKTVWGVGYKIEK

SEQ ID NO: 10745 - DNA, 693 bp, Escherichia coli
  CDS (1)..(693)
atgccacatcacattgttattgttgaagatgagccggttacccaggcgcgattacaatcctacttcactcaggaggggtataccgtttccgttacggcgagcggtgctgggctacgggaaattatgcagaatcagtcggtagatttaattctgctggatatcaacttacccgatgaaaatggcctgatgttaacccgcgccctgcgagaacgctcaacggtggggattattctggttaccggacgcagcgatcggattgaccgtattgttgggctggaaatgggcgcagacgattacgtcaccaaaccgctggaactgcgcgaactggtagtacgggtgaaaaatctgctctggcgaatcgacctcgcgcgacaagctcaaccgcacactcaggacaactgctatcgctttgccggttattgcctgaatgtgtcgcgccatacgctggagcgggatggcgagccgattaaactgacccgcgcagagtatgaaatgttggtggcatttgtgacgaatccgggcgaaattctcagccgtgaacgtctgctacgtatgctttctgcgcgtcgggtggaaaaccctgacctgcgcaccgtcgatgtgttaattcgtcgtttacgtcataaactcagcgcggatttactggtgacgcaacatggtgaaggttatttcttagccgctgatgtgtgctga

SEQ ID NO: 10746 - protein, 230 aa, Escherichia coli
MPHHIVIVEDEPVTQARLQSYFTQEGYTVSVTASGAGLREIMQNQSVDLILLDINLPDENGLMLTRALRERSTVGIILVTGRSDRIDRIVGLEMGADDYVTKPLELRELVVRVKNLLWRIDLARQAQPHTQDNCYRFAGYCLNVSRHTLERDGEPIKLTRAEYEMLVAFVTNPGEILSRERLLRMLSARRVENPDLRTVDVLIRRLRHKLSADLLVTQHGEGYFLAADVC

SEQ ID NO: 10747 - DNA, 699 bp, Bacillus halodurans
  CDS (1)..(699)
atgactcaggggtataacgtgcttgtggtcgatgatgataaggaaatccgtgaaggaatcaccatctatttaaaaaatgaagggatgaacgtctttcaagcgaaagacggaattgaagcgctcgaacgtttaaatgaagaagatattcacttgatgcttcttgatgtgatgatgcctcgccttgacggtatacagacgacgttaaagatacgtgaagcccgtaacatcccgattatttttctcagtgcgaaaagtgaagaagctgataaggtactgggattgcaagtgggcggtgatgattatgtaacaaaaccgttcaacccgctggagctcattgcgagagtaaagtctcaacttagaagatacgtgaatctcggtacatatgaacagaaaaagcagcttattaacttgaacgggattacgcttgatcttgatgcgaaagaagtaaaagcttatggcgaacctgtcaagctaacaccgattgaataccgaattattgaattgttgatgactaatgcaggccgggtgttttcgatagcagaaatctacgaacgtgtttggaacgaaccgtcctttcaatcatcagaaaatacagtcgctgttcatatacgaaaaattcgtgaaaagatcgaaatcgatcctagcaacccgagacacttaaaagtcgtttggggaattggctacaagatggagcgatga

SEQ ID NO: 10748 - protein, 232 aa, Bacillus halodurans
MTQGYNVLVVDDDKEIREGITIYLKNEGMNVFQAKDGIEALERLNEEDIHLMLLDVMMPRLDGIQTTLKIREARNIPIIFLSAKSEEADKVLGLQVGGDDYVTKPFNPLELIARVKSQLRRYVNLGTYEQKKQLINLNGITLDLDAKEVKAYGEPVKLTPIEYRIIELLMTNAGRVFSIAEIYERVWNEPSFQSSENTVAVHIRKIREKIEIDPSNPRHLKVVWGIGYKMER

SEQ ID NO: 10749 - DNA, 699 bp, Sinorhizobium meliloti; identical to SEQ ID NO: 8313
  CDS (1)..(699)

SEQ ID NO: 10750 - protein, 232 aa, Sinorhizobium meliloti; identical to SEQ ID NO: 8314

SEQ ID NO: 10751 - DNA, 699 bp, Salmonella enterica subsp. enterica serovar Typhi
  CDS (1)..(699)
atgaataaaatcctgttagttgatgatgaccgagagctgacttccctgttaaaagagctcctcgaaatggaaggttttaatgtcctggtggcccacgacggcgagcaggcgcttgagcttttggatgacagcatcgatttacttttgcttgacgtcatgatgccgaagaaaaacggtatcgatacgttgaaagcgcttcgccagacacaccagacgcctgtcattatgctgaccgcgcgcggcaacgagctggatcgcgttctcggccttgagctgggcgcggacgactatttgcccaaaccgtttaacgaccgcgagctggtagcgcgcatcagggctattttgcgccgttcccactggagcgagcagcagcagagcagcgacaacggctcgccgacgctggaagttgatgcgctaagccttaatccgggtcgccaggaagccagtttcgatggccaaacgctggagctgaccggtacggaattcaccctgctctatttactggcgcaacacctcggccaggtggtttcccgtgaacatttaagtcaggaagtgctgggtaagcgcctgacgccgttcgatcgcgccattgatatgcatatttctaacctgcgccgcaaactgccggaacgcaaagacggtcacccgtggtttaaaacattgcgtggtcgcggctatctgatggtttccgcttcatga

SEQ ID NO: 10752 - protein, 232 aa, Salmonella enterica subsp. enterica serovar Typhi
MNKILLVDDDRELTSLLKELLEMEGFNVLVAHDGEQALELLDDSIDLLLLDVMMPKKNGIDTLKALRQTHQTPVIMLTARGNELDRVLGLELGADDYLPKPFNDRELVARIRAILRRSHWSEQQQSSDNGSPTLEVDALSLNPGRQEASFDGQTLELTGTEFTLLYLLAQHLGQVVSREHLSQEVLGKRLTPFDRAIDMHISNLRRKLPERKDGHPWFKTLRGRGYLMVSAS

SEQ ID NO: 10753 - DNA, 720 bp, Yersinia pestis
  CDS (1)..(720)
atgcaagagaatcacaagattctggtcgttgatgacgatatgcgtctacgtgcgctactcgaacgttatttgacggagcaaggttttcaggtccgcagtgtggctaatgctgaacagatggatcgcttgctgactcgtgagtccttccacctgatggtacttgacctgatgttaccgggcgaagatggtttgtcgatttgccgccgcttgcgtagtcaaagtaatccgatgccgatcattatggtgacggcaaaaggcgaagaagtggaccgtatcgttgggctggaaatcggtgcggatgattatattcccaagccattcaaccctcgcgaattactggctcgtatccgtgcggtgctgcgccgtcaggcaaacgaactgccgggagcgccttcacaagaagaggcgatcattgcgtttggcaaatttaaactgaatctgggcacgcgcgagatgtttcgtgaagatgagcctatgccactgactagcggtgaatttgcggtgcttaaagccttggttagccacccacgtgagccgttgtcccgcgataagctgatgaatctggcccgtggccgtgaatacagtgcgatggaacgttctatcgatgtccagatttctcgtttgcgtcggatggtggaagaagatccggcccatccgcgttatatccagacggtgtggggtctaggctacgtctttgtaccggacggcaataaagcatga

SEQ ID NO: 10754 - protein, 239 aa, Yersinia pestis
MQENHKILVVDDDMRLRALLERYLTEQGFQVRSVANAEQMDRLLTRESFHLMVLDLMLPGEDGLSICRRLRSQSNPMPIIMVTAKGEEVDRIVGLEIGADDYIPKPFNPRELLARIRAVLRRQANELPGAPSQEEAIIAFGKFKLNLGTREMFREDEPMPLTSGEFAVLKALVSHPREPLSRDKLMNLARGREYSAMERSIDVQISRLRRMVEEDPAHPRYIQTVWGLGYVFVPDGNKA

SEQ ID NO: 10755 - DNA, 717 bp, Nostoc sp. PCC 7120
  CDS (1)..(717)
atggtgatgctttccgctacaaaccccaaaattcttgttgtagatgacgattttggagtccgtaacctcatatatcgctttttaagccgcaaatatcaaatagagtctgcggcagatggtaaaacagctttgtcattgtttgagcaatttaacccagccttggtgattcttgattggaatcttccagacaccagtggctacagtctttgccaagaaatgcagagccgtaataacgtcttggtgatgatcttgactggaagaacagaggaagctgacaaaattagaatcctggctgctggtgctgatgacttcattacgaagccatttagtttggctgaaattgaagttcgcgtccaagctcttttaagacgtatccgctctattaaaccttctccttcacaacgcttgatatttaagcagttagcaattaacccagaaggaagagaggtaactcttaacgataaacctctgaatctcaccgctttggagtttaatattctccatttcttagctagtcatcctggtcaagcttggagccgtcctcaattaattcaaaaaatttggggttgtgactatgtaggagatggacgggtggttgacgtacacatcggacaactacgtaagaagttagaatctgataccagtataccggagtttattaaaactgttcgcggttacggttataagtttgaaataccagaatctacagcaatttaa

SEQ ID NO: 10756 - protein, 238 aa, Nostoc sp. PCC 7120
MVMLSATNPKILVVDDDFGVRNLIYRFLSRKYQIESAADGKTALSLFEQFNPALVILDWNLPDTSGYSLCQEMQSRNNVLVMILTGRTEEADKIRILAAGADDFITKPFSLAEIEVRVQALLRRIRSIKPSPSQRLIFKQLAINPEGREVTLNDKPLNLTALEFNILHFLASHPGQAWSRPQLIQKIWGCDYVGDGRVVDVHIGQLRKKLESDTSIPEFIKTVRGYGYKFEIPESTAI

SEQ ID NO: 10757 - DNA, 714 bp, Agrobacterium tumefaciens
  CDS (1)..(714)
atggcacaagctccgaccaaccgcgtgccggtggatgacgatgcggcccatctgctgatcgtcgacgatgacgcccgcattcgcaatctcctgcaacgattccttggcgacaagggctatcgcgtctcggtggccggcgacgcggccgaagcacggcgcaagatggtgggcatccgtttcgatctgctgatcctcgacgtgatgatgcccggcgaaaacgggctttcgctgacccgttcactgaacgagaacaaatccgtgccggtcattctcctgaccgcccgttcggaagcggattcgcgcattgccggattggaagcgggcgccgatgactatctcgccaagcccttcgatccgcgcgagcttgtcctgcgcatcaacaatatcctgcggcgcaacacctcgcccgatacgcccaagatcgaacagatcatgttcggcccctacagcttctccattccgaagagggaattgcgacgcggtgccgaaacgatccggctgacggaccgtgaacaggaaatcatgctgcttttcgccctgcgcgccggcgataccattccgcgccacgagctcgtggaggcggaatcggaagtgggtgaaagaaccatcgacgtgcaaatcaaccgtcttcgccgcaagatcgaggacgaccctgccaatcctgtctatctgcaaacggtgcgtggcatcggttaccgcctgagcgtggactga

SEQ ID NO: 10758 - protein, 237 aa, Agrobacterium tumefaciens
MAQAPTNRVPVDDDAAHLLIVDDDARIRNLLQRFLGDKGYRVSVAGDAAEARRKMVGIRFDLLILDVMMPGENGLSLTRSLNENKSVPVILLTARSEADSRIAGLEAGADDYLAKPFDPRELVLRINNILRRNTSPDTPKIEQIMFGPYSFSIPKRELRRGAETIRLTDREQEIMLLFALRAGDTIPRHELVEAESEVGERTIDVQINRLRRKIEDDPANPVYLQTVRGIGYRLSVD

SEQ ID NO: 10759 - DNA, 720 bp, Brucella melitensis
  CDS (1)..(720)
atgaaggaagcttcggcaacgcagacgattgcgctggttgatgatgaccgcaacatcctgacctccgtttccattgcgctggagtcggaaggttatcgcgtcgaaacctataccgacggcgcttctgcgctggatgggttgatggcgcgtccgcccaatcttgcgatcttcgatatcaagatgccgcgcatggacggtatggagcttctgcgccgcctgcgccagaagtccgatctgccggtcatcttcctcacttccaaggacgatgagatcgatgaactcttcggcctcaagatgggggcggacgatttcatcaccaagcctttttcgcagcgtcttctggtcgagcgtgtcaaggctgttctgcgccgcgtggcggcgcgcgacggcacggcaaagcccgccggccagcaggccaagtcccttgagcgcggacagctcgtcatggatcaggagcgccatacctgcacctggaagggtgagccggttacgctgactgttaccgaatttctcatccttcactcacttgcccagcgccccggcgtggtcaaaagccgtgacgccctgatggatgcggcctatgatgaacaggtctatgtggatgatcgcaccatcgacagccacatcaagcgtctgcgcaagaagttcaaggcggttgacgacagcttcgagatgatcgaaacgctctacggcgtcggttatcgtttccgggaagcgtaa

SEQ ID NO: 10760 - protein, 239 aa, Brucella melitensis
MKEASATQTIALVDDDRNILTSVSIALESEGYRVETYTDGASALDGLMARPPNLAIFDIKMPRMDGMELLRRLRQKSDLPVIFLTSKDDEIDELFGLKMGADDFITKPFSQRLLVERVKAVLRRVAARDGTAKPAGQQAKSLERGQLVMDQERHTCTWKGEPVTLTVTEFLILHSLAQRPGVVKSRDALMDAAYDEQVYVDDRTIDSHIKRLRKKFKAVDDSFEMIETLYGVGYRFREA

SEQ ID NO: 10761 - DNA, 717 bp, Brucella melitensis
  CDS (1)..(717)
atgaaagaagacgcccacattctgatcgtcgatgacgacaaggatatacgcgaccttctgcacgaatttctcaaacggcgcggaatgcacgtttccatcgcctgcaatggtgatgaaatgctggatgtgctgagccgcacgcccattgatctcgtcattctggatgtcatgctgccgggaaaaagcggcatagaaatctgtcaggatgtgcggcgcacctcccgtgtgcctatcattatgctgacggccattgccgatgcagccgacaagatactgggattggaaatcggcgcggacgactatatcgccaagcccttcgacccgcgcgagttgcttgcgcgcatccgcgccgtgcttcgccgtttcgagggcaatcgcagcccgcagcgcgcccttacgcagatttaccgcttcgcgggctggacgctcgactgcgcccggcggcgccttacatcgccccacgatgtgcgggtggaactgacgacagccgaattcaacctgctcgaagctttcgtcaaaagctcgcagcatattctaagccgcgaccagttgatggaaatggcaggccatcaggccgtctatggctatgatcgcagcgtggatattctcatcagccgcctgcgcaagaagctggaggacgatccgtgcgcgccgaagctgatccttaccattcgcggcggcggctaccagttcgggcatgaagtggaaatagcatga

SEQ ID NO: 10762 - protein, 238 aa, Brucella melitensis
MKEDAHILIVDDDKDIRDLLHEFLKRRGMHVSIACNGDEMLDVLSRTPIDLVILDVMLPGKSGIEICQDVRRTSRVPIIMLTAIADAADKILGLEIGADDYIAKPFDPRELLARIRAVLRRFEGNRSPQRALTQIYRFAGWTLDCARRRLTSPHDVRVELTTAEFNLLEAFVKSSQHILSRDQLMEMAGHQAVYGYDRSVDILISRLRKKLEDDPCAPKLILTIRGGGYQFGHEVEIA

SEQ ID NO: 10763 - DNA, 717 bp, Yersinia pestis
  CDS (1)..(717)
atgcagaccccccacattctgatcgtagaagacgagatagtcactcgcaacacactaaagagcattttcgaggcggaaggctacgttgtttatgaagccaatgatggggcagaaatgcaccatatcctgtctgaaaatgacatcaacttagtgatcatggacatcaatctgccaggcaaaaatggcttgttgctagcacgggagctccgtgagcaagccagtgttgctctcatgttcctcaccggtcgtgataacgaagttgataagatccttggtttggaaattggtgctgatgattacatcacgaaacctttcaacccacgtgaattaaccatccgtgcccgtaacctgctgtctcgcaccatgaatctgagcagtgtaggcgaagaacgccgtttggttgaaagctacaaatttaatggttgggagctggatatcaatagccgctcactggtcagccctacgggtgagcattacaaactgccacgcagtgagttccgcgccatgctgcatttctgcgaaaacccagggaaaattcaatcccgcggtgaattgttgaaaaaaatgaccggtcgcgagttgaaacctcatgaccgtactgtcgatgtgactatccgccgtattcgtaaacacttcgaatctacgccggatacaccagaaattatcgccaccatccacggtgaaggctatcgtttctgtggcgatctagaagagtaa

SEQ ID NO: 10764 - protein, 238 aa, Yersinia pestis
MQTPHILIVEDEIVTRNTLKSIFEAEGYVVYEANDGAEMHHILSENDINLVIMDINLPGKNGLLLARELREQASVALMFLTGRDNEVDKILGLEIGADDYITKPFNPRELTIRARNLLSRTMNLSSVGEERRLVESYKFNGWELDINSRSLVSPTGEHYKLPRSEFRAMLHFCENPGKIQSRGELLKKMTGRELKPHDRTVDVTIRRIRKHFESTPDTPEIIATIHGEGYRFCGDLEE

SEQ ID NO: 10765 - DNA, 729 bp, Nostoc sp. PCC 7120; identical to SEQ ID NO: 8329
  CDS (1)..(729)

SEQ ID NO: 10766 - protein, 242 aa, Nostoc sp. PCC 7120; identical to SEQ ID NO: 8330

SEQ ID NO: 10767 - DNA, 762 bp, Nostoc sp. PCC 7120; identical to SEQ ID NO: 8331
  CDS (1)..(762)

SEQ ID NO: 10768 - protein, 253 aa, Nostoc sp. PCC 7120; identical to SEQ ID NO: 8332

SEQ ID NO: 10769 - DNA, 717 bp, Nostoc sp. PCC 7120; identical to SEQ ID NO: 8333
  CDS (1)..(717)

SEQ ID NO: 10770 - protein, 238 aa, Nostoc sp. PCC 7120; identical to SEQ ID NO: 8334

SEQ ID NO: 10771 - DNA, 738 bp, Yersinia pestis
  CDS (1)..(738)
atgaaacctgcaatcctcgtggtggatgacgatacggccatctgtgaagtgctgcgagatgtacttaacgaacacgtattcgatgtactgttatgccacagcggcaatgaggcgcttcagattaccgctacacagccctcaatcgcacttattttgcttgatatgatgctgccggatatcaatggcctgttggtgttgcagcaagtgcaaaaactgcgcccgtcgctaccggtcgtgatgctcaccggcatgggtagtgagtctgatatggtggttgggctagaaatgggggcggacgactatatcgctaaaccatttaatgccagggtagtggtcgcacgcgttaaagcggtgttgcggcggagcgaggtgttggcgatagaaagtagcagtgtgatagaaagtagcagtgtgaaagcctgcggattgcaatttaatggctggcggctgaataccgaccgctgtcagttgatgaacccacagcagcagcaaatcgatttgactcagggggaatatggcctgctgctgtcgttgatgcaaaacgccagaaaagtgctctctcgtgaaaagctgcttgaactgacgcaccgtgaaagcctggacgtttttgatcgcactattgatgtactgattatgcggttacgtcgaaaaatagaagttaatccgcaccagcccacactgatccgtaccatccgcggcgtggggtatgtctttgccgccgatattattcatgcctag

SEQ ID NO: 10772 - protein, 245 aa, Yersinia pestis
MKPAILVVDDDTAICEVLRDVLNEHVFDVLLCHSGNEALQITATQPSIALILLDMMLPDINGLLVLQQVQKLRPSLPVVMLTGMGSESDMVVGLEMGADDYIAKPFNARVVVARVKAVLRRSEVLAIESSSVIESSSVKACGLQFNGWRLNTDRCQLMNPQQQQIDLTQGEYGLLLSLMQNARKVLSREKLLELTHRESLDVFDRTIDVLIMRLRRKIEVNPHQPTLIRTIRGVGYVFAADIIHA

SEQ ID NO: 10773 - DNA, 762 bp, Agrobacterium tumefaciens
  CDS (1)..(762)
atggctggccaggatcctagattgagaggtgaaccgttgaaacacgttcttgtcatcgatgacgatgtcgctatgcggcatcttatagtcgagtatcttacgatccatgcctttaaggtgactgcggtagccgacagcaagcagttcaatcgtgtactctgctccgagacggtcgatgtcgtggtcgtcgatcttaatttgggtcgcgaagatgggcttgaaattgttcgtagtctggccacgaagtccgatgttccaatcataattattagcggcgctcgcctcgaagaggcggacaaagttattgcgctcgagttgggagcaaccgattttattgccaagccttttgggacgcgggaatttctggcgcgcatccgtgttgcgttacgcgtgcggcccagtgtcgcgcgaaccaaagatcgacgctcatttagtttcgctgactggacacttaatctcaggcgacgccgcttgatttcggaagagggcagtgaggtgaaactcacggcaggtgagtttaatctcctggttgctttcctggagaagccgcgcgacgtcctatcccgggagcagcttctgatcgccagtcgggtacgcgaggaggaggtgtatgacagaagtattgatgtcctcattttgcggctgcgccggaagcttgagggggatccgacgacccctcagttgatcaagactgcaagaggtgctggctatttctttgacgctgacgtggatgtttcgtacgggggtgtgatggcggcctga

SEQ ID NO: 10774 - protein, 253 aa, Agrobacterium tumefaciens
MAGQDPRLRGEPLKHVLVIDDDVAMRHLIVEYLTIHAFKVTAVADSKQFNRVLCSETVDVVVVDLNLGREDGLEIVRSLATKSDVPIIIISGARLEEADKVIALELGATDFIAKPFGTREFLARIRVALRVRPSVARTKDRRSFSFADWTLNLRRRRLISEEGSEVKLTAGEFNLLVAFLEKPRDVLSREQLLIASRVREEEVYDRSIDVLILRLRRKLEGDPTTPQLIKTARGAGYFFDADVDVSYGGVMAA

SEQ ID NO: 10775 - DNA, 726 bp, Bacillus halodurans
  CDS (1)..(726)
atggaagagcgaagcattctcattgtagatgatgaaaaggcaattgtgaaaatgctcgaaaccgttttgcgcaaggaagggttttcgacgatctatactgcatataacgcagaagaagcttttcattacgtaaaaaactatacattggacgtgattttgcttgatgttatgttgccagatcggagcggatttgacctttgtccacaaattcgagggttaacgcaagcatacattttatttttaaccgcaaaagtttcagatttagacaagctgactggctttgcgattggtgctgatgactatgtaacgaagccatttaacccattggaaattgtggcgcggattaacgcacgattaaggagagaggtcaatagtgttgcaaaagaacaggtggctacaacctcgataagaaagggaatctttacgtttgatcgatttacggtgaacgaattagccggtgaacttttagttgatggacggaaggtcccttgtccggctcaagtttttttattgctatgctacttttgtaagcatcctaatcgtattttatcgaaggagcaattgttagaagctgtttgggggatggacagttttgtcgatgacaatacagttatggttcatattagacgaattcgagagagaatcgaaatcgatccgagccacccacgttaccttgtaacagttcgaggcctaggttacaagctagtgaaggagcctgaggcatga

SEQ ID NO: 10776 - protein, 241 aa, Bacillus halodurans
MEERSILIVDDEKAIVKMLETVLRKEGFSTIYTAYNAEEAFHYVKNYTLDVILLDVMLPDRSGFDLCPQIRGLTQAYILFLTAKVSDLDKLTGFAIGADDYVTKPFNPLEIVARINARLRREVNSVAKEQVATTSIRKGIFTFDRFTVNELAGELLVDGRKVPCPAQVFLLLCYFCKHPNRILSKEQLLEAVWGMDSFVDDNTVMVHIRRIRERIEIDPSHPRYLVTVRGLGYKLVKEPEA

SEQ ID NO: 10777 - DNA, 765 bp, Caulobacter crescentus
  CDS (1)..(765)
atggaaaacgtccaaaacgccgcccaaagcgagctcgaggccgtccgcggggcgccttcgcggatcctgatcgtcgatgacgatccgggcatacgcgacgtggtgtccgactttctcgccaagcacggctatgtggtcgagaccgcccaggatggccgcacgatggagcaggttctggcgcgggggccgatcgatctgatcgtgctcgacgtcatgctgcccggcgaagacggcctggccatctgccggcggctgtccgcgacacccgaagctcccgccatcatcatgctgtcggcgatgggcgaggaaaccgaccgcatcgtcggcctggagctgggcgccgacgactatctgcccaagccctgcaatccgcgcgagctcttggctcgtgtccgcgccgtgctgcgtcgccgccaggagccgcgcgcggtggatgacgcgatgggcgcggcctgcgagttcgccggttggcgcctggacctcgtgcgtcgcgaactgcgctcgccccagtcgatcgtggtgaacctgtccagcggcgagttctcgctgctgcgcgccttcgtcgagcgtccccagcgcgtcctcacgcgcgaccagttgctggatctggcgcggggccgcgacagcgacgcctatgatcgcgccatcgacgttcagatcagccgcctgcgccgcaagctcgatgacggcggcggcagcgagctgatccgcaccatccgcagcgaaggctacatgttcaccgccaaggtcgtgcgcaccccatga

SEQ ID NO: 10778 - protein, 254 aa, Caulobacter crescentus
MENVQNAAQSELEAVRGAPSRILIVDDDPGIRDVVSDFLAKHGYVVETAQDGRTMEQVLARGPIDLIVLDVMLPGEDGLAICRRLSATPEAPAIIMLSAMGEETDRIVGLELGADDYLPKPCNPRELLARVRAVLRRRQEPRAVDDAMGAACEFAGWRLDLVRRELRSPQSIVVNLSSGEFSLLRAFVERPQRVLTRDQLLDLARGRDSDAYDRAIDVQISRLRRKLDDGGGSELIRTIRSEGYMFTAKVVRTP

SEQ ID NO: 10779 - DNA, 708 bp, Staphylococcus aureus
  CDS (1)..(708)
atgcaaatggctagaaaagttgttgtagttgatgatgaaaaaccgattgctgatattttagaatttaacttaaaaaaagaaggatacgatgtgtactgtgcatacgatggtaatgatgcagtcgacttaatttatgaagaagaaccagacatcgtattactagatatcatgttacctggtcgtgatggtatggaagtatgtcgtgaagtgcgcaaaaaatacgaaatgccaataataatgcttactgctaaagattcagaaattgataaagtgcttggtttagaactaggtgcagatgactatgtaacgaaaccgtttagtacgcgtgaattaatcgcacgtgtgaaagcgaacttacgtcgtcattactcacaaccagcacaagacactggaaatgtaacgaatgaaatcacaattaaagatattgtgatttatccagacgcatattctattaaaaaacgtggcgaagatattgaattaacacatcgtgaatttgaattgttccattatttatcaaaacatatgggacaagtaatgacacgtgaacatttattacaaacagtatggggctatgattactttggcgatgtacgtacggtcgatgtaacgattcgtcgtttacgtgaaaagattgaagatgatccgtcacatcctgaatatattgtgacgcgtagaggcgttggatatttcctccaacaacatgagtag

SEQ ID NO: 10780 - protein, 235 aa, Staphylococcus aureus; identical to SEQ ID NO: 8338

SEQ ID NO: 10781 - DNA, 675 bp, Clostridium acetobutylicum; identical to SEQ ID NO: 8339
  CDS (1)..(675)

SEQ ID NO: 10782 - protein, 224 aa, Clostridium acetobutylicum; identical to SEQ ID NO: 8340

SEQ ID NO: 10783 - DNA, 756 bp, Streptococcus pneumoniae; identical to SEQ ID NO: 8341
  CDS (1)..(756)

SEQ ID NO: 10784 - protein, 251 aa, Streptococcus pneumoniae; identical to SEQ ID NO: 8342

SEQ ID NO: 10785 - DNA, 684 bp, Haemophilus influenzae
  CDS (1)..(684)
atgtcaaaactcttactcgttgatgatgatattgaattaactgaactactttctacacttttagaacttgagggttttgacgttgaaactgcaaataatggattagaagcattacaaaaactcaatgaaagctataaactggttttacttgatgtaatgatgccaaagttaaatggtatcgaaacattaaaagaaattcgtaaagtctctaacgtgccagtgatgatgctaacagcaagaggcgaagacattgatcgcgtattaggcttagaattgggagcggatgattgtttacccaagccttttaacgatcgtgaacttattgcaagaattaaggcgattttgcgtcgtagtgcatctccttcaaataatatatcaaatgtagaaatcctttcttttgacggaattactctccacttttctcacggaattgcaacctataatgaagaaaatctaaatttaacggattatgaatttaagattctttgtttattgcttaaatctaagggaaatgtggtaagtcgagaagaattaagtttagaagtaatggaaaaaccgctcactccatttgaccgttctcttgatatgcacatctctaatttaagacgcaaattaccaaaacgaaaaaacaagccctcttggtttaaaactttacgcggaaaaggatacgctttagttacctaa

SEQ ID NO: 10786 - protein, 227 aa, Haemophilus influenzae
MSKLLLVDDDIELTELLSTLLELEGFDVETANNGLEALQKLNESYKLVLLDVMMPKLNGIETLKEIRKVSNVPVMMLTARGEDIDRVLGLELGADDCLPKPFNDRELIARIKAILRRSASPSNNISNVEILSFDGITLHFSHGIATYNEENLNLTDYEFKILCLLLKSKGNVVSREELSLEVMEKPLTPFDRSLDMHISNLRRKLPKRKNKPSWFKTLRGKGYALVT

SEQ ID NO: 10787 - DNA, 1110 bp, Bacillus subtilis
  CDS (1)..(1110)
atggacggccagtttgaacaaaaaaagaaacaaaaagacgagacttatgacattgagcacctgattgcatgcttttcaccgatgatcagaaaaaaactcagcaatacgtcctatcaagaaagagaagatttagagcaagagctgaagatcaaaatgtttgaaaaggctgatatgcttttatgtcaggatgtaccggggttttgggagtttattttgtacatggtagatgagaactcatcaatcatttctcatatgaaaaaacatcaaaagggagcgcttgtttgctccttttttgctgttttgatttgccaaggctccaatgtattcaaaaatgtgaccataaataaacgatataatgataagatgaaaaaaacagtgacagaaaggaacataaaagtggaaaatgcgtcaattttaatcgtagacgatgagaaagcgattgtggacatgatcaaacgcgttctcgaaaaagaaggttatcgaaatatactggatgcggcaagcgcagaagaagcgattcccgttgtgaaggccaataaggttgacttgattgtgctggatgtcatgatgggcggaatgtccggttttgaagcctgcacattgatcagagagtattcagacgctccgatttttttcctgacggcaagatcatccgacgcggacaaattatcgggctttgcggttggagctgatgactatatcacaaaaccatttaatccgctggaattagcggcgcggatcagagcgcatctcaagcgtacatatcaatcgaaagaaacgagttcaaatcaaacctacacatatgattactttactttttctccgcaaaatgccgagttgatcgtaggcggggaagccgttgcctgttcagcccagcttctgcagcttttgcagtatttttgtgaacaccctaacgtggtgctttccaaagatcaaatatatgaaaaagtatggggctatccttcctacggtgacaacaacaccgtcatggttcatattcgcaagcttagggagaagactgagcgcgatccgagcaatccggagtatattgtaaccgttcgaggtctcggctatcgttttatcccaaatcctgaaggcaagcggtcatga

SEQ ID NO: 10788 - protein, 369 aa, Bacillus subtilis
MDGQFEQKKKQKDETYDIEHLIACFSPMIRKKLSNTSYQEREDLEQELKIKMFEKADMLLCQDVPGFWEFILYMVDENSSIISHMKKHQKGALVCSFFAVLICQGSNVFKNVTINKRYNDKMKKTVTERNIKVENASILIVDDEKAIVDMIKRVLEKEGYRNILDAASAEEAIPVVKANKVDLIVLDVMMGGMSGFEACTLIREYSDAPIFFLTARSSDADKLSGFAVGADDYITKPFNPLELAARIRAHLKRTYQSKETSSNQTYTYDYFTFSPQNAELIVGGEAVACSAQLLQLLQYFCEHPNVVLSKDQIYEKVWGYPSYGDNNTVMVHIRKLREKTERDPSNPEYIVTVRGLGYRFIPNPEGKRS

SEQ ID NO: 10789 - DNA, 723 bp, Vibrio cholerae
  CDS (1)..(723)
atggtggaaaatcataaagttttagtggtagatgatgatgcgcgcttgcgtgcgctgcttgagcgttacctgtccgagcagggttttcaagtccgcagcgtggctaacggcgagcagatggatcgtctgctgacgcgcgaaaacttccatttgatggtgctggatttgatgttgccgggtgaagatggtctttctatctgtcgtcgtctgcgcaattccaacaacatgatcccgattctgatgctcactgccaaaggcgatgagattgaccgcattgtcggcctagaagttggtgccgatgattacctgcctaagccatttaacccacgtgagttgctggcgcgtatcaaagcggtattgcgccgccaagtgattgaagcgccgggagcgcccagtgcagaagagaccatcattgaatttggtgagtttcgcttaaatcttggtacgcgagaaatgttccgtggtgaagaggcgatgccactcacttctggtgaatttgctgtgttgaaagcactcgtgaccaatgcccgtgaaccgctttcgcgcgataaactgatgaacatggcgcgtggccgtgaatattcagcgatggagcgctcgattgacgtacagatttctcgtctacgtcgtatgctcgaagttgaccctagcaaaccgcgctatattcaaaccgtatggggactcggttacgtgtttgttcctgatggtaaagccgccaactaa

SEQ ID NO: 10790 - protein, 240 aa, Vibrio cholerae
MVENHKVLVVDDDARLRALLERYLSEQGFQVRSVANGEQMDRLLTRENFHLMVLDLMLPGEDGLSICRRLRNSNNMIPILMLTAKGDEIDRIVGLEVGADDYLPKPFNPRELLARIKAVLRRQVIEAPGAPSAEETIIEFGEFRLNLGTREMFRGEEAMPLTSGEFAVLKALVTNAREPLSRDKLMNMARGREYSAMERSIDVQISRLRRMLEVDPSKPRYIQTVWGLGYVFVPDGKAAN

SEQ ID NO: 10791 - DNA, 762 bp, Pseudomonas aeruginosa
  CDS (19)..(762)
ctcattctgggagtttctatgtcgaaccctgccgccctggccgaaggtgaaaagatcctcgtcgtcgacgacgacgcccgcctgcgccgcctgctcgaacgtttcctcgacgagcagggctaccgcgtccgcgcggtggagaacaccgagcagatggatcgccttctatcccgcgaactgttccagttggttgtgctcgacctgatgcttcccggcgaggacggcctcactgcctgccgccgcctgcgcgaacagaacaatcaggtgccgatcatcatgctcaccgccaagggcgacgagggcagccgcatccagggcctggaactgggcgccgacgactacctggccaagccgttcaacccgcgcgaactgctggcgcggatcaaggccgtgctgcgccgccaggcgccgctggtgcccggcgcgcctgccggtgccgacgaggtggtgaccttcggcgactaccagctgttcctcgccacccgcgaactgaagaagggcgacgaggtacacatgctgaccaccggcgagttcgccgtgctcaaggccctggtgcagcacgcccgcgaaccgctgacccgggacaagctgatgaacctcgcccgtggccgcgagtgggatgccctggagcgttccatcgacgtgcagatctcgcgcctgcgccggctgatcgagccggatccgtccaagccgcgctatatccagacggtctggggcgtcggctacgtgttcgtgccggacggcaacgcgcgcaaggcctga

SEQ ID NO: 10792 - protein, 247 aa, Pseudomonas aeruginosa
MSNPAALAEGEKILVVDDDARLRRLLERFLDEQGYRVRAVENTEQMDRLLSRELFQLVVLDLMLPGEDGLTACRRLREQNNQVPIIMLTAKGDEGSRIQGLELGADDYLAKPFNPRELLARIKAVLRRQAPLVPGAPAGADEVVTFGDYQLFLATRELKKGDEVHMLTTGEFAVLKALVQHAREPLTRDKLMNLARGREWDALERSIDVQISRLRRLIEPDPSKPRYIQTVWGVGYVFVPDGNARKA

SEQ ID NO: 10793 - DNA, 711 bp, Bacillus halodurans; identical to SEQ ID NO: 8345
  CDS (1)..(711)

SEQ ID NO: 10794 - protein, 236 aa, Bacillus halodurans; identical to SEQ ID NO: 8346

SEQ ID NO: 10795 - DNA, 744 bp, Thermotoga maritima; identical to SEQ ID NO: 8347
  CDS (1)..(744)

SEQ ID NO: 10796 - protein, 247 aa, Thermotoga maritima; identical to SEQ ID NO: 8348

SEQ ID NO: 10797 - DNA, 705 bp, Bacillus halodurans
  CDS (1)..(705)
atgatagaacataaaatattacttattgaagatgatgtttcaatcagtgagatggtgaaagagcatttacaacttgagggttatcatgtttgttgtgcttttgatggcgaagaagccacacgactgtttgagcaaaatacgtatgaccttgttttacttgacctgatgctaccaagacgaaacgggattgattgcttacaatggattcgaacgaagagtgttgtccctgttctcattatgtcagcaaaagacagtgatgtagataaagcactcggattaggatttggcgccgatgactacataacgaaacctttttccatgattgaattaacggctcgggtcaaagccgctattcgcagaacggtcaattacgctcaagcaagccagagtgctgagaacgaaaggataaaaattcatgaattagtagttgagctaagcagctttacggtcaaaaaaaagggcgaagaaatcaaactaactgccaaagaatttcagattcttaagttgtttgtgacccatccgaaaaaagtatttacgaaagagcagttgtatcgttccgtttggaatgatgactattatagcgatgaaaatgtcattaatgttcatatcagacggttaagagaaaaaattgaagacaccccttccaagccacaatatatcaaaacgatttggggaatcggttaccggatgggggagtttgaatga

SEQ ID NO: 10798 - protein, 234 aa, Bacillus halodurans
MIEHKILLIEDDVSISEMVKEHLQLEGYHVCCAFDGEEATRLFEQNTYDLVLLDLMLPRRNGIDCLQWIRTKSVVPVLIMSAKDSDVDKALGLGFGADDYITKPFSMIELTARVKAAIRRTVNYAQASQSAENERIKIHELVVELSSFTVKKKGEEIKLTAKEFQILKLFVTHPKKVFTKEQLYRSVWNDDYYSDENVINVHIRRLREKIEDTPSKPQYIKTIWGIGYRMGEFE

SEQ ID NO: 10799 - DNA, 684 bp, Bacillus halodurans
  CDS (1)..(684)
atgtcggaatatctcgtgcatttagtagaagatgaagcaaatctttctgaagtattaaaagcgtatcttgaaaaagaaggatggagtgtgagagtgtttactgatggaaatgtagcacaagaagccattagtgaacaacagcctcacttatggatactagatattatgcttccgggaacagatggctatcaattattaaagcaaattaaagaaaaaggggatacccctgtcattttcatctcggctcgggatcaagacttggatcgggttttaggacttgagatggggagtgacgattatttagctaagccttttctaccacaagaattaattattcgagcgaaaaagcttttaaatcgtgtttacggttcctcgtcacaggagcaacgaaagatcgaaattaatcattatgtcattgatccagtgggacgtacggtcatcgatcaagaaaacaatgatgaggctgtcgatttgacaacaaaagagatggatttaatcttgctattgacaggagacataggcaaagcattctctcgagagcggatcattgagcatgtatggggagaaaattatttcggctctgagcgtgcggttgatgatgtcgttcggagggtgcgtaagaaaatgccgcggattcatttagagacattatatggttacgggtacagggttctctcttcatga

SEQ ID NO: 10800 - protein, 227 aa, Bacillus halodurans
MSEYLVHLVEDEANLSEVLKAYLEKEGWSVRVFTDGNVAQEAISEQQPHLWILDIMLPGTDGYQLLKQIKEKGDTPVIFISARDQDLDRVLGLEMGSDDYLAKPFLPQELIIRAKKLLNRVYGSSSQEQRKIEINHYVIDPVGRTVIDQENNDEAVDLTTKEMDLILLLTGDIGKAFSRERIIEHVWGENYFGSERAVDDVVRRVRKKMPRIHLETLYGYGYRVLSS

SEQ ID NO: 10801 - DNA, 717 bp, Bacillus halodurans; identical to SEQ ID NO: 8349
  CDS (1)..(717)

SEQ ID NO: 10802 - protein, 238 aa, Bacillus halodurans; identical to SEQ ID NO: 8350

SEQ ID NO: 10803 - DNA, 726 bp, Staphylococcus aureus; identical to SEQ ID NO: 8351
  CDS (1)..(726)

SEQ ID NO: 10804 - protein, 241 aa, Staphylococcus aureus; identical to SEQ ID NO: 8352

SEQ ID NO: 10805 - DNA, 738 bp, Sinorhizobium meliloti
  CDS (1)..(738)
atggagcacatcgatcacatcctgatcgtcgatgacgatcgggaaatccgcgagcttgtgtccgcttacctgaagaagaacggtctgcgggtgaccgccgttgccgacgggcggcagatgcggaccttcctcgaggcaaatacagtcgatctgatcatcctcgatctgatgatgccgggcgacgacggcctcgtcttgagccgcgagctgcgtgtcggcagacacaaggcgacgcccatcgtcatgctgaccgcccgctcggacgagatggaccgcatcatcgggctggaaatgggcgccgacgactatatcgccaaacccttctcggcgcgcgaactgctcgcccgcatcaaggcggtcctgcggcgcgcgcggatgctgccagcgaacctgcaggtctcggaggcaggtcagctgttgcgtttcggccaatggaagctggacacgacggcaaggcatctcatcgatgcggatggtactgcgattgcactcagcggcgccgaataccggctgctgcgcgtcttcgtcgaccacccgcagcgcgtcctcaaccgcgatcagctcctcaacctcacacaggggcgcgaggccgagctcttcgaccgatcgatcgatctcctggtcagccgggtacgccagcgcctcggcgacgatgctcgggaaccgacctatatcaggaccgtccgcagcgaaggctatgttttctcggtgccggtcgagatcatggagccccgctga

SEQ ID NO: 10806 - protein, 245 aa, Sinorhizobium meliloti
MEHIDHILIVDDDREIRELVSAYLKKNGLRVTAVADGRQMRTFLEANTVDLIILDLMMPGDDGLVLSRELRVGRHKATPIVMLTARSDEMDRIIGLEMGADDYIAKPFSARELLARIKAVLRRARMLPANLQVSEAGQLLRFGQWKLDTTARHLIDADGTAIALSGAEYRLLRVFVDHPQRVLNRDQLLNLTQGREAELFDRSIDLLVSRVRQRLGDDAREPTYIRTVRSEGYVFSVPVEIMEPR

SEQ ID NO: 10807 - DNA, 729 bp, Pseudomonas aeruginosa
  CDS (1)..(729)
atgagcgcgaacggacgatcgatcctgctggtggacgatgaccaggaaatccgcgaattgctggagacctacctgagccgcgccggcttccaggtccgcagcgtctcgcggggcgccgacttccgccaggcgctgtgcgaggaggaggcgagcctggcgatcctcgacgtgatgctgccggacgaggacggcttcagcctctgtcgctggattcgctcccaccagcgcctggcctgcatgccgatcataatgctcaccgccagttccgacgaggccgaccgggtgatcggcctggaactgggcgccgacgactacctgggcaagccgttcagcccgcgcgagctgctggcgcggatcaaggccctgctgcgccgcgcgcagttcacccaggtgcgcggtggcgacgtactggccttcgaggactggcgactggacacggtcagccaccggctgttccacgaggacggcgaggagttcttcctcagcggcgcggatttcgccctgctcaagctgttccttgaccatccgcagcagatcctcgaccgcgacaccatcgccaacgccacccgcggccgcgaggtgctgccgctggagcgcatcgtcgacatggcggtcagccgcctgcgccagcgcctgcgcgacaccggcaaggcgccgcggctgatccagaccgtgcgcggcagtggctacctgctggcggcgcaggtgcggccgcacctgcagccatga

SEQ ID NO: 10808 - protein, 242 aa, Pseudomonas aeruginosa
MSANGRSILLVDDDQEIRELLETYLSRAGFQVRSVSRGADFRQALCEEEASLAILDVMLPDEDGFSLCRWIRSHQRLACMPIIMLTASSDEADRVIGLELGADDYLGKPFSPRELLARIKALLRRAQFTQVRGGDVLAFEDWRLDTVSHRLFHEDGEEFFLSGADFALLKLFLDHPQQILDRDTIANATRGREVLPLERIVDMAVSRLRQRLRDTGKAPRLIQTVRGSGYLLAAQVRPHLQP

SEQ ID NO: 10809 - DNA, 702 bp, Lactococcus lactis subsp. lactis
  CDS (1)..(702)
atgaaaaaaattcttgttgttgatgatgaaaaaccaatctcagatatcgtaaaatttaatttaaccaaagaaggttttgaagtatttacagctttcgatggcgaagaagcccttgaagcttttaaagaagtacaacctgaccttattttacttgatttgatgttaccaaaacttgacggtcttgatgttgcacgtgaaatccgtaaaacctctgacactcctattatcatggtgtcagctaaagatagcgagtttgataaagttattggacttgaacttggtgcagatgactatgtcactaaaccattctcaaatcgcgaacttttagctcgtattaaagcaaacttgcgtcgtatcaatgtcgcacctgctgaatctactgataatgttaagaaagaattgattatcggaaatctccgtatcaatccagcacattatgctgcttacaaaaatgataaacaacttgacctcacacaccgtgagtttgaattactttactatcttgctcaacacctcggcgaagttatcactcgtgaaaatcttttggaaacagtttggggctacgattactttggtgatgtgcgtacagttgacgttacagtccgccgcttgcgtgaaaaagttgaagatacaccaagccgtccacaatacgtttcaacacgccgcggggttggctattacatgagcaacccacatgattaa

SEQ ID NO: 10810 - protein, 233 aa, Lactococcus lactis subsp. lactis
MKKILVVDDEKPISDIVKFNLTKEGFEVFTAFDGEEALEAFKEVQPDLILLDLMLPKLDGLDVAREIRKTSDTPIIMVSAKDSEFDKVIGLELGADDYVTKPFSNRELLARIKANLRRINVAPAESTDNVKKELIIGNLRINPAHYAAYKNDKQLDLTHREFELLYYLAQHLGEVITRENLLETVWGYDYFGDVRTVDVTVRRLREKVEDTPSRPQYVSTRRGVGYYMSNPHD

SEQ ID NO: 10811 - DNA, 684 bp, Mycobacterium tuberculosis
  CDS (1)..(684)
atgaccagtgtgttgattgtggaggacgaggagtcgctggccgatccgctggcgtttctgctgcgcaaggagggctttgaggccacggtggtgaccgatggtccggcagctctcgccgagttcgaccgggccggcgccgacatcgtcctgctcgatctgatgctgcctgggatgtcgggtaccgatgtatgcaagcagttgcgcgctcggtccagcgttccggtgatcatggtgaccgcccgggatagcgagatcgacaaggtggtcggcctggagctgggcgctgacgactacgtgaccaagccctattcggcacgcgagttgatcgcacgcatccgcgcggtgctgcgccgtggcggcgacgacgactcggagatgagcgatggcgtgctggagtccgggccggttcgcatggatgtggagcgccatgtcgtctcggtgaacggtgacaccatcacgctgccgctcaaggagttcgacctgctggaatacctgatgcgcaacagcgggcgggtgttgactcgcggacaactgatcgaccgggtctggggtgcggactacgtgggcgacaccaagacgctcgacgtccatgtcaagcggctgcgctccaagatcgaagccgacccggctaacccggttcacttggtgacggtgcgcgggctgggctacaaactcgagggctag

SEQ ID NO: 10812 - protein, 227 aa, Mycobacterium tuberculosis
MTSVLIVEDEESLADPLAFLLRKEGFEATVVTDGPAALAEFDRAGADIVLLDLMLPGMSGTDVCKQLRARSSVPVIMVTARDSEIDKVVGLELGADDYVTKPYSARELIARIRAVLRRGGDDDSEMSDGVLESGPVRMDVERHVVSVNGDTITLPLKEFDLLEYLMRNSGRVLTRGQLIDRVWGADYVGDTKTLDVHVKRLRSKIEADPANPVHLVTVRGLGYKLEG

SEQ ID NO: 10813 - DNA, 741 bp, Pseudomonas aeruginosa
  CDS (1)..(741)
atggagcatgtcgatcacatcctgatcgtcgacgatgaccgcgagattcgcgagctggtaggcaactacctgaagaagaacggcctgcgcaccaccatcgtcgccgatggccggcagatgcgcgcgttcctcgaagccaacacggtggacctgatcgtcctcgacatcatgatgcccggcgacgacggcctgctgctctgccgcgagctgcgcgtcggcaagcacaaggccacgccggtgctgatgctcaccgcgcgcaacgacgagaccgaccgcatcatcggcctggagatgggcgccgacgactacctgaccaagcccttctccgcccgcgaactgcttgcccggatcaacgccgtgctgcggcgtacgcggatgctgccgccgaacctcaccgtgagcgagagcagccggctgatcggcttcggccagtggcaactggacaccagcgcccgccacctgctcgacgacgccggcaccgtggtcgccctcagcggcgccgagtaccgcctgctgcgggtgttcctcgatcatccgcaacgggtactcagtcgcgaccagttgctcaacctgacccagggccgcgaggcggacatcttcgaccgttccatcgacctgctggtcagccgcctgcgccaacgcctcggcgacgacgcccgcgaaccggagtacatcaagaccgtgcgcagcgagggctatgtgttctcgctgccggtgcgactggtcgaggcccatccatga

SEQ ID NO: 10814 - protein, 246 aa, Pseudomonas aeruginosa
MEHVDHILIVDDDREIRELVGNYLKKNGLRTTIVADGRQMRAFLEANTVDLIVLDIMMPGDDGLLLCRELRVGKHKATPVLMLTARNDETDRIIGLEMGADDYLTKPFSARELLARINAVLRRTRMLPPNLTVSESSRLIGFGQWQLDTSARHLLDDAGTVVALSGAEYRLLRVFLDHPQRVLSRDQLLNLTQGREADIFDRSIDLLVSRLRQRLGDDAREPEYIKTVRSEGYVFSLPVRLVEAHP

SEQ ID NO: 10815 - DNA, 705 bp, Vibrio cholerae
  CDS (1)..(705)
atgagctatcacgtacttgtggttgaagatgacctcgtcacgcgaagtaagttaagtggttactttcaaaatgaaggttaccaagtgacggaagcagaaagtggcgcacagatgagagaagcgttagagctcaatgacatcgatctggttttgctggacattaatttgcccggtgaagacggtctgttattgacgcgagaattacgcagccagtcggagattggcattattttagtgacaggacgcaccgacagtatcgacaaaatcgttggcctcgaaatgggcgcggacgattatgtcacaaaacctgttgacctacgcgagcttcaggttcgtgtaaaaaacttattatggcgaatttccctcgcacagcgagagagaattaccgacaaacacgatgacaaactggtgcattttggtgagtggacgttcgatgttcagcgccgtgcattaagccgtaatggtgagccagtcaagctcactaaagcggaatacgagttgttggttgcgctttcttcttatcctaatcaagtgctgagccgtgagcggattttgaacatgatcagtcaccgtgtggatgcgccaaacgaccgtacgattgacgtattgatccgccgtatgcgcgccaaaatggaaatggatccgaaaaacccgcaaatctttgtgacggttcacggcgaagggtacatgttcgctggggattaa

SEQ ID NO: 10816 - protein, 234 aa, Vibrio cholerae
MSYHVLVVEDDLVTRSKLSGYFQNEGYQVTEAESGAQMREALELNDIDLVLLDINLPGEDGLLLTRELRSQSEIGIILVTGRTDSIDKIVGLEMGADDYVTKPVDLRELQVRVKNLLWRISLAQRERITDKHDDKLVHFGEWTFDVQRRALSRNGEPVKLTKAEYELLVALSSYPNQVLSRERILNMISHRVDAPNDRTIDVLIRRMRAKMEMDPKNPQIFVTVHGEGYMFAGD

SEQ ID NO: 10817 - DNA, 699 bp, Clostridium acetobutylicum; identical to SEQ ID NO: 8375
  CDS (1)..(699)

SEQ ID NO: 10818 - protein, 232 aa, Clostridium acetobutylicum; identical to SEQ ID NO: 8376

SEQ ID NO: 10819 - DNA, 717 bp, Vibrio cholerae
  CDS (1)..(717)
atgcaaaccccgcagatccttatcgtcgaagacgagcaagtaactcgtaacactcttaagagtatttttgaagcagagggatacgctgtttttgaggccagcaatggtgaagagatgcaccaagtgctgtccgattatccaattaacttggtgattatggacatcaacctgccaggaaaaaatggcctgctgcttgcacgcgaactgcgtgaacaagcagatgtagcgctgatgttcctgaccggtcgcgacaatgaagtagataagattctgggcctagagatcggcgcagatgattacatcaccaagcctttcaacccacgtgaactaaccattcgcgcacgtaacttgttgagccgctcaatgcatgcgggcaccacacaagaagaaaaacgtagcgttgaaaaatacgtgtttaatggttgggaactggatatcaacagccgttcactggtgagccctgatggtgatagctacaagctgccacgttctgagttccgtgctctgctgcacttctgtgaaaatccgggcaaaattcaaactcgtgccgatctcttgaaaaagatgactggacgtgaactcaaaccacacgatcgtactgttgatgtaacgatccgccgtatccgtaagcactttgaatctgtgtcaggtacgccagaaatcattgccaccattcacggtgaaggctaccgcttctgtggtgatttagaagattaa

SEQ ID NO: 10820 - protein, 238 aa, Vibrio cholerae
MQTPQILIVEDEQVTRNTLKSIFEAEGYAVFEASNGEEMHQVLSDYPINLVIMDINLPGKNGLLLARELREQADVALMFLTGRDNEVDKILGLEIGADDYITKPFNPRELTIRARNLLSRSMHAGTTQEEKRSVEKYVFNGWELDINSRSLVSPDGDSYKLPRSEFRALLHFCENPGKIQTRADLLKKMTGRELKPHDRTVDVTIRRIRKHFESVSGTPEIIATIHGEGYRFCGDLED

SEQ ID NO: 10821 - DNA, 735 bp, Pseudomonas aeruginosa
  CDS (1)..(735)
atggcgatggttccgcgcgtattggtggtcgacgacgacccggtgattcgtgagcttctccaggcctatctcggcgaggagggctatgacgtcctctgcgccggcaacgccgagcaggcggaagcctgccttgccgagtgcgcccatctcggccagccggtcgagctggtgctgctggacatccgcctgcccggcaaggacggcctgaccctgacccgcgagctgcgggtgcgctccgaggtggggatcatcctgatcaccgggcgcaacgacgagatcgatcgcatcgtcggcctggagtgcggcgccgacgattacgtgatcaagccgctgaacccgcgcgaactggtgtcgcgggcgaagaacctgatccgccgggtgcgccatgcccaggccagcgccggccccgcccggcaggccctcaggcagttcggcgactggctgctggacgccgaccggcgccgcctgatcgaccacgcgggcaacgaaaccctgctcacccatggcgaattccaattgctcggcgctttcctgcgcaacagcgggcataccctgagccgcgaccagttgatggaccagatccgcaaccgcgagtggctgcccagcgatcgctccatcgacgtgctggtcggccgcctgcgtcgcaagctgcgcgacgacccggccgaaccgcaactgatcatcaccatccacggcgccggctacctgttcaccgccgcggccagcgacgcctga

SEQ ID NO: 10822 - protein, 244 aa, Pseudomonas aeruginosa
MAMVPRVLVVDDDPVIRELLQAYLGEEGYDVLCAGNAEQAEACLAECAHLGQPVELVLLDIRLPGKDGLTLTRELRVRSEVGIILITGRNDEIDRIVGLECGADDYVIKPLNPRELVSRAKNLIRRVRHAQASAGPARQALRQFGDWLLDADRRRLIDHAGNETLLTHGEFQLLGAFLRNSGHTLSRDQLMDQIRNREWLPSDRSIDVLVGRLRRKLRDDPAEPQLIITIHGAGYLFTAAASDA

SEQ ID NO: 10823 - DNA, 711 bp, Haemophilus influenzae
  CDS (1)..(711)
atgactactccaaaaattctcgttgttgaagatgaaattgtcactcgaaatacgcttaaagggatttttgaagcggaaggatatgatgtgtttgaagcagaaaatggtgttgaaatgcatcatatattggcaaatcataatattaatttggttgtgatggatattaatttaccaggcaaaaacggcttattattggcaagagaactccgtgaagaattaagcttacctcttatttttttaactggtcgagataatgaagtggataaaattttaggtttggaaattggtgccgatgactatttgactaagccttttaaccctagagaactgactatccgcgcacgtaatctattgcatcgtgcaatgccgcatcaagaaaaagaaaatacatttggtcgagaattctatcgttttaatggttggaaattagacctaaatagccacagtttaattacaccagaaggacaagaattcaaacttcctcgcagtgaatttcgtgcaatgttacatttctgtgaaaatccaggaaaattgcaaacgcgcgaagaattgctgaaaaaaatgaccggacgagagttaaaacctcaggatcgtaccgtagatgtcacaattcgacgtatcagaaaacattttgaagatcatcccaatactccaaatatcattatgactatacatggagaaggctatcgtttttgtggagatattgaataa

SEQ ID NO: 10824 - protein, 236 aa, Haemophilus influenzae
MTTPKILVVEDEIVTRNTLKGIFEAEGYDVFEAENGVEMHHILANHNINLVVMDINLPGKNGLLLARELREELSLPLIFLTGRDNEVDKILGLEIGADDYLTKPFNPRELTIRARNLLHRAMPHQEKENTFGREFYRFNGWKLDLNSHSLITPEGQEFKLPRSEFRAMLHFCENPGKLQTREELLKKMTGRELKPQDRTVDVTIRRIRKHFEDHPNTPNIIMTIHGEGYRFCGDIE

SEQ ID NO: 10825 - DNA, 726 bp, Agrobacterium rhizogenes
  CDS (1)..(726)
atgaaacacgttcttgtcatcgatgacgatgtcgctatgcggcatcttatagtcgagtatcttaccatccatgcctttaaggtgacggcggtagccgacagcaagcagttcaatcgtgtactttcctccgagacggtcgatgtcgcggttgtcgatcttaatttgggtcgcgaagatgggcttgaaattgttcgcactctggcgacaaaatccgatgttccaatgataatcattagcggtgatcggcttgaggaggcggacaaagttgttgcactcgagctgggagcaaccgattttatcgccaaaccttttgggacccgcgaatttctggcgcggatccgtgttgcgttgcgcgagcggcccagcgtcgcgcgtacgaaagaccgacgctcattttatttcgcagactggacactgaatatcaggcaacgccgtttgatttcggaagagggcggagagattaaactcacggcaggtgagtttaatcttcttgtcgccttcctggagaagccgcgcgacgttctatcccgcgagcagcttctgatcgccagtcgggtgagagaggaggaggtgtatgacagaagtattgacgtcctcattttcaggctgcgccgaaagcttgagggggatccgacaagcccccagttgatcaagactgcaagaggtgctggctatttctttgacgcggacgtcaacgtttcctacgggggtatgatggcggcctga

SEQ ID NO: 10826 - protein, 241 aa, Agrobacterium rhizogenes
MKHVLVIDDDVAMRHLIVEYLTIHAFKVTAVADSKQFNRVLSSETVDVAVVDLNLGREDGLEIVRTLATKSDVPMIIISGDRLEEADKVVALELGATDFIAKPFGTREFLARIRVALRERPSVARTKDRRSFYFADWTLNIRQRRLISEEGGEIKLTAGEFNLLVAFLEKPRDVLSREQLLIASRVREEEVYDRSIDVLIFRLRRKLEGDPTSPQLIKTARGAGYFFDADVNVSYGGMMAA

SEQ ID NO: 10827 - DNA, 717 bp, Rhizobium sp
  CDS (1)..(717)
atgccgcacctgattatcgtcgacgatgatccgcggattcgctccatgctttcacgttatctcgaagacgagggctttcgcgtgaggctggcggagaatatttcgcagttgcgccgggtgctatctccgtctgttgacctggtgctgctcgacatcggacttcccgacggcaacggattggagctcgcacgcgagatcgacgcgaattttcgcgttccaaccataatcgtctccgggcgcgacgacgacgtcgatcgtatcatcggtctggagatgggggccgatgactatgtgtcgaagccattcaaccttcgcgaactgttggcgcgcgtaagaagcgtattgagacgatcgcagcgggcaatgccgctcggaccggcgcagaaggccacagccggtatctttcatttcgacggttggatgctcgacgccgaccggcgtcaactgacgtccaccgcagggcagacgatcgaactcactaccggcgaattcgacctgctcatggttttcgtcacgcatccgggccgcgtcctgacgcgcgactttcttctggatcagacacgcggccgcacgcgagaggcattcgaccgcgcgatcgacgtgcaggtcacgcgccttagggcaaaggtggaagacgatccgggagatccgcgacggataaagtccgtgcgcggagccggctacgtatttgcggcgaaggtcttccgcccaacgtga

SEQ ID NO: 10828 - protein, 238 aa, Rhizobium sp
MPHLIIVDDDPRIRSMLSRYLEDEGFRVRLAENISQLRRVLSPSVDLVLLDIGLPDGNGLELAREIDANFRVPTIIVSGRDDDVDRIIGLEMGADDYVSKPFNLRELLARVRSVLRRSQRAMPLGPAQKATAGIFHFDGWMLDADRRQLTSTAGQTIELTTGEFDLLMVFVTHPGRVLTRDFLLDQTRGRTREAFDRAIDVQVTRLRAKVEDDPGDPRRIKSVRGAGYVFAAKVFRPT

SEQ ID NO: 10829 - DNA, 774 bp, Synechococcus sp; identical to SEQ ID NO: 8383
  CDS (1)..(774)

SEQ ID NO: 10830 - protein, 257 aa, Synechococcus sp; identical to SEQ ID NO: 8384

SEQ ID NO: 10831 - DNA, 708 bp, Bacillus subtilis; identical to SEQ ID NO: 8385
  CDS (1)..(708)

SEQ ID NO: 10832 - protein, 235 aa, Bacillus subtilis; identical to SEQ ID NO: 8386

SEQ ID NO: 10833 - DNA, 720 bp, Xenorhabdus nematophilus
  CDS (1)..(720)
atgcaagagaattataagatccttgtcgttgatgatgatatgcgcctgagggcgttattggaacgttatttatctgagcagggatttcaagttcgtagtgcggcaaatgcagaacagatggatcgtttgttaaccagagaatccattcaattgattattttggatttaatgttaccgggcgaagatgactgtctgtctgccgaagaattgagaagtcaaaataatgcgataccgatcatcatgatatccgcgaaaggggaagaggttgaccggattgttggtcttgaaattggcgctgatgattatctttccaagccattcaatccgcgtgaattgctggcacggatgcgtctggtcctgcgccgtcagactcatgagctgccgggagcgccgacatcggatgatacggtggtcaagtttggaaaattcgaaactgatctcggaacacgtgaaatgtttcatcacgatgaacaattgtcgttaaccagtggtgaattttctgtcctgaaggttttggtttcctatccacgtgagccgctgtcacgggataaattgatgagcctggcccggggacgggagtatggcgcgatggagcgttccattgatgtacaagtttcccgtctgcgccgcctgattgaggaagatcccgctcaaccccgctatattcagaccgtctggggattgggatacgtttttatccctgatggaaataaagtatga

SEQ ID NO: 10834 - protein, 239 aa, Xenorhabdus nematophilus
MQENYKILVVDDDMRLRALLERYLSEQGFQVRSAANAEQMDRLLTRESIQLIILDLMLPGEDDCLSAEELRSQNNAIPIIMISAKGEEVDRIVGLEIGADDYLSKPFNPRELLARMRLVLRRQTHELPGAPTSDDTVVKFGKFETDLGTREMFHHDEQLSLTSGEFSVLKVLVSYPREPLSRDKLMSLARGREYGAMERSIDVQVSRLRRLIEEDPAQPRYIQTVWGLGYVFIPDGNKV

SEQ ID NO: 10835 - DNA, 738 bp, Synechocystis sp; identical to SEQ ID NO: 8387
  CDS (1)..(738)

SEQ ID NO: 10836 - protein, 245 aa, Synechocystis sp; identical to SEQ ID NO: 8388

SEQ ID NO: 10837 - DNA, 789 bp, Synechocystis sp; identical to SEQ ID NO: 8393
  CDS (1)..(789)

SEQ ID NO: 10838 - protein, 262 aa, Synechocystis sp; identical to SEQ ID NO: 8394

SEQ ID NO: 10839 - DNA, 720 bp, cyanelle Cyanophora paradoxa
  CDS (1)..(720)
atggaaattaacaaaaaaaaaattttagtagttgatgatgaaataagtattcgaagaattttagaaacccgtctttctatgatcgggtatgaagttgttaccgctgctgatggtgaagaagcattaacaatatttcaactagaacatcctaatttagttgttcttgatgttatgatgccaaagttagatggatatggagtttgtcaagaattaagaaaagaatcagatattccaataattatgctaactgcattaggagatgttgctgatagaataaccgggctagaattaggtgctgacgattatgttgttaaacctttttcaccgaaagagctcgaagctcgaattcgttctttattaagacgaacagaaaatccaactctttcaacaaccagcacaaatggagaaaatttacaaattggatttttaaaaattgatattaataaaagacaagtttttaaaaatggagaacgtattcgattaacgggaatggaatttagccttttagaattacttattagtaaaatgggtgaacctttttcacgtgctcaaattttacaagaagtctggggctatacaccagaacgtcatatagacactcgtgttgttgatgtccatatttctcgtttaagatcaaaattagaagaaaatccaagtaaccctgatttaattttaacagctcggggaattggttatttattccaaaatacttccaattga

SEQ ID NO: 10840 - protein, 239 aa, cyanelle Cyanophora paradoxa
MEINKKKILVVDDEISIRRILETRLSMIGYEVVTAADGEEALTIFQLEHPNLVVLDVMMPKLDGYGVCQELRKESDIPIIMLTALGDVADRITGLELGADDYVVKPFSPKELEARIRSLLRRTENPTLSTTSTNGENLQIGFLKIDINKRQVFKNGERIRLTGMEFSLLELLISKMGEPFSRAQILQEVWGYTPERHIDTRVVDVHISRLRSKLEENPSNPDLILTARGIGYLFQNTSN

SEQ ID NO: 10841 - DNA, 717 bp, Bacillus licheniformis; identical to SEQ ID NO: 8395
  CDS (1)..(717)

SEQ ID NO: 10842 - protein, 238 aa, Bacillus licheniformis; identical to SEQ ID NO: 8396

SEQ ID NO: 10843 - DNA, 1116 bp, synthetic construct
  CDS (1)..(1116)
atgaaacacgttcttcttatcgatgacgatgtcgctatgcggcatcttattatcgaataccttacgatccacgccttcaaagtgaccgctgtagctgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgaactaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcatcttgagactgagaagaaaacttgaggctgatccgtcaagccctcaactgataaaaacagcaagaggtgccggttatttctttgacgctgacgtgcaggtttcgcacggtggtacgatggcagccgaattcagcagaggcagaaccagaaacaactacggctctaccatcgagggcttgctcgacctcccagacgacgacgacgctccagccgaagcaggtctcgttgctccaagaatgtctttcctctccgctggacagagaccaagaagactttctaccaccgctccaatcaccgacgtttctttggttgacgaattgagattggacggcgaggaggttgacatgaccccagccgacgccttggacgacttcgacttggagatgttgggtgacgttgagtccccatccccaggcatgacccacgacccagtttcctacggcgctttggacgttgacgacttcgagtttgagcagatgttcaccgacgccttgggcatcgacgacttcggtggctag

SEQ ID NO: 10844 - protein, 371 aa, synthetic construct
MKHVLLIDDDVAMRHLIIEYLTIHAFKVTAVADSTQFTRVLSSATVDVVVVDLNLGREDGLEIVRNLAAKSDIPIIIISGDRLEETDKVVALELGASDFIAKPFSTREFLARIRVALRVRPNVVRSKDRRSFCFTDWTLNLRQRRLMSEAGGEVKLTAGEFNLLLAFLEKPRDVLSREQLLIASRVRDEEVYDRSIDVLILRLRRKLEADPSSPQLIKTARGAGYFFDADVQVSHGGTMAAEFSRGRTRNNYGSTIEGLLDLPDDDDAPAEAGLVAPRMSFLSAGQRPRRLSTTAPITDVSLVDELRLDGEEVDMTPADALDDFDLEMLGDVESPSPGMTHDPVSYGALDVDDFEFEQMFTDALGIDDFGG

SEQ ID NO: 10845 - DNA, 699 bp, Rhodobacter sphaeroides
  CDS (1)..(699)
atgaagaaaaactaccacatgcttgtcgtcgaagacgatccggtcagccgccagacgctcgcgatgtatctgcgcaaggaaaatcacgaagtcagcgaagcgcgcgacggcgaacaaatgcgccgcgtcttccccaagggcgacgtggatgtggtgatgctcgacatcaacatgccgggcaaggacgggctgtcaattctgcgggaactgccccggcagtccgaggtcggcatcatcatggtgacgagccggaaggaggatgtggaccggatcgtggcgctggagttcggcgcggacgattatgtgaccaagccatacaacatgcgcgagatcctgccgcgggcaaagaatttcgcccggcgggtggcggccctgcggctggtgcggccggaccagccggcgacgaccttcgacggctggaccctcgacgcggcccattgggcgctgaccgatcccgcgggcaatcatgtcaaactgacacgggccgagttcgagctgctggccaccttcgtggcccatcccgggcaggtcctgacccgcgaccagctgatgaaccatgtcggccgccgcgggcacgagaccttcgaccggaccatcgacgtgctagtgcgccgcatccgccgcaagatcgaggcggacccttccgacccgcggctgatcgtgaccgttcacggcatcggctacgtcttccaggcctga

SEQ ID NO: 10846 - protein, 232 aa, Rhodobacter sphaeroides
MKKNYHMLVVEDDPVSRQTLAMYLRKENHEVSEARDGEQMRRVFPKGDVDVVMLDINMPGKDGLSILRELPRQSEVGIIMVTSRKEDVDRIVALEFGADDYVTKPYNMREILPRAKNFARRVAALRLVRPDQPATTFDGWTLDAAHWALTDPAGNHVKLTRAEFELLATFVAHPGQVLTRDQLMNHVGRRGHETFDRTIDVLVRRIRRKIEADPSDPRLIVTVHGIGYVFQA

SEQ ID NO: 10847 - DNA, 1288 bp, Rhodobacter sphaeroides
  CDS (60)..(758)
gaattcgaggcgcgataaggcgcaataggcccggtcggccgtcggagaccctgcgcgtcatgaagaaaaactaccacatgctcgtcgtcgaggacgacccggtcagccgccagacgctcgcgatgtatctgcgcaaggagaaccacgaggtcagcgaggcgcgcgacggcgagcagatgcgccgcgtcttcgcccggggcgatgttgacgtggtgatgctcgacatcaacatgcccggcgaggacgggctgtcgatcctgcgggaactgcgccggcagtccgaggtcggcatcatcatggtgacgagccggaaggaggatgtggaccggatcgtggccctggagctcggcgcggacgactatgtgaccaagccctacaacatgcgcgagatcctgccgcgggcgaagaatctcgcccggcgcgtggcggccctgcggctcgtgcggccggaccagccggccacgaccttcgtcggctggaccctcgatccggcccattggacgctgaccgatcccgcgggccatcctgtcaaactgacacgggccgagttcgagctgctggccaccttcgcggcccatcccgggcaggttctgacccgcgaccagctgatgaaccatgtgggccgccgcgggcacgacacgctcgaccggaccatcgacgttctcgtgcgccgcctccgccgcaagatcgaggcggacccttccgacccgcggctgatcgtgaccgtccacggcatcggctacgtcttccaggcctgacgccggacggggcggcctcagccctcggccactccggcactggcttcggcccaggcgagatcggccagcgcaggggccgcgcggcagtcggcgaccagcgcgagcaccagggcggcctcgcagccctcggccgcggccgcggtctcgacctgctctgccctgtcggagaggcccgtgaagcccagatgccgcgccgaccccttcagccggtgcgccagagacgccacgctccgcatgtcggcctcctccatcgcccgttcgagcgcacgggcggtctcgaggacgctctgccggaaggtccggacgatccgcgcggcggaggtgcatccgagcgcctcggcatgcccccgcagcacgccgaggtctaccgacggcaaggcacgcggggccggacccgcgggcgcggccttcccgagcggggtcggcgaggaactcccgaccagacggcagaggatctcttcgaggcgggcgaaatggaaaggttttccaaggaaggcgtcgatccccgcctcggtcagcgccgccggatc

SEQ ID NO: 10848 - protein, 232 aa, Rhodobacter sphaeroides
MKKNYHMLVVEDDPVSRQTLAMYLRKENHEVSEARDGEQMRRVFARGDVDVVMLDINMPGEDGLSILRELRRQSEVGIIMVTSRKEDVDRIVALELGADDYVTKPYNMREILPRAKNLARRVAALRLVRPDQPATTFVGWTLDPAHWTLTDPAGHPVKLTRAEFELLATFAAHPGQVLTRDQLMNHVGRRGHDTLDRTIDVLVRRLRRKIEADPSDPRLIVTVHGIGYVFQA

SEQ ID NO: 10849 - DNA, 735 bp, Bordetella bronchiseptica
  CDS (1)..(735)
atgaacacgcaaaacaccactcctacccgcaagatcctggtcgtcgacgatgatccccgactgcgcgatctcctgcgccgctatctgtcggaacaagggttcaatgtattcgtggccgaagatgccaaggaaatgggcaaactgtggcaacgcgaacactttgacctgctggttctcgacctgatgctgccgggcgaggatggcctgtcgatctgccgccgcctgcgcggcggccacgacaatactcccatcatcatgctgaccgccaaggccgaggaaatcgaccggatcgtcggcctggaaatgggagccgacgattacctgtccaagcccttcaacccgcgcgaactgctggcccgcatcaatgcgatcctgcgccgccgcggcaccgaagagcacccgggcgcgcccagccaggaaaacgagtcgatcgccttcggcccgtacgtcctgaacctgtccacgcgcaccctcacccgcaatggcgagcaggtgccgatcacgaccggcgaattctcggtcctgaaggtttttgcccgccatcccaagatcccgctgtcgcgcgacaagctgatggaactggcccgcggacgcgaatacgaggcgttcgaccgcagcctggatgtgcagatttcgcgtctgcgcaaattgatcgaacccaacccgtccaaacccgttttcatccaaaccgtctggggcctgggatacgttttcgttccggatggcggcagttga

SEQ ID NO: 10850 - protein, 244 aa, Bordetella bronchiseptica
MNTQNTTPTRKILVVDDDPRLRDLLRRYLSEQGFNVFVAEDAKEMGKLWQREHFDLLVLDLMLPGEDGLSICRRLRGGHDNTPIIMLTAKAEEIDRIVGLEMGADDYLSKPFNPRELLARINAILRRRGTEEHPGAPSQENESIAFGPYVLNLSTRTLTRNGEQVPITTGEFSVLKVFARHPKIPLSRDKLMELARGREYEAFDRSLDVQISRLRKLIEPNPSKPVFIQTVWGLGYVFVPDGGS

SEQ ID NO: 10851 - DNA, 726 bp, Agrobacterium tumefaciens
  CDS (1)..(726)
atgaaacacgttcttatcatcgatgacgatgccgcgatgcgtcatcttattacggagtatttgacgattcatgccttaagggtcaccgcggtatcggatagccagcaattcaaccgtgtacttgcatctgagacggtcgatgtcgtcgttgtggatctcaatttagggcgtgaagacgggcttgagatcgttcgcagtttggccacaaaatccgatgttccaattataatcatcagcggtgatcgcctcgaggaggcggataaagtggtcgcgcttgagctgggggcaacggattttatcgcgaaacctttcggaacacgcgagttcctagcacgcatccgtgttgcactacgcgtgcgaccgaatgtcatacgaaccaaagataggcgttcattttgtttcgccggctggacgcttagtctcaggcagcggcgattgatatcggcacaaaatggcgaggtgaaacttacagcaggggagttcaatctgctcgtcgctttcctggaaaagccacgcgacgtgctttcccgcgagcagctcctcatcgcgagccgagtgcgcgaggaggaagtttatgacagaagcattgatgttctcattttgacagtccgccgaaagcttgaggaggatgcagcgagcccacacttgatcaaaactgccagaggtgccggctatttcctcgacgctgacgtggatgtttcctatggaggaatgatggcagcctga

SEQ ID NO: 10852 - protein, 241 aa, Agrobacterium tumefaciens
MKHVLIIDDDAAMRHLITEYLTIHALRVTAVSDSQQFNRVLASETVDVVVVDLNLGREDGLEIVRSLATKSDVPIIIISGDRLEEADKVVALELGATDFIAKPFGTREFLARIRVALRVRPNVIRTKDRRSFCFAGWTLSLRQRRLISAQNGEVKLTAGEFNLLVAFLEKPRDVLSREQLLIASRVREEEVYDRSIDVLILTVRRKLEEDAASPHLIKTARGAGYFLDADVDVSYGGMMAA

SEQ ID NO: 10853 - DNA, 804 bp, Agrobacterium tumefaciens
  CDS (1)..(804)
atgattgtacatccttcacgtgaaaatttctcaagcgctgtgaacaagggttcagattttagattgaaaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctga

SEQ ID NO: 10854 - protein, 267 aa, Agrobacterium tumefaciens
MIVHPSRENFSSAVNKGSDFRLKGEPLKHVLLIDDDVAMRHLIIEYLTIHAFKVTAVADSTQFTRVLSSATVDVVVVDLNLGREDGLEIVRNLAAKSDIPIIIISGDRLEETDKVVALELGASDFIAKPFSTREFLARIRVALRVRPNVVRSKDRRSFCFTDWTLNLRQRRLMSEAGGEVKLTAGEFNLLLAFLEKPRDVLSREQLLIASRVRDEEVYDRSIDVLILRLRRKLEADPSSPQLIKTARGAGYFFDADVQVSHGGTMAA

SEQ ID NO: 10855 - DNA, 705 bp, Synechococcus sp; identical to SEQ ID NO: 8407
  CDS (1)..(705)

SEQ ID NO: 10856 - protein, 234 aa, Synechococcus sp; identical to SEQ ID NO: 8408

SEQ ID NO: 10857 - DNA, 732 bp, Vibrio vulnificus
  CDS (1)..(732)
atggacggacacatgcaagagaattttaaaattttagtggttgatgatgatgctcgcttgcgtgcgttgttggagcgttatctgtcagaacaaggtttccaagtgcgcagtgtcgccaatggggaacagatggatcgcctattgacccgtgaaaacttccacttaatggtactggatttaatgcttcctggtgaagatggtctttcgatctgtcgtcgtctgcgtaatgccaacaacatgttgcctatcctgatgctgacagcaaaaggggatgaggttgaccgcatcgtgggtttagaagtgggtgcggacgattacctgccaaaaccgttcaacccacgtgagttacttgcgcgtattaaagcggtgttgcgtcgtcaaaccatcgagctgccaggtgcgccaagtgcggaagagaaaattgtcgagtttggtgagtttcgtctgaacttgggcacgcgtgaaatgttccgtggtgatgagccgatgccactcacctcgggtgaatttgcggtactgaaatcgctagtgaccaatgcgcgtgaaccgatgtcgcgcgacaagttgatgaacatggcgcgcggacgtgaatactccgcgatggaacgttccattgacgtacaaatttctcgcctacgtcgtatgttggaagaggacccaagcaaacctcgctacatccaaactgtatggggcctaggttatgtgtttgttcctgatggcaaaccagcttaa

SEQ ID NO: 10858 - protein, 243 aa, Vibrio vulnificus
MDGHMQENFKILVVDDDARLRALLERYLSEQGFQVRSVANGEQMDRLLTRENFHLMVLDLMLPGEDGLSICRRLRNANNMLPILMLTAKGDEVDRIVGLEVGADDYLPKPFNPRELLARIKAVLRRQTIELPGAPSAEEKIVEFGEFRLNLGTREMFRGDEPMPLTSGEFAVLKSLVTNAREPMSRDKLMNMARGREYSAMERSIDVQISRLRRMLEEDPSKPRYIQTVWGLGYVFVPDGKPA

SEQ ID NO: 10859 - DNA, 717 bp, Photorhabdus luminescens
  CDS (1)..(717)
atgcaaaccccgcacattttgattgttgaagacgaaattgtcactcgcaataccctaaaaagcattttcgaagctgaagggtacatagtttatgaagccactgatggttcagaaatgcaccatattctgtcaaacaacgacattaacctggtgattatggatattaaccttccaggcaaaaatggcttgttacttgcccgcgaactgcgagagcaagcaaatgttgctttgatgttcctgactggccgtgataacgaagtagacaaaatccttggcttggaaatcggtgcagatgattacatcaccaaaccatttaatccgcgtgaattgactattcgcgcccgcaacctgctttctcgtaccatgaatctgagtaatgtcagcgaggaacgtcgccaagttgagagttataaattcaacggttgggaattagatatcaatagccgttctctgataagcccggctggtgagccgtataaattgccacgcagcgagttccgcgccatgcttcatttctgtgaaaatccaggcaaaatccaaacacgcgcagatttactgaaaaagatgacaggtcgtgaattgaaacctcacgaccgtactgttgatgtaacgattcgtcgtatccgtaaacattttgaatcgacgccagatacgatggaaattatcgccaccattcacggtgaaggctatcgtttctgtggtgatttggaagcataa

SEQ ID NO: 10860 - protein, 238 aa, Photorhabdus luminescens
MQTPHILIVEDEIVTRNTLKSIFEAEGYIVYEATDGSEMHHILSNNDINLVIMDINLPGKNGLLLARELREQANVALMFLTGRDNEVDKILGLEIGADDYITKPFNPRELTIRARNLLSRTMNLSNVSEERRQVESYKFNGWELDINSRSLISPAGEPYKLPRSEFRAMLHFCENPGKIQTRADLLKKMTGRELKPHDRTVDVTIRRIRKHFESTPDTMEIIATIHGEGYRFCGDLEA

SEQ ID NO: 10861 - DNA, 720 bp, Photorhabdus luminescens
  CDS (1)..(720)
atgcaagtagataacaagatccttgtggtggatgatgacatgcgtttacgaacgttattagagcgttatctgacagaacaaggttttcaggtacgtagtgctgctaatgcggagcagatggaccgcttactgacacgggaatctgttagcttaatcgtattggatttaatgttaccaggagaggatgggctttctgtttgccaaaggctgagaaaccaaagtaatccggtaccgattattatggtgaccgcgaggggagaagaggtagatcgtattgttgggctggaaattggtgctgatgattatattccgaagccatttaatccccgtgagctattagcgcgtatccgggcggtattacgtcgtcaggcgaataagttattgggcctaccggctgaggatgatgcgattattaattttggtaagtttagcctcaatttgagtacgcgggaaatgtttcagggagatgaacatattcaattaaccagtggagaatttgctgtattgaaagtactggtttcttatcctggcgtgccactgtcccgtaataagttgatgaatttagcgcgtggccgggaatatagcacgatgaagcgatcgattgatgtcttggtttcacgtctgcgccgtgtgattgaagaagatcctacacatcctcgctatatccagactatctggggtctgggctatgtctttgtgccagacggaattcgtgtatga

SEQ ID NO: 10862 - protein, 239 aa, Photorhabdus luminescens
MQVDNKILVVDDDMRLRTLLERYLTEQGFQVRSAANAEQMDRLLTRESVSLIVLDLMLPGEDGLSVCQRLRNQSNPVPIIMVTARGEEVDRIVGLEIGADDYIPKPFNPRELLARIRAVLRRQANKLLGLPAEDDAIINFGKFSLNLSTREMFQGDEHIQLTSGEFAVLKVLVSYPGVPLSRNKLMNLARGREYSTMKRSIDVLVSRLRRVIEEDPTHPRYIQTIWGLGYVFVPDGIRV

SEQ ID NO: 10863 - DNA, 705 bp, Gloeobacter violaceus; identical to SEQ ID NO: 8415
  CDS (1)..(705)

SEQ ID NO: 10864 - protein, 234 aa, Gloeobacter violaceus; identical to SEQ ID NO: 8416

SEQ ID NO: 10865 - DNA, 714 bp, Chromobacterium violaceum
  CDS (1)..(714)
atgtctcaagcttcccgcgtacttattgtcgatgacgatccggatctgcgcgatctgcttagcgattatctgagccgccaggacatggttgtctccgcggtgggcgatggcgaggcgatgaaccgcgccctggccgagcaatcgttcgacatcctgatcctggacctgatgctgccgggcgcggacggcctgacgctgtgccgcgacctgcgctcccgctccaatatgcccatcctgatgctgacggcgcgcggcgacgagctggaccgcatcatcggcctggaaatgggcgccgacgactacctgcccaagccgttcaatccgcgcgagctgctggcccgcgtgcgcagcatcctgcgccgggtggaggagcgccgcaacaacagcgcgctgcgcgccttgcagttcggcgactggcggctggagctgggcgcccagcacctggtcgacggcggcggcgtggtgacgcccttgtccggcggcgagttcaagctgatgcaggcgctggccgaaaatccgcagcgcgtgatgtcgcgcgatcaattgatggaggcgatgaacggcaaggaagccggtccgttcgatcgcaccgtcgacgtgatgataggccgcctgcgccgccgcctgggagacgacgcgcgcgagccgctgctgatcaagaccatacgcagcggcggctacatgctggcttgcgaggtggtgccggtgcgatga

SEQ ID NO: 10866 - protein, 237 aa, Chromobacterium violaceum
MSQASRVLIVDDDPDLRDLLSDYLSRQDMVVSAVGDGEAMNRALAEQSFDILILDLMLPGADGLTLCRDLRSRSNMPILMLTARGDELDRIIGLEMGADDYLPKPFNPRELLARVRSILRRVEERRNNSALRALQFGDWRLELGAQHLVDGGGVVTPLSGGEFKLMQALAENPQRVMSRDQLMEAMNGKEAGPFDRTVDVMIGRLRRRLGDDAREPLLIKTIRSGGYMLACEVVPVR

SEQ ID NO: 10867 - DNA, 708 bp, Synechococcus sp; identical to SEQ ID NO: 8427
  CDS (1)..(708)

SEQ ID NO: 10868 - protein, 235 aa, Synechococcus sp; identical to SEQ ID NO: 8428

SEQ ID NO: 10869 - DNA, 720 bp, Rhodopirellula baltica
  CDS (1)..(720)
atgccccggatcttgatcgctgaagatgaccggcacactcgtgctgccctggaggaattactgggcgcagagggctacgacgtggcaacagtcggtgatggcctgtccgcatcaaagatgatcgaatccaagaagttcgatttggtgtgcctcgacgtgatgatgcctatgaaaagcggttttgacgtttgtcgacttctgcgtgccgaagaccatcgaacgccggtcattttcatcaccgccaagggtgacgagatcgacaaagtcgtggggctggaactgggtgcggacgactacatcagcaaaccgtttggatcccacgaagtcattgcccgagtcaaagccgtcctgcggcgctgccagccagcccccagccaaacaccaatcgcgaaagacccgaccacgcacatcacgttcaacatggacgatttgcagatcacgccatcaaaactgcgagccactcgtggcgaaacgacaatcgaactcaccgctcgtgaactacagatcctgatactgttgcatgatgccgacggggacgtggtgcatcgccaaacgctcttccaagaatgctgggggcataaccgagtccccaacagccgaaccgtcgaccaaaccgtcagccaactccgcaaacgcatcgagcgagatcccaaacaccctcgcatcatccaaaccgtctatggcctcggctaccgctacgagtgcaaacctcacccatga

SEQ ID NO: 10870 - protein, 239 aa, Rhodopirellula baltica
MPRILIAEDDRHTRAALEELLGAEGYDVATVGDGLSASKMIESKKFDLVCLDVMMPMKSGFDVCRLLRAEDHRTPVIFITAKGDEIDKVVGLELGADDYISKPFGSHEVIARVKAVLRRCQPAPSQTPIAKDPTTHITFNMDDLQITPSKLRATRGETTIELTARELQILILLHDADGDVVHRQTLFQECWGHNRVPNSRTVDQTVSQLRKRIERDPKHPRIIQTVYGLGYRYECKPHP

SEQ ID NO: 10871 - DNA, 729 bp, Prochlorococcus marinus subsp; identical to SEQ ID NO: 8429
  CDS (1)..(729)

SEQ ID NO: 10872 - protein, 242 aa, Prochlorococcus marinus subsp; identical to SEQ ID NO: 8430

SEQ ID NO: 10873 - DNA, 738 bp, Prochlorococcus marinus
  CDS (1)..(738)
atgactgttgcacctccaaaggtcatacctcctcagtcattgaaggttttccgattgcttgttgttgaagacgatgacgcgattcgagaaactattggcgaggctttgtgtgctgagggttttgaaactatattgtgtggagatggattcgaagctgtttcgatccttacaagtcaaccgagacataaatttgatctaattattttagatgtgatgctccctggcattggtggtctagatatttgtcgaagattgagagaatttgatcctaaaacacgcatattcatgatcagtgctcgagataatgaaatcgatcgtgttttggggcttgaggttggagctgatgattacctagttaaaccatttagcgttagagaacttgttgcacgttgtcgagcacaattacgtcgttatcaggaacgatctgacgattcaaatgcaaaaatgattgaatatgggaatttatgtttatacattgaagaatgtagagtcaccaaggatggaaaagatctaagccttgctccaaaggagtataaaatattaaagttattactagaacacccaagacaggtcctgagccgagatcagattcttgagcgaatatggggtgatgattattttggcgataccaaaactgtagacgtacacattcggtggataagagaaaagattgagcaggacccttcatcccctcagtgcatccatactgtgagaggatttggttatcgctttgggtaa

SEQ ID NO: 10874 - protein, 245 aa, Prochlorococcus marinus
MTVAPPKVIPPQSLKVFRLLVVEDDDAIRETIGEALCAEGFETILCGDGFEAVSILTSQPRHKFDLIILDVMLPGIGGLDICRRLREFDPKTRIFMISARDNEIDRVLGLEVGADDYLVKPFSVRELVARCRAQLRRYQERSDDSNAKMIEYGNLCLYIEECRVTKDGKDLSLAPKEYKILKLLLEHPRQVLSRDQILERIWGDDYFGDTKTVDVHIRWIREKIEQDPSSPQCIHTVRGFGYRFG

SEQ ID NO: 10875 - DNA, 714 bp, Haemophilus ducreyi
  CDS (1)..(714)
atgcaaaatccacaaatcttgattgttgaagatgaacttgttacccgtaatacattaaaaagtatttttgaagctgaagggtatgaagtatttgaagcatctgatggcacagaaatgaacactattctggcgcagcaaacaataaatctcgtgattatggacatcaatttacccggtaaaaacggtttaatgctagcacgtgagttgcgtgaaaatactaaaatggccttaatgtttttaacgggacgtgacaatgaagttgataaaattttaggtttagaggttggggcggacgactacattactaaaccatttaatccaagagaattgacgattcgtgcacgtaatctcttacatagaacgatgcttgaaaaagataaagtgagccatagcgaacagcaagaaagttatcgttttaacggttggacgcttgatgttaatagccgaagtttaattacaccggaaggtgaaataaataaattaccacgcagtgaatttcgagcattgttacacttctgtgaaaacccgggcaaaattcagacccgtgaagacttactattgaaaatgaccggtcgagaattgaaacctcatgatcgcacagtagatgtgacgattcgccgtattcgtaaacattttgaagatcatctcaatacccccgaaatcattgttactattcatggtgaaggctaccgtttttgtggtcagatagagtaa

SEQ ID NO: 10876 - protein, 237 aa, Haemophilus ducreyi
MQNPQILIVEDELVTRNTLKSIFEAEGYEVFEASDGTEMNTILAQQTINLVIMDINLPGKNGLMLARELRENTKMALMFLTGRDNEVDKILGLEVGADDYITKPFNPRELTIRARNLLHRTMLEKDKVSHSEQQESYRFNGWTLDVNSRSLITPEGEINKLPRSEFRALLHFCENPGKIQTREDLLLKMTGRELKPHDRTVDVTIRRIRKHFEDHLNTPEIIVTIHGEGYRFCGQIE

SEQ ID NO: 10877 - DNA, 708 bp, Bacillus cereus
  CDS (1)..(708)
atgatgggaaagaaaattttagtagttgatgatgaaaagccgattgcagatattttgaagtttaacctagaaaaagaaggttttgaaatagtaatggcgcatgatggtgatgaagcaattgaaaaggctaatgaagagcaaccagatatggttttattagatattatgctaccaggtaaagatggcttagaggtttgccgtgaaatacgtaaaagctcagaaatgccgattattatgcttacagcaaaggactctgagattgataaagtattagggctcgagcttggggcagatgattatgtaacgaagccatttagtacgagggaattacttgctcgtgtgaaggcgaatttacgccgccatcaacaaggtggtgctgcggaaaaagaagaaaatacagaaatggttattggaccaattgtgattaatccaaatgcatatagtgtaacgaagcgcgaggaaaatatcgagcttacacatcgtgaatttgagttgctacattatttagcgaaacatttaggacaagttatgacacgcgaacatttattacaaacagtttggggttatgactattttggagatgtgcgcacagtagacgttacagtacgtcgtttgcgtgaaaaaattgaagataatccaagccatcctactttaattgtaactagacgtggagtagggtattacttgcgtgacccagagcaggaatag

SEQ ID NO: 10878 - protein, 235 aa, Bacillus cereus
MMGKKILVVDDEKPIADILKFNLEKEGFEIVMAHDGDEAIEKANEEQPDMVLLDIMLPGKDGLEVCREIRKSSEMPIIMLTAKDSEIDKVLGLELGADDYVTKPFSTRELLARVKANLRRHQQGGAAEKEENTEMVIGPIVINPNAYSVTKREENIELTHREFELLHYLAKHLGQVMTREHLLQTVWGYDYFGDVRTVDVTVRRLREKIEDNPSHPTLIVTRRGVGYYLRDPEQE

SEQ ID NO: 10879 - DNA, 690 bp, Bacillus cereus; identical to SEQ ID NO: 8443
  CDS (1)..(690)

SEQ ID NO: 10880 - protein, 229 aa, Bacillus cereus; identical to SEQ ID NO: 8444

SEQ ID NO: 10881 - DNA, 705 bp, Bacillus cereus
  CDS (1)..(705)
atgtaccaagcaaatattttactcgttgatgatgaaacagcaattttacaattactaactaccattcttgaaaaagaaggcttttctcatattacaactgcaacatcagctgaaatggctttatctctaactaagcaaaacaattacgatttaattattttagatgtaatgcttcctggacaatctggttttgatatttgtccaatcattcgccaacaaacagattgtccaattttcttcctatcagcaaaagcatctgatttagataaaatatccggattttcatacggtgcagatgattatattacgaaaccatttaatccattagaagtagtagcacgcatgaaagcacagcttcggagacatatgaaacaaaccgtaccacacgaacaaaaatcacactcgatttcatttggaagatttgaaattgatcagcactctgcagaactaacagtagatgggcacattgtcgaatgctccgctcaactctttcaactactactcttcttttgcgagaatccgaactacgtattttcgaaagaggaaatatacgaaaaagtttggggagcacctgcctataatggcgatgacaacactgttatggtccacattcgaaaactacgtgaaaaaattgaacatgatccaagtaaaccagaatatataaaaaccgttcgcgggcttggttataagttcgttacaaagtag

SEQ ID NO: 10882 - protein, 234 aa, Bacillus cereus
MYQANILLVDDETAILQLLTTILEKEGFSHITTATSAEMALSLTKQNNYDLIILDVMLPGQSGFDICPIIRQQTDCPIFFLSAKASDLDKISGFSYGADDYITKPFNPLEVVARMKAQLRRHMKQTVPHEQKSHSISFGRFEIDQHSAELTVDGHIVECSAQLFQLLLFFCENPNYVFSKEEIYEKVWGAPAYNGDDNTVMVHIRKLREKIEHDPSKPEYIKTVRGLGYKFVTK

SEQ ID NO: 10883 - DNA, 702 bp, Bacillus cereus
  CDS (1)..(702)
atggcacacgaaacaatacttgtcgtagatgatgaaaaagaaattcggaatttaattacaatctatttaaagaatgaaggatataaagtattacaagcagaagacggagaagaagggttacgtctattggaagaaaatgaagtacatctagtcgtattagatattatgatgccgaaagtggatggtattcatatgtgtatgaaggtaagggaagcgaaagaaatgcctattattatgctttctgccaaaacgcaagatatggataagattttaggattaacaacaggggcagatgattatgtaacgaagccgtttaatccgttagagctaattgcacgaattaaatctcagttacgccgttatatgaaaatgaatggtttcgctattcaaaatgaggacgagttagaaattggggagatgaaaatcaacatctcgacccataaagttattgtagagggagaagaagtgaaactaactccgagggaattttcaattttagaattgctagctagaaatccaggtatggtgtttagtgcggagcaaatttatgaaaaggtgtggaacgaacgatctttccagtctgataatactgtaatggtgcatattcgaaaagtgcgtgaaaagattgaggagaatccaaggaaacctagatatataaaaacagtatggggagtggggtataagattgaaaaagatatttaa

SEQ ID NO: 10884 - protein, 233 aa, Bacillus cereus
MAHETILVVDDEKEIRNLITIYLKNEGYKVLQAEDGEEGLRLLEENEVHLVVLDIMMPKVDGIHMCMKVREAKEMPIIMLSAKTQDMDKILGLTTGADDYVTKPFNPLELIARIKSQLRRYMKMNGFAIQNEDELEIGEMKINISTHKVIVEGEEVKLTPREFSILELLARNPGMVFSAEQIYEKVWNERSFQSDNTVMVHIRKVREKIEENPRKPRYIKTVWGVGYKIEKDI

SEQ ID NO: 10885 - DNA, 690 bp, Bacillus anthracis
  CDS (1)..(690)
atggcaaaaaacattttaattgtggaagatgaagatatattacgtgaaatattaaaagactattttttaagtgagcaatatgtagtgtttgaagcgagggacgggaaagaggctttagttgtatttgaagaagaagaggttgatttagttattcttgatattatgttgccggaactcgatggatggtctgtttgccgaagaatccgtaaaacatccgaagttcctattattatgttgacggcacgtgtagatgaagatgatacgttacttggatttgaacttggggcggatgactatgtgacgaagccatatagcccaccaattttattagcaagagcgaaacggttgttagagagtagaaaagtgacaaagcaacttttagagaatgaagatgatatattatcaatccatggtattcatgttcattttccatcgcgtactgttacggtaaataaaacagacattaatttaacacatacagaatttgaaatattagcgtattttatgaaaaatccaggaattgtcttaacgcgagaacaattaatttcaagaatttggggatatgaatttgctggtgacgaccgaacagttaatagtcatattcgtaatttaagaaataaattaggagagaaagcaaagtacattacaactgtagtacgaacgggttataaatttgaggggaatgtatga

SEQ ID NO: 10886 - protein, 229 aa, Bacillus anthracis
MAKNILIVEDEDILREILKDYFLSEQYVVFEARDGKEALVVFEEEEVDLVILDIMLPELDGWSVCRRIRKTSEVPIIMLTARVDEDDTLLGFELGADDYVTKPYSPPILLARAKRLLESRKVTKQLLENEDDILSIHGIHVHFPSRTVTVNKTDINLTHTEFEILAYFMKNPGIVLTREQLISRIWGYEFAGDDRTVNSHIRNLRNKLGEKAKYITTVVRTGYKFEGNV

SEQ ID NO: 10887 - DNA, 714 bp, Bacillus anthracis
  CDS (1)..(714)
atgaaagatatacgtatccttatagcagatgatgataaagaaatccgtaatttactaaaaatatatttagaacgagaattatatatggtagatactgcgattgatggcgaagtagccttacagttatttaatcaaaacaactatagcatcgttatattagatcttatgatgccaaaagtagatggtatcgaagtatgtagaaagcttagagataaaactaacgtaccgatattaatgctaaccgctaaagatcacgaagtcgataaaattttaggtttaagcattggtgctgatgattacattacgaagcctttcagcattcacgaagtagttgcacgagtcaaagctcttatacggcgttttttagttcttggaagtaacattaatgtacaagagaagacaactttagcttttaaaggactaactatcaatttaaatacatatacagttcacacaaataaagaagaaatcagcttaaccggaaaagaactagaactattaaaattctttacttcaaacccaggacaagtatttacaaaaacacagctctttcgcaatgtatgggacgataattatatagaagatgataataccgttatggtacatattcgaaaacttagaaagaaaatagaaatcgatccttccaatccaaaattcattcaaactgtatggggaattggctataagtttgtaggtgaaaagcttgaagattga

SEQ ID NO: 10888 - protein, 237 aa, Bacillus anthracis
MKDIRILIADDDKEIRNLLKIYLERELYMVDTAIDGEVALQLFNQNNYSIVILDLMMPKVDGIEVCRKLRDKTNVPILMLTAKDHEVDKILGLSIGADDYITKPFSIHEVVARVKALIRRFLVLGSNINVQEKTTLAFKGLTINLNTYTVHTNKEEISLTGKELELLKFFTSNPGQVFTKTQLFRNVWDDNYIEDDNTVMVHIRKLRKKIEIDPSNPKFIQTVWGIGYKFVGEKLED

SEQ ID NO: 10889 - DNA, 678 bp, Bacillus anthracis
  CDS (1)..(678)
atgaataaaacagtattacttgttgaagatgaaagaagattacgtgaaattgttagcgattattttcgcaatgaaggctttgaagtaatcgaagcagaagacggaaaaaaagcgttagaattatttgcagagcatgaaattgatttaattatgttagatattatgttaccagaaatagatggatggtctgtttgtagacgaattagaaaagaatcagcagtaccaattattatgctaacagcacgttcggatgaggatgatacattactagggttcgaattaggtgcagatgagtatgtaacgaaacctttcagcccgaaagtgttagtagctcgcgcgaagacgttactgaaacgtgcggatggcgtggtaggggtagcagaagaaaatgctatgtctttagctggaatagaagtgaatcgtctatctagaactgttttagtagatggagaagaaattattttgacacataaagaatttgaacttctcgtttatttaatggagaacaaaggaattgtgttatcacgtcaacatttattagatcagttatggggatatgactattacggtgatgaccgaacggttgatactcatattaaaaaactacgaaataagctaggagataaagcgaagcatattggtactgttattcgagtaggttataagtttgaagaataa

SEQ ID NO: 10890 - protein, 225 aa, Bacillus anthracis
MNKTVLLVEDERRLREIVSDYFRNEGFEVIEAEDGKKALELFAEHEIDLIMLDIMLPEIDGWSVCRRIRKESAVPIIMLTARSDEDDTLLGFELGADEYVTKPFSPKVLVARAKTLLKRADGVVGVAEENAMSLAGIEVNRLSRTVLVDGEEIILTHKEFELLVYLMENKGIVLSRQHLLDQLWGYDYYGDDRTVDTHIKKLRNKLGDKAKHIGTVIRVGYKFEE

SEQ ID NO: 10891 - DNA, 750 bp, Streptomyces avermitilis; identical to SEQ ID NO: 8461
  CDS (1)..(750)

SEQ ID NO: 10892 - protein, 249 aa, Streptomyces avermitilis; identical to SEQ ID NO: 8462

SEQ ID NO: 10893 - DNA, 672 bp, Streptomyces avermitilis
  CDS (1)..(672)
atgctcgtcgtcgaggacgaggagtccttcagcgacgccctgtcctacatgcttcgcaaggagggcttcgaggtcgccatcgcgaccaccggccccgacggtctggacgagttcgagcgcaacggcgccgacctcgtgctgctcgacctgatgctgcccggtctgccgggcacggaggtctgccgtcagctgcgtggccgctccaacgtgccggtgatcatggtcaccgccaaggacagcgagatcgacaaggtcgtcgggctggagataggagccgacgactacgtcaccaagcccttctcctcccgcgaactggtcgcccgcatccgggccgtcctgcgccgccgcggggagcccgaggaggtcaccccggccgccctggaggcaggtccggtgcgcatggacgtcgaccgccacgtggtcaccgtctccggctccaaggtcgaccttcccctgaaggagttcgacctcctggagatgctgctgcgcaacgcgggccgcgtcctgacccgcatgcagctcatcgaccgggtgtggggcgccgactacgtcggtgacaccaagaccctggacgtccacgtgaagcgcctgcgcgcgaagatcgagccggacccgggcgcgccgcggtacctggtgacggtgcgtggtctcggctacaagttcgagccgtag

SEQ ID NO: 10894 - protein, 223 aa, Streptomyces avermitilis
MLVVEDEESFSDALSYMLRKEGFEVAIATTGPDGLDEFERNGADLVLLDLMLPGLPGTEVCRQLRGRSNVPVIMVTAKDSEIDKVVGLEIGADDYVTKPFSSRELVARIRAVLRRRGEPEEVTPAALEAGPVRMDVDRHVVTVSGSKVDLPLKEFDLLEMLLRNAGRVLTRMQLIDRVWGADYVGDTKTLDVHVKRLRAKIEPDPGAPRYLVTVRGLGYKFEP

SEQ ID NO: 10895 - DNA, 705 bp, Enterococcus faecalis; identical to SEQ ID NO: 8465
  CDS (1)..(705)

SEQ ID NO: 10896 - protein, 234 aa, Enterococcus faecalis; identical to SEQ ID NO: 8466

SEQ ID NO: 10897 - DNA, 738 bp, Coxiella burnetii
  CDS (1)..(738)
atgacaggtacttcacacatcctcatcgtcgatgacgacagcgatattcgagatcttctaggtaaatttctccgccgccatggttttgaggccagcttggcgaaggatggaagcgaaatgcaggccattctgctcaagcaagccgtggatctcgttattcttgacatcatgatgccaggagatgatggtttaacgctgtgtcgtcaaatgcgcgctaattcgaccatccctattcttatgctcacggccattagtgaagaggtggatcggattttgggtttggagatgggagcggatgattatttaagcaagccttttaatccgcgggaattactggcgcgagtcagggcgattttgcggcgcagccagggaggaggtggctccctgaatggaatcgggacaaatgagcgggtcatttatgagtttgcggggtggtcgttagaccccgctgagcgccgtttgaagtctcccgacagcttagaaattactttgagtagtggtgagtttgatttattgcacgcactggtgcaacgttcacaacaagtgttaagccgcgataaattattggatttaactaaaaatcgcgaagcggggccgtttgaccgcagcatagatattcaaattagccggctgcggcacaagttggaacaagatcctaaaaatccccaaatcatcaaaaccatccgtggcggtggctatgtgttagcggcggaagttgttcgaaagcaaagactatga

SEQ ID NO: 10898 - protein, 245 aa, Coxiella burnetii
MTGTSHILIVDDDSDIRDLLGKFLRRHGFEASLAKDGSEMQAILLKQAVDLVILDIMMPGDDGLTLCRQMRANSTIPILMLTAISEEVDRILGLEMGADDYLSKPFNPRELLARVRAILRRSQGGGGSLNGIGTNERVIYEFAGWSLDPAERRLKSPDSLEITLSSGEFDLLHALVQRSQQVLSRDKLLDLTKNREAGPFDRSIDIQISRLRHKLEQDPKNPQIIKTIRGGGYVLAAEVVRKQRL

SEQ ID NO: 10899 - DNA, 672 bp, Streptomyces lividans; identical to SEQ ID NO: 8589
  CDS (1)..(672)

SEQ ID NO: 10900 - protein, 223 aa, Streptomyces lividans
MLVVEDEESFSDALSYMLRKEGFEVAIATTGPDGLDEFERNGADLMLLDLMLPGLPGTEVCRQLRGRSNVPMIMMTAKDSEIDKVVGLEIGADDYVTKPFSSRELVARIRAVLRRRGEPEEVAPAALEAGPVRMDMDRHMMTMGGTKVDLPLKEFDLLEMLLRNAGRMLTRMQLIDRVWGADYVGDTKTLDVHVKRLRAKIEPDPGAPRYLMTMRGLGYKFEP

SEQ ID NO: 10901 - DNA, 717 bp, Thiocapsa roseopersicina
  CDS (1)..(717)
atgcccgatacaccgatccagatcctggttgtcgacgacgattcggccttgcgcgctctgctcggagactatctcgccggggagggcttcctcgtggccggagcggaggacggcgtggcgatggacgcctggttggccgagcatgagacggacctggtgatcctcgacttgatgctccccggcgaggacgggctgaccctggcacgccgactgcgggcgcgcgccgataccccgatcatcatgctgtcggcacgcggcgacgacatcgatcgcatcgtcggcttggaggtcggtgccgacgactacatgcccaagcccttcaatccccgcgagcttcttgcgcgaatccgtgcggtgctgcgccgccgagccccgagcgggccaacagagccccgtgaggagaatgggatcattcggttcgggccctatcgtctcgacctcggtcaacgcgagttgcgacgcggggatgacgccgtcgtgctcacctcgggcgagcttgagctgttgcgcatccttgccgagcatcccgaccggatattggatcgtgatctgctgctcgacctgctcaagggctacgagcgctcgccgttcgatcgcagcatcgacgtgcagatcgcgcgcctgcgcgccaaaatcgaaccggataccaaacgcccccgttacatccgcaccatttggggcaagggttacatgttcacgccggccggcgacgcatga

SEQ ID NO: 10902 - protein, 238 aa, Thiocapsa roseopersicina
MPDTPIQILVVDDDSALRALLGDYLAGEGFLVAGAEDGVAMDAWLAEHETDLVILDLMLPGEDGLTLARRLRARADTPIIMLSARGDDIDRIVGLEVGADDYMPKPFNPRELLARIRAVLRRRAPSGPTEPREENGIIRFGPYRLDLGQRELRRGDDAVVLTSGELELLRILAEHPDRILDRDLLLDLLKGYERSPFDRSIDVQIARLRAKIEPDTKRPRYIRTIWGKGYMFTPAGDA

SEQ ID NO: 10903 - DNA, 720 bp, Yersinia enterocolitica
  CDS (1)..(720)
atgcaagagaatcacaagattttggtcgttgagatacatatgcgcctacgcgcgctattggaacgttacgtgacagagcaaggttttcaggtgcgcagtgttgccaatgctgaacagatggatcgcttgctaactggtgagtcattccacatgatggtgctcgacctgatgttaccgggggaagatggcctgtctatctgcccccgcctgcgcagtcaaagtaacccaatgccgatcattatggtgacggccaagggtgaagaagttgaccgtatcgtcgggctggaaattggtgccgatgactatattccaaagccatttaacccacgcgaactgctggctcgtatccgcgcggtggtacgccgtcaggccaacgaacttccaggtgccccttcacaagaagaagcggtgattgcatttggtaagttcaaactgaacttgggtacccgggagatgttcggtgaagatgaacctatgccactgaccagcggcgagtttgcagtgctgaaagctttagtcagccatccgcgtgagccattgtctcgcgataaactgatgaatttggctcgtggccgtgaatacagtgcaatggaacgctctatcgacgtacagatttcacgtttgcgccgtatggtagaagaagatccagctcatccacgctatatccaaaccgtatggggcttgggctacgtatttgtgccggacggcagtaaagcatga

SEQ ID NO: 10904 - protein, 239 aa, Yersinia enterocolitica
MQENHKILVVEIHMRLRALLERYVTEQGFQVRSVANAEQMDRLLTGESFHMMVLDLMLPGEDGLSICPRLRSQSNPMPIIMVTAKGEEVDRIVGLEIGADDYIPKPFNPRELLARIRAVVRRQANELPGAPSQEEAVIAFGKFKLNLGTREMFGEDEPMPLTSGEFAVLKALVSHPREPLSRDKLMNLARGREYSAMERSIDVQISRLRRMVEEDPAHPRYIQTVWGLGYVFVPDGSKA

SEQ ID NO: 10905 - DNA, 708 bp, Vibrio parahaemolyticus
  CDS (1)..(708)
atggaaaacaagcagatactggtcgtcgatgacaacctcgacctgcgcgaagcattgtcagattaccttggccgtgcagggtttgaagtactttgcgcagaaaacggccgtgtgatgtggcagctgctcaatgatcaccatcctgatttgatcatcctagatattatgatgcccggtgacgacggctttaccctgtgccagaaactgcgcaaaaattccgatatcccgatcatcatgctgaccgccgtcaccgaagaagccgaccgagtcgcagggctagaaatgggcgctgatgactacatcaccaaatcattcagtccgcgtgaactgctcgcgcgcatcaaaacgattctgagacgcagccaatcgaccgccaatagcaaactgacgcgtaaagtgcgttttgacgattggttgttagataccgtaacccggcaactgacccacgttgctagccgcgaggtcaagcaacttagtggcgcggatttgtcgctgctcggtttgttcgtcaaccacgcgcagtcaatattgtctcgcgatgacattgcgcgcgagatctggggacgcgatgccgacccgtttgaacgcggcattgacgtgcagatcagccgcttgcgtcatcaccttgaagataaagaccgttcgctgatcctaacagtgcgcaacaaaggctacatgctgaccacggacgtgcactatgaaaattaa

SEQ ID NO: 10906 - protein, 235 aa, Vibrio parahaemolyticus
MENKQILVVDDNLDLREALSDYLGRAGFEVLCAENGRVMWQLLNDHHPDLIILDIMMPGDDGFTLCQKLRKNSDIPIIMLTAVTEEADRVAGLEMGADDYITKSFSPRELLARIKTILRRSQSTANSKLTRKVRFDDWLLDTVTRQLTHVASREVKQLSGADLSLLGLFVNHAQSILSRDDIAREIWGRDADPFERGIDVQISRLRHHLEDKDRSLILTVRNKGYMLTTDVHYEN

SEQ ID NO: 10907 - DNA, 717 bp, Vibrio parahaemolyticus
  CDS (1)..(717)
atgcaaaccccgcagattcttatcgtagaagatgagcaagtaactcgtaacactcttaagagtatttttgaagcagagggatacgctgtttttgaagccagtgacggtgaagagatgcaccaagtgttgtctgacaactctatcaacttggtcattatggacattaatcttccaggcaagaatggtttactgttagcacgtgaactacgtgagcaagcgaacatcgctctgatgttcctaacaggccgcgacaatgaagtagacaagatcctaggtcttgaaattggtgctgatgactacatcacaaaaccattcaacccacgtgaattgactattcgtgcgcgcaacctgctaagccgctcaatgagcactaacgcagttcaagaagaaaagcgctcagtagaaaaatacgaattcaacggttgggtgctagatattaacagccgctcactagtgagccctgctggtgatagctacaaactgcctcgttctgaattccgtgcacttctgcacttctgtgagaacccaggtaagatccaaacacgtgctgatcttcttaagaagatgactggaggtgagcttaaaccacatgaccgtactgtcgacgtaacgattcgccgtattcgtaaacacttcgaatcagtatctggtacgccagaaatcatcgcgactatccacggtgaaggctaccgcttctgtggtgacttagaagactaa

SEQ ID NO: 10908 - protein, 238 aa, Vibrio parahaemolyticus
MQTPQILIVEDEQVTRNTLKSIFEAEGYAVFEASDGEEMHQVLSDNSINLVIMDINLPGKNGLLLARELREQANIALMFLTGRDNEVDKILGLEIGADDYITKPFNPRELTIRARNLLSRSMSTNAVQEEKRSVEKYEFNGWVLDINSRSLVSPAGDSYKLPRSEFRALLHFCENPGKIQTRADLLKKMTGGELKPHDRTVDVTIRRIRKHFESVSGTPEIIATIHGEGYRFCGDLED

SEQ ID NO: 10909 - DNA, 693 bp, Pseudomonas syringae
  CDS (1)..(693)
atgcgggcgctgatcgtcgatgacgacgtggccattcgcgaactgctttgcgactacctgacgcgcttcaacatcaatgcccgcggcgtgaccgacggttcgcagatgcgtcaggcactcaccgatgaaaccttcgatgtggtggtgctcgacctgatgctgcccggcgaggacggcctgtcgctgtgccgctggttgcgcagcacttcggacattccgatcctgatgctgaccgcacgttgcgaaccgactgaccggatcatcggcctggagctgggtgccgacgattacatggccaaaccgttcgaaccgcgcgagctggtcgcgcgcatccagaccatcctgcgccgggtacgcgacgaacgcagcgatcagcgcacgaccattcgctttgacgcctggcgcctgaacagcgtcctgcgtcaattgacggccgccgacgggctggtggtgccgctgtccaacgccgagtttcgcctgttgcgcgtctttctcgaacgaccgcacagagtcttgagccgcgaacagttgctcgatgctgcaagaggccgctcgatagaggcgtttgatcgcagtatcgatttgctggtttcgcgcctgcgccagaaactcggcgacgacccgaagaatccgcaactgatcaagaccgtacgcggtgaaggctatctgttcgatgccagggagctgggttga

SEQ ID NO: 10910 - protein, 230 aa, Pseudomonas syringae
MRALIVDDDVAIRELLCDYLTRFNINARGVTDGSQMRQALTDETFDVVVLDLMLPGEDGLSLCRWLRSTSDIPILMLTARCEPTDRIIGLELGADDYMAKPFEPRELVARIQTILRRVRDERSDQRTTIRFDAWRLNSVLRQLTAADGLVVPLSNAEFRLLRVFLERPHRVLSREQLLDAARGRSIEAFDRSIDLLVSRLRQKLGDDPKNPQLIKTVRGEGYLFDARELG

SEQ ID NO: 10911 - DNA, 738 bp, Pseudomonas syringae
  CDS (1)..(738)
atgagttcagtcagtaaatcgatcctgctggtggatgacgatcaggagattcgcgagttgctggacacctacctgagtcgtgccggttttcaggtgcgcacggtgggcgatggcgcgcaatttcgccgcgccttcaacgaagaacccagtgatttgctgatccttgacgtgatgctgccggatgaagacggtttcagcctgtgcaaatgggtgcgccagcatccgcgccagccgcacgtgccgatcatcatgctgaccgccagttcggacgaggccgaccgggtcatcggcctggagttgggggccgacgattatctgggcaaaccgttcagcccgcgtgagctgcaagcgcgtatcaaggcgttgttgaggcgcgcccagtttggtcaggatcgtccgggtggcgatgtgcttctgttcgatgaatggcggctggatatggtcagtcaccggctgtttcacaatgacggcgaagaggtgattctttccggtgccgactttgcactgctcaagctgtttctcgacaacccccaacagattctcgaccgcgacaccatcggcaacgccacccgtggccgggagctgatgccgctggagcgtattgtcgacatggcggtcagccgcctgcgccagcgtttgcgcgacaccggcaagtcgccgcgcctgatccgcaccattcgtggcagtggttacctgctggcggcgagtgttaattcgcacgcgagcaacggttattaa

SEQ ID NO: 10912 - protein, 245 aa, Pseudomonas syringae
MSSVSKSILLVDDDQEIRELLDTYLSRAGFQVRTVGDGAQFRRAFNEEPSDLLILDVMLPDEDGFSLCKWVRQHPRQPHVPIIMLTASSDEADRVIGLELGADDYLGKPFSPRELQARIKALLRRAQFGQDRPGGDVLLFDEWRLDMVSHRLFHNDGEEVILSGADFALLKLFLDNPQQILDRDTIGNATRGRELMPLERIVDMAVSRLRQRLRDTGKSPRLIRTIRGSGYLLAASVNSHASNGY

SEQ ID NO: 10913 - DNA, 717 bp, Pseudomonas putida
  CDS (1)..(717)
atgacgcctcgggtattgatcgtcgatgacgatccgcttgttcgtgacttgctgcaggcctacctgtcccgggaaggctacgacgtacactgcgccgacaccgccgaaagggccgaagccctgcttggcagccaggacgtcgacctcgtgctgctggacatccgcctgcccggcaaggacggcctcaccctgacccgcgaactgcgggtgcgctcggaggttggcatcatcctcatcaccgggcgcaatgacgatatcgaccgcatcgttggcctggaatgcggcgcagatgactacgtgatcaaaccgctcaacccccgcgagctggtgtcccgggcgaaaaacctgatccgccgcgtgcgccatgcccgcgaggcgcaccccgccccagcctgcgcgcaatcgctgaagcagttcgccgactgggcactggataccgaccgccggcgcctgatcgacgcctgtggcgggcaaaccctgctgactcatggcgagttccagttgctcagtgtgttcctgcgcaacagcggccacaccctcagccgcgaccagttgatggaccagattcgcaaccgcgagtgggtgcccaacgaccgctccatcgacgtgctggtcggccgcctgcggcgcaagctgcatgacgacccggccgaaccgcagttgatcatcaccattcacggcaccggctacctgttcaccgccagcgtggcagcatga

SEQ ID NO: 10914 - protein, 238 aa, Pseudomonas putida
MTPRVLIVDDDPLVRDLLQAYLSREGYDVHCADTAERAEALLGSQDVDLVLLDIRLPGKDGLTLTRELRVRSEVGIILITGRNDDIDRIVGLECGADDYVIKPLNPRELVSRAKNLIRRVRHAREAHPAPACAQSLKQFADWALDTDRRRLIDACGGQTLLTHGEFQLLSVFLRNSGHTLSRDQLMDQIRNREWVPNDRSIDVLVGRLRRKLHDDPAEPQLIITIHGTGYLFTASVAA

SEQ ID NO: 10915 - DNA, 741 bp, Pseudomonas putida
  CDS (1)..(741)
atggaacacgtcgatcacatcctgatcgtcgacgacgaccgcgagatccgcgaactggtcggcaattacctgaagaagaacggcctgcgcaccagcatcgttgcagacggccggcagatgcgcgcctttctcgaagccaacagcgtcgacctgatcgtgctcgacatcatgatgcctggcgacgacggcctgctgttgtgccgcgagctgcgcgccggcaagcaccgcaatacgccggtgctgatgctgaccgcccgcaatgacgaaaccgaccgcatcatcggcctggaaatgggcgccgacgattacctgaccaaaccgttctcggcccgcgaactgctcgcccgcatcaacgccgtgctgcgccgcacacgcatgctgccgcccaacctgaccatcagtgaaagcagccgcctgctgggtttcggtcaatggcgcctggacaccaccgcgcgccacctgctcgacagcgaaggcaccctggtggccctgagcggcgccgagtaccgcctgctgcgagtgttcctcgaccacccgcagcgggtgctcagccgcgaacagctgcttaacctgacccagggccgcgaagccgacatcttcgaccgctccatcgacttgctggtcagccgcctgcgccagcgcctgggtgacgatgcccgcgagcccagctgcatcaagaccgtgcgcagcgagggctacgtgttttcgctgccggtgcaattgctcgagtccccctcatga

SEQ ID NO: 10916 - protein, 246 aa, Pseudomonas putida
MEHVDHILIVDDDREIRELVGNYLKKNGLRTSIVADGRQMRAFLEANSVDLIVLDIMMPGDDGLLLCRELRAGKHRNTPVLMLTARNDETDRIIGLEMGADDYLTKPFSARELLARINAVLRRTRMLPPNLTISESSRLLGFGQWRLDTTARHLLDSEGTLVALSGAEYRLLRVFLDHPQRVLSREQLLNLTQGREADIFDRSIDLLVSRLRQRLGDDAREPSCIKTVRSEGYVFSLPVQLLESPS

SEQ ID NO: 10917 - DNA, 726 bp, Pseudomonas putida
  CDS (1)..(726)
atgagcactgccggcaaatcgatcctgatggtcgacgacgaccaggaaatccgtgaactgctgcaaacctacctgagtcgatccggcttccaggtgcatgccgaggctgacggcaagggctttcgccacgcgctggaaaccacgccctgcgacctggtcattcttgacgtcatgttgcccgacgaagacggcttcagcttgtgccgctgggtacgccagcaccctcgccaggcgcgcgtacctatcatcatgctcaccgccagttcggacgaggccgaccgggtcatcggcctggagctgggcgctgacgactatctgggcaagccgttcagcccccgcgaactgcaagcgcgaatcaaggctttgttgcgtcgcaccgagttcggccagacggcgccgggcaacgccgtgctggccttcgacgactggcgcctggacacggtcagccaccgcctgttccaccgtgatggagaggaggtgatcctctccggcgccgactttgccctgctcaaactgttcctcgatcacccgcagcaaatcctcgaccgcgacaccatcggcaacgccacccgtggtcgcgaaccgatgccgttggaccgtatcgtcgacatggcggtcagccgtctgcgccagcgcctgcgcgataccgacaagcctccccggctgatccgcacggtgcgcggcagtggctacttgttggcggcacatgtctgctgtgcgccctga

SEQ ID NO: 10918 - protein, 241 aa, Pseudomonas putida
MSTAGKSILMVDDDQEIRELLQTYLSRSGFQVHAEADGKGFRHALETTPCDLVILDVMLPDEDGFSLCRWVRQHPRQARVPIIMLTASSDEADRVIGLELGADDYLGKPFSPRELQARIKALLRRTEFGQTAPGNAVLAFDDWRLDTVSHRLFHRDGEEVILSGADFALLKLFLDHPQQILDRDTIGNATRGREPMPLDRIVDMAVSRLRQRLRDTDKPPRLIRTVRGSGYLLAAHVCCAP

SEQ ID NO: 10919 - DNA, 720 bp, Pseudomonas putida
  CDS (1)..(720)
atgagcacgaccctgctggttgtcgatgatgacgacgagatccgcgaacttctttgtgattacctgaccgatgccggctacaacgtgctggcggcagcagacggtcaacagatgcgtgaccagctggcccggcacaaagtggagctggtggtgctcgacctgatgctgccgggtgaggacggccttagcctgtgcaggcagttgcaggccacacctgggttggcagtgatcatgctgtcagccaagggcagcacgctggaccgcatcatcggtctggaagtaggcgccgacgactatctggccaagcccttcgaaccacgcgaactgatcgcccggatcaaagccgtactgcgtcgtccgcaacgcctgggcacctctgccgaagaacctatggtggacgcccagctgttcgcaggctttcgcctggaacacgtcaagcgcctgctcacccgcccggatggcgagaccctgaccctgccgcgctccgactaccgtgtgctgcgcgaactgctggaagccaacaaccgagtggtctcccgtgaccaactgacccgcagcgcgttcggccgcgatcacctgcccgacgaccgctcggtggacatgtgtgtcagccgcctgcgccagcagctgcgccgggcgccggcggggaccgcgcaaatcctgaccatccgtaacgaaggctatttgctgagtctcgcccccctcgcggctggtgtctga

SEQ ID NO: 10920 - protein, 239 aa, Pseudomonas putida
MSTTLLVVDDDDEIRELLCDYLTDAGYNVLAAADGQQMRDQLARHKVELVVLDLMLPGEDGLSLCRQLQATPGLAVIMLSAKGSTLDRIIGLEVGADDYLAKPFEPRELIARIKAVLRRPQRLGTSAEEPMVDAQLFAGFRLEHVKRLLTRPDGETLTLPRSDYRVLRELLEANNRVVSRDQLTRSAFGRDHLPDDRSVDMCVSRLRQQLRRAPAGTAQILTIRNEGYLLSLAPLAAGV

SEQ ID NO: 10921 - DNA, 708 bp, Lactobacillus plantarum; identical to SEQ ID NO: 8483
  CDS (1)..(708)

SEQ ID NO: 10922 - protein, 235 aa, Lactobacillus plantarum; identical to SEQ ID NO: 8484

SEQ ID NO: 10923 - DNA, 786 bp, Clostridium tetani
  CDS (1)..(786)
atgatgataatggaggaatatagtgtgcttgtagtagatgatgaagatgaaataagagatgccataggtatatatttaaaaaatgagggaataaaagttcttaaagcaaaagatggcatagaggctttgatggttttagaagaagaagaagttcatcttattataatggacattatgatgcctagaatggatggaattaaagctacttttaaaataagggaaagtaaaaaaatacctataataatgctttcagcaaaatctgaagatatggataaaatattgggacttaatataggagcggatgattatgtaacaaaaccttttaatcctttagaactaatagctagagtaaaatctcagttgagaagatatataagatttgggaattataaagaaaataaaaatgcaatagtagtaaggggacttactttaaataaggatgcaaagactgctatggtagatggaaaagaagtaagccttacattaacggaatataaaatattaaaattattaatggaaaacaagggacgggtattttctatagaacatatatatgaaagcgtttggcaggaacctttttataatggggaaaatactgtagcggttcacataaggaggataagagaaaaaatagaaattaatccaagggaaccagaatacttaaaggtggtttggggaattggatataaaattgaaaaacaaaaaatcaatactaatatgctttatagtaggtatatatttaatagctatagcatctatagcatgtatagatgttttaaatcatag

SEQ ID NO: 10924 - protein, 261 aa, Clostridium tetani
MMIMEEYSVLVVDDEDEIRDAIGIYLKNEGIKVLKAKDGIEALMVLEEEEVHLIIMDIMMPRMDGIKATFKIRESKKIPIIMLSAKSEDMDKILGLNIGADDYVTKPFNPLELIARVKSQLRRYIRFGNYKENKNAIVVRGLTLNKDAKTAMVDGKEVSLTLTEYKILKLLMENKGRVFSIEHIYESVWQEPFYNGENTVAVHIRRIREKIEINPREPEYLKVVWGIGYKIEKQKINTNMLYSRYIFNSYSIYSMYRCFKS

SEQ ID NO: 10925 - DNA, 723 bp, Clostridium tetani
  CDS (1)..(723)
atgggcgtgacatatatggaagggttaagcaatgcaaatgtcttaatagttgaagatgataaagagataaataatttaataagtaaagctctaattaaagaaggatttagtgtagtgcaagcatttgaaggtatagaggggtattcaaaatataggaaaatagatttttctattataattttagatataatgctcccatatttaaatggtatagaaatcatgaaaaaaataagggaagaaagtgtagttccaattattttaatatctgctaaagatgaagaatatgatagaataataggacttgaattaggagcagacgattatatagtaaaaccattttttgtaggggaattagtagctagaattaaatcacagcttagaagatatattgattttcataaaaatgatgaagtgataagtagaatacaaaagggggacataattttagatttaaataattattgcatttataaaaatggagaaaaaatagaccttactgctaaagaatttggattattaaagctattttttacaaatcccaatagagtatttacaaagatgcagatatttgaaaatgtttggcatgaagaatataggggtgatgataatactataatggttaacataagaaggcttagaaacaagatagaggatgaccctaataacccagaatatattttaacagtatggggcattggatataaattaggtgatataaaatga

SEQ ID NO: 10926 - protein, 240 aa, Clostridium tetani
MGVTYMEGLSNANVLIVEDDKEINNLISKALIKEGFSVVQAFEGIEGYSKYRKIDFSIIILDIMLPYLNGIEIMKKIREESVVPIILISAKDEEYDRIIGLELGADDYIVKPFFVGELVARIKSQLRRYIDFHKNDEVISRIQKGDIILDLNNYCIYKNGEKIDLTAKEFGLLKLFFTNPNRVFTKMQIFENVWHEEYRGDDNTIMVNIRRLRNKIEDDPNNPEYILTVWGIGYKLGDIK

SEQ ID NO: 10927 - DNA, 699 bp, Clostridium tetani; identical to SEQ ID NO: 8485
  CDS (1)..(699)

SEQ ID NO: 10928 - protein, 232 aa, Clostridium tetani; identical to SEQ ID NO: 8486

SEQ ID NO: 10929 - DNA, 693 bp, Clostridium tetani
  CDS (1)..(693)
atgaatatattaatagcagaagatgaacaggatataagagaacttttaggattacatctaataaaggaagattataatgtttatgaagcatgtaatggtatagaagcattagatgtttttaataaaaatgatatagatttagcaatattagatataatgatgccaggtttagatggatttaaagttttaaaaaaaattagagaaaaaagtaatataccagtaatatttataacagctagaggagaagatgaaaataaaatattagggctggggttaggagcagatgattatatagtaaagccgtttagtcctatggaagtagtagcaagagtaaaagctctttttagaagggttggaacctattctcaaaatagcagtaaagatattaataaaattgaaaatggagagttatcattaaacaaagactcctgcactttttacaaaaatggaaatccaattgaattaaatgcaaaggaatataaaataatggagtttctaatggagaataaaggcagagtacatacaaaaaaacaaatatacgaaaaggtatggggctatgaatactatggcgatgctaatacaataatggtacatataagtcatataagagataaaatagaagataatccaaaagagcctatatatttaaaaactattagaggaataggatataaattagaaaaggtagaataa

SEQ ID NO: 10930 - protein, 230 aa, Clostridium tetani
MNILIAEDEQDIRELLGLHLIKEDYNVYEACNGIEALDVFNKNDIDLAILDIMMPGLDGFKVLKKIREKSNIPVIFITARGEDENKILGLGLGADDYIVKPFSPMEVVARVKALFRRVGTYSQNSSKDINKIENGELSLNKDSCTFYKNGNPIELNAKEYKIMEFLMENKGRVHTKKQIYEKVWGYEYYGDANTIMVHISHIRDKIEDNPKEPIYLKTIRGIGYKLEKVE

SEQ ID NO: 10931 - DNA, 741 bp, Clostridium tetani; identical to SEQ ID NO: 8489
  CDS (1)..(741)

SEQ ID NO: 10932 - protein, 246 aa, Clostridium tetani; identical to SEQ ID NO: 8490

SEQ ID NO: 10933 - DNA, 771 bp, Bradyrhizobium japonicum
  CDS (1)..(771)
atggccattctcaatcccaacatcctggtcgtcgaggacgaccgcgaaacgcggacgttgattgcgaagtacctgcgcaacaacgcctgtaacgtcaccgccgtgagcgatggccgcgagatgtcgcgcgccatggccgatcatcgcgtggacctcatcatcctcgacgtcatgctgccgggcgaggacggcctgagcctctgccgcaaggtgcgctcggaggcgcagacgccgatcatcatgctgaccgcgcgcggcgaggacgtcgaccgcatcgtcggcctcgagatgggcgcggacgactatctgacaaagcccttcaacccgcgcgagctgctcgcccgcatcaacgcggtgttgcgccgccaggccgcagcccaggcggcgagctcgatcgaaggcgcgagcacgctcgccttcgagggctggcgcatcgacctgcggctgcgcgagctgcgcaatccggaaggcgcgcgcgtcgcggtgaccagcgccgagttcgatctgctcaggacgttctgcgaacggccgggccgcgtgctgtcgcgcgacagcctgctcgacctcacgcagggccgcaacaccggctcgttcgagcgctccatcgacgtgctggtcagccgcatccgccgcaagatcgagcccaatccgcacgatccgaccatcatcaagacggtgcgctccggcggctatctgttcacgccaagaactgaagcagcgagaactgaagcagcaagcaccgaagcggtcgcggcccccctgggcaactga

SEQ ID NO: 10934 - protein, 256 aa, Bradyrhizobium japonicum
MAILNPNILVVEDDRETRTLIAKYLRNNACNVTAVSDGREMSRAMADHRVDLIILDVMLPGEDGLSLCRKVRSEAQTPIIMLTARGEDVDRIVGLEMGADDYLTKPFNPRELLARINAVLRRQAAAQAASSIEGASTLAFEGWRIDLRLRELRNPEGARVAVTSAEFDLLRTFCERPGRVLSRDSLLDLTQGRNTGSFERSIDVLVSRIRRKIEPNPHDPTIIKTVRSGGYLFTPRTEAARTEAASTEAVAAPLGN

SEQ ID NO: 10935 - DNA, 822 bp, Bradyrhizobium japonicum
  CDS (1)..(822)
atgaatgaccttaaaaccctcgccgcgtgtggtagtttggctcgaacgcggtcttccggcaccgaccggccgcccgcatcgacgccaagcaacatcgccattcatgccatgagcacccagagcatcctcatagtcgaagacgaccaagagacacgaaatctggtcgcacgctatctgcgtgagaactcgttcaacgtcggcatggccgcgaacgggcgtgagatggaccgctacatcagccagaaccgcgtcgacctgatcgtgctcgacctcatgctgccgggcgaggacggcctgagcctgtgtcgacgcctgcgcgtcgataccacgacgcccatcatcattctgaccgccaagggcgacgacgtcgatcggatcctcggtctcgaaatgggagccgacgactatttgccaaagccgttcaatccgcgcgaacttctggcgcggatcaacgccgtgctccggcggcaattgggcggatcggcggggcccgcggcaaagacctcggcccgcctgagattcgagggctggatcatcgattcccgaatgcgggagttgcgtgacccggagggcgcgcaggtgccgctgacgagcgccgaattcgacctgctgcaatccttctgcgagcgccacggccgcatcctgagccgggacacgctcctgaacatgacgcgcgggcggccgggcggcgccttcgggcgcagcatcgacgtgctcgtgagccgattgcgcggcaagctcgacaggaccgaaggaacctcgatgatcaagaccgtcagaacgggcggctatattttcacgccgcgggtggacgaagcgtga

SEQ ID NO: 10936 - protein, 273 aa, Bradyrhizobium japonicum
MNDLKTLAACGSLARTRSSGTDRPPASTPSNIAIHAMSTQSILIVEDDQETRNLVARYLRENSFNVGMAANGREMDRYISQNRVDLIVLDLMLPGEDGLSLCRRLRVDTTTPIIILTAKGDDVDRILGLEMGADDYLPKPFNPRELLARINAVLRRQLGGSAGPAAKTSARLRFEGWIIDSRMRELRDPEGAQVPLTSAEFDLLQSFCERHGRILSRDTLLNMTRGRPGGAFGRSIDVLVSRLRGKLDRTEGTSMIKTVRTGGYIFTPRVDEA

SEQ ID NO: 10937 - DNA, 726 bp, Bradyrhizobium japonicum
  CDS (1)..(726)
atgcttgcagatgttggccacatcgttgttgtcgatgacgatcccaccttgcggcagatggtgatcagatatctggaggagcacaatgtcccgaccagggcggcgtccaaccggtctgaactgtaccactatctcgaggccggtcagcccagtctgatcatcctcgaccttcgcctcggtcaggaagacggcctggacctgctgcgggagatccggtcgcattccgacgtgcctgtcatcatcacgactggccaccgccccgacgagatcgatcgcatcgtcgggctcgagctcggcgccgacgactacatcatcaagccgttctccttgagagagctgctggcgcgcgtccgggcggtgttgcggcggcaggagatgggccgcgccgcgcgcgcccgcgatcccgagcgcggcggctatcgcttcaacggctggaagctggaacgccgcggccgaaagctcatcgatcccagcgaagcgccggtaccgctcagcaagggagagtatgccttgttgctggccttcctcgaggcgccgcagcgacccctgacccgcgagcatctgcttcaggccacccgcatccacgaagacattttcgatcgcagcatcgatgttcaagtgttgcggctgcggcgcaagctggaggtcgatccgagtgcgccgcgcgtcattcagaccgagcgcggcgtcggctatgtcttcgcggttcccgtagatccgttctag

SEQ ID NO: 10938 - protein, 241 aa, Bradyrhizobium japonicum
MLADVGHIVVVDDDPTLRQMVIRYLEEHNVPTRAASNRSELYHYLEAGQPSLIILDLRLGQEDGLDLLREIRSHSDVPVIITTGHRPDEIDRIVGLELGADDYIIKPFSLRELLARVRAVLRRQEMGRAARARDPERGGYRFNGWKLERRGRKLIDPSEAPVPLSKGEYALLLAFLEAPQRPLTREHLLQATRIHEDIFDRSIDVQVLRLRRKLEVDPSAPRVIQTERGVGYVFAVPVDPF

SEQ ID NO: 10939 - DNA, 816 bp, Bradyrhizobium japonicum
  CDS (1)..(816)
atgaatgttcgttcacaggacagcgcgttgcgcgacgacttgaattttcaggccggcccgcaagcacacaggacatccaccatcgtggctgatcccgcacgtcaggacgtgcgtcccgcaggccgcgagcggctgatcgtcgtcgaagacgatccggtgacgcggacgatgctggtcggttacttcggcgagaacaatttcgacgtggtcggcgccggctcctgcgcggaatgccgccaggcgctgcgtgggcgcgccgacctcatcttcctcgacgtgcagttgcccgacggcgacggcttcgagctcgccaaggaaatccaggcgaccagcaacgcgggcatcatcttcgtgacccgccgcgacaccgacgtcgatcgcatcctcggcctcgagatcgcgggcgaccactacgtcaccaagccgatcaatctgcgcgacctgcttgcgcgcgcccgcagcgtgctgcggcggcgctcgatcgaccgcaaggcggcgcgcaaccacaattcgatcgccttcggcgactggatcatcgatctgacgcggcgcgagctgctcggcaacgacggcaagccggtgtcgctgacgcgggccgagttcgacctgctggcggcgcttgtcggcgccgacggcaggccgctcagccgcgactatctgatcgaggtcgtcagcaaccgccaggccgaggtcgacatccgcacggtcgatgcgctggtggcgcggctgcgccgcaagctcgtcggcagcggcacgcccgtgatcgcgaccgtcaccggcgtcggctacaagctcgcgctcagcgaacggctctag

SEQ ID NO: 10940 - protein, 271 aa, Bradyrhizobium japonicum
MNVRSQDSALRDDLNFQAGPQAHRTSTIVADPARQDVRPAGRERLIVVEDDPVTRTMLVGYFGENNFDVVGAGSCAECRQALRGRADLIFLDVQLPDGDGFELAKEIQATSNAGIIFVTRRDTDVDRILGLEIAGDHYVTKPINLRDLLARARSVLRRRSIDRKAARNHNSIAFGDWIIDLTRRELLGNDGKPVSLTRAEFDLLAALVGADGRPLSRDYLIEVVSNRQAEVDIRTVDALVARLRRKLVGSGTPVIATVTGVGYKLALSERL

SEQ ID NO: 10941 - DNA, 738 bp, Bradyrhizobium japonicum
  CDS (1)..(738)
atgacccaaagccagcacatcatgatcgtcgacgacgaggccccggcccgggagatggtcggcgattacctcaagatgcacggcttcaccgtgacgctgtgcgacggcggcaagtcgttgcgcgccgcgatcgacggcggcatgcccgatctcgtcgtgctcgacctcaacatgcccgaggaagacgggctgtcgatcatccgcgacctcaagagccgcatcaacgtgcctgtcatcatgctcacggcgaccgcgagcccgatcgaccgcgtcgtcgggcttgagcttggcgccgacgactacgtggcaaagccctgcgagctgcgcgagctgatggcgcgcatccgctcggtgctgcgcagaagcgggccggccaaggccgcggcgccggaggctgcggcggcgaaatcggacaaggatcagctggtccgcttcggcaccaaatggctcgacctcgaagcccaggcgctgcgcgacgacgagggcaacgagcatccgctgaccgcatccgagttcgggctgctcaaggtgttcgcggccaatccgaagcgcgtgctgtcgcgcgaacgtctgctcgaactggccaatgcgcgcgacgccgaagccttcgaccgcgccgtggacctgcgcatcatgcgcatccgccgcaagatcgagcccgacccggcaaaacccgccgtgatccgcaccatccgcggcggcggctatctgttctcgccggctggcgagaagacgtag

SEQ ID NO: 10942 - protein, 245 aa, Bradyrhizobium japonicum
MTQSQHIMIVDDEAPAREMVGDYLKMHGFTVTLCDGGKSLRAAIDGGMPDLVVLDLNMPEEDGLSIIRDLKSRINVPVIMLTATASPIDRVVGLELGADDYVAKPCELRELMARIRSVLRRSGPAKAAAPEAAAAKSDKDQLVRFGTKWLDLEAQALRDDEGNEHPLTASEFGLLKVFAANPKRVLSRERLLELANARDAEAFDRAVDLRIMRIRRKIEPDPAKPAVIRTIRGGGYLFSPAGEKT

SEQ ID NO: 10943 - DNA, 741 bp, Staphylococcus epidermidis; identical to SEQ ID NO: 8495
  CDS (16)..(741)

SEQ ID NO: 10944 - protein, 241 aa, Staphylococcus epidermidis; identical to SEQ ID NO: 8496

SEQ ID NO: 10945 - DNA, 720 bp, Yersinia pestis; identical to SEQ ID NO: 8499
  CDS (1)..(720)

SEQ ID NO: 10946 - protein, 239 aa, Yersinia pestis; identical to SEQ ID NO: 8500

SEQ ID NO: 10947 - DNA, 717 bp, Vibrio vulnificus
  CDS (1)..(717)
atgcaaaccccgcagattcttatcgtcgaagatgagcaagtaactcgtaacactcttaagagtatttttgaagcagagggatatgctgtatttgaagccagcaacggtgatgagatgcatcacatgctgtctgaaaatagtattaatctggtgattatggacatcaacctgcctggtaaaaacggccttcttcttgcccgtgaactccgcgagcaagccgatgttgctttgatgttcttaaccggtcgcgacaatgaagtcgacaagattcttggcttagaaatcggcgcagatgattacatcacgaagccatttaatcctcgcgaactgacgatccgtgctcgtaacctgctaagccgctctatgagcagcagtgttatgccggaagaaaaacgttcggttgagaaatacgaatttaacggttgggtgttggatatcaacagccgctcactcatcagcccatcgggtgatggctacaaactgccgcgttcagagttccgtgcattactgcacttctgtgaaaacccaggcaagatccaaactcgtgccgatcttctgaagaagatgacgggacgtgaactgaagccgcacgatcgtaccgttgacgtgaccattcgtcgcatccgtaagcactttgaatcggtatctggcacaccagaaatcatcgcaaccattcacggtgaaggctaccgtttctgtggtgatttagaagcgtaa

SEQ ID NO: 10948 - protein, 238 aa, Vibrio vulnificus
MQTPQILIVEDEQVTRNTLKSIFEAEGYAVFEASNGDEMHHMLSENSINLVIMDINLPGKNGLLLARELREQADVALMFLTGRDNEVDKILGLEIGADDYITKPFNPRELTIRARNLLSRSMSSSVMPEEKRSVEKYEFNGWVLDINSRSLISPSGDGYKLPRSEFRALLHFCENPGKIQTRADLLKKMTGRELKPHDRTVDVTIRRIRKHFESVSGTPEIIATIHGEGYRFCGDLEA

SEQ ID NO: 10949 - DNA, 729 bp, Vibrio vulnificus
  CDS (1)..(729)
atgcaggatgtaactcgaattttagtggtggacgacgatagcgaaattcgcgaactgctggatgagtatttgagccgcaacggataccaagtggccacggtggcggatgggcatcagttaaaacactaccttgcagaaaacggctatccagaattagtcctgctcgacatcatgcttcccggtgaagacggtttcagcctgtgccaatttatgcgccgtgaatcgactgtgccgatcatcatgctcacggcggtctcggaagagacagaccaaatcatcggtttggagattggtgccgatgattacattgccaagccctttaacccacgccatttggtggcgcgcatcaaagcggttttacgccgcgtgcacgtcacgcaggagaagccaagtgacacgctgccaaagcagattgtttttggtgattggcggttggatacgttagcacaccgcattgttcatcaagaaaatggccagcaacacgaactgtcaggcagtgatttcgctttgctgatgctgtttttgacccatcccgatgaaatcctcgatcgtgacaccatttcttatgccactaaggggcgtgagtcgttgccttttgagcgcggtattgatgttcaactgtcacgtttgcgtcaacgcctgggcgacagtgcacgctacccacactacatcaaaaccatgcgcggtaatggctatattttatcggtgcctgttagctacgaacattga

SEQ ID NO: 10950 - protein, 242 aa, Vibrio vulnificus
MQDVTRILVVDDDSEIRELLDEYLSRNGYQVATVADGHQLKHYLAENGYPELVLLDIMLPGEDGFSLCQFMRRESTVPIIMLTAVSEETDQIIGLEIGADDYIAKPFNPRHLVARIKAVLRRVHVTQEKPSDTLPKQIVFGDWRLDTLAHRIVHQENGQQHELSGSDFALLMLFLTHPDEILDRDTISYATKGRESLPFERGIDVQLSRLRQRLGDSARYPHYIKTMRGNGYILSVPVSYEH

SEQ ID NO: 10951 - DNA, 711 bp, Streptococcus agalactiae
  CDS (1)..(711)
atgaaaaaaatacttatcgttgatgatgaaaaaccaatttcagatattatcaaatttaatttaaccaaagaaggatatgagacggcgacagctttcgatggccgtgaagctttagtacaatatgcagaatttcaaccagatttaatcattttggatttaatgctccctgaactagatggtttagaagtggctaaagaagttcgtaaaaccagccatattcctattattatgctttctgcaaaagatagtgagtttgacaaagtcattggtttagaaatcggtgcagatgattatgttactaaacctttttcaaatcgtgaacttttggcacgggtcaaagcacatttacgacgtactgaaaatattgaaacagctgtagcagaagaaagtgctcaaaatgcttcttcggatattactattggtgagttgcaaattttaccagacgcctttattgctaagaaacgtggcgaagaaattgaattaacgcaccgagaatttgaattacttcaccatttagcgacacatatcggacaagtcatgacacgcgaacatttattggaaacagtttggggatatgattattttggagatgtccgtacagttgatgtgacggtgagacgtttacgtgaaaagattgaagatactcctggtcgtccagaatatattttgactcgacgtggtgtaggttattacatgaagtcttatgaataa

SEQ ID NO: 10952 - protein, 236 aa, Streptococcus agalactiae; identical to SEQ ID NO: 8510

SEQ ID NO: 10953 - DNA, 726 bp, Shewanella oneidensis
  CDS (1)..(726)
atgggacaagaaacctcgaaaatcctcgttgtcgatgatgatatgcgcctacgagcactcctcgagcgttacctgatggagcaaggctatcaggtacgcagtgcggccaatgctgagcagatggaccgtttactggagcgagaaaattttcatttgattgtgctcgacctcatgctgcctggggaagatggcttatctatctgccgtcgcctgcgccaacagggtagcaccattcccattgtgatgctgacggctaagggcgatgaggtcgaccgtattatcggactagaactcggtgccgatgattatttgccaaaaccgtttaacccgcgggaactattggcgcggattaaagcggtgatgcgccgccaaactcaggatgtgcccggcgcgccggcgcagcaggaagccgaaattcgctttggtgagttttccctcgatttagccacccgtgagatgtaccacggtgatgaggccatcgtgctgaccagtggcgaatttgcggtattaaaagtgttagtcacccatccacgcgaaccgttatcgcgggataaattgatgaacctcgcccgcggccgtgattattcggcgctcgagcgctcgattgacgtacaggtttcgcgcctgcgccgcttgattgaaaaagatcccgctaatccgcgctatattcaaaccgtgtggggattaggctatgtgtttgtgcccgacggtgccgcccggcgatga

SEQ ID NO: 10954 - protein, 241 aa, Shewanella oneidensis
MGQETSKILVVDDDMRLRALLERYLMEQGYQVRSAANAEQMDRLLERENFHLIVLDLMLPGEDGLSICRRLRQQGSTIPIVMLTAKGDEVDRIIGLELGADDYLPKPFNPRELLARIKAVMRRQTQDVPGAPAQQEAEIRFGEFSLDLATREMYHGDEAIVLTSGEFAVLKVLVTHPREPLSRDKLMNLARGRDYSALERSIDVQVSRLRRLIEKDPANPRYIQTVWGLGYVFVPDGAARR

SEQ ID NO: 10955 - DNA, 717 bp, Shewanella oneidensis
  CDS (1)..(717)
atgcaaaatccgcacattctgatcgttgaagatgaagccgttacccgtaacacgctaagaagtattttcgaggcagaagggtatgtggtaactgaggccaatgatggcgcagaaatgcataaggctatgcaggaaaacaaaattaacctcgtggttatggacattaacctaccaggtaaaaacggtctgttgttggcacgtgaattacgtgaaatcaacaacatcggtctgatattccttacaggccgtgacaacgaagtcgacaaaatccttggacttgaaattggcgcggacgattatattaccaagccgttcaacccgcgtgaattgacgattcgtgctcgtaatcttctgactcgtgtgaatagcgctggtaacgaagtcgaagaaaagagttctgtcgaatactatcgtttcaacgattggagcttagagatcaacagccgttctctcgtaagcccacagggtgaatcttacaaactgccacgtagcgaattccgcgctatgctgcactttgttgaaaacccaggcaaaatcttaactcgtgccgatctactgatgaagatgactggccgggagttaaagccacacgaccgtactgttgacgtgactatccgtcgtatccgtaagcactttgaaagcttgccagatacgccagaaatcatcgccaccattcacggtgaaggctaccgtttctgcggtaacttagaagactaa

SEQ ID NO: 10956 - protein, 238 aa, Shewanella oneidensis
MQNPHILIVEDEAVTRNTLRSIFEAEGYVVTEANDGAEMHKAMQENKINLVVMDINLPGKNGLLLARELREINNIGLIFLTGRDNEVDKILGLEIGADDYITKPFNPRELTIRARNLLTRVNSAGNEVEEKSSVEYYRFNDWSLEINSRSLVSPQGESYKLPRSEFRAMLHFVENPGKILTRADLLMKMTGRELKPHDRTVDVTIRRIRKHFESLPDTPEIIATIHGEGYRFCGNLED

SEQ ID NO: 10957 - DNA, 720 bp, Shewanella oneidensis; identical to SEQ ID NO: 8511
  CDS (1)..(720)

SEQ ID NO: 10958 - protein, 239 aa, Shewanella oneidensis; identical to SEQ ID NO: 8512

SEQ ID NO: 10959 - DNA, 702 bp, Oceanobacillus iheyensis; identical to SEQ ID NO: 8513
  CDS (1)..(702)

SEQ ID NO: 10960 - protein, 233 aa, Oceanobacillus iheyensis; identical to SEQ ID NO: 8514

SEQ ID NO: 10961 - DNA, 684 bp, Oceanobacillus iheyensis
  CDS (1)..(684)
atgacagttcatattggtctagttgaagatgatacaaacattcagaatatcgtttccgcgtatttaaaaaaggaaggataccaaactacaattttagataatgcggaagatggttggaaactttgggagaacaacccacctgatatgtggatattagatataatgttaccgggaatggacgggtatgaattttgcaaaaaaattcgaaatgaaagtgatgttccgattatcattatttctgcaaaagatgaagaaattgacaaaatacttgggcttgaattaggtggagatgattatttaacaaagccgtttagccctagagaattaatagctagagtgaagagattatttaaacgttcaacctcacaccgccaagatgaaatagaagaggaccgtgtaaaagttgatcagctgctagtttataaaaatgaacgtcgcgtattttttgaaggagaagaatttgaaacaacaacaaaagagtacgatatgctgctactgcttgcagaaaacccaaacagagcattctcaagagaagaactgcttatgaaaatttggggtaatgattattttggtagtgatagagcagttgatgatttaattaaacgaattcgtaaaaaaatgggcaatatcccactagaaaccgtatggggttttggatatcgcttaagaaaagatgaggaataa

SEQ ID NO: 10962 - protein, 227 aa, Oceanobacillus iheyensis
MTVHIGLVEDDTNIQNIVSAYLKKEGYQTTILDNAEDGWKLWENNPPDMWILDIMLPGMDGYEFCKKIRNESDVPIIIISAKDEEIDKILGLELGGDDYLTKPFSPRELIARVKRLFKRSTSHRQDEIEEDRVKVDQLLVYKNERRVFFEGEEFETTTKEYDMLLLLAENPNRAFSREELLMKIWGNDYFGSDRAVDDLIKRIRKKMGNIPLETVWGFGYRLRKDEE

SEQ ID NO: 10963 - DNA, 681 bp, Corynebacterium efficiens; identical to SEQ ID NO: 8521
  CDS (1)..(681)

SEQ ID NO: 10964 - protein, 226 aa, Corynebacterium efficiens; identical to SEQ ID NO: 8522

SEQ ID NO: 10965 - DNA, 699 bp, Corynebacterium efficiens; identical to SEQ ID NO: 8523
  CDS (1)..(699)

SEQ ID NO: 10966 - protein, 232 aa, Corynebacterium efficiens; identical to SEQ ID NO: 8524

SEQ ID NO: 10967 - DNA, 771 bp, Bifidobacterium longum
  CDS (1)..(771)
atggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgtcatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaa

SEQ ID NO: 10968 - protein, 256 aa, Bifidobacterium longum
MVTIMSENFAPMRTGTYPRKATMTRILIVEDEESYREPLVYQLTREGYDVSAAATGEEGLELFTKGGIDLVLLDLMLPGIDGTALCRRIREQSRVPIIMLTAKSAEIDKVVGLEIGADDYVTKPYSFRELLARIRAVMRRNQATAQASGTVDDDIPLVCGDIVMQVGQHQVTVRGETVFFPLKEFELLEYLMQNKGRVMTRHQLIDRIWGSDYVGDTKTLDVHVKRVRSKIEEDPAHPKYLTTVRGLGYKIDTPAE

SEQ ID NO: 10969 - DNA, 726 bp, Rhizobium loti
  CDS (1)..(726)
atgaaacatgttcttgtcattgacgatgatgccgcaatgcgacgcctcatctcccagtatctcatgatgcatgccttgaaggtgaccgcagtcaacgatagcaagcagtttaactacgttctatcgcatgagccagtcgatctcgtggttgttgacctcaacctaggccgggaggatgggcttgccatcgtccgcaacctggcgacaaaatcggatttacccatcatagtgatcagcggcgaccggcttgatgaggcggaaaaagtcgttgcgctggagctcggcgcaaccgatttcatccccaagcctttcgggctgcgcgagttcttggcccgcattcgagtagggctacgccagcgcatttccagtccgcgaacgaaagatcatcgctcatttcggttcggagcctggaagctcagcgtcaagcagcggcgactgatctgtgcggagcgtggcgaagtcaagcttaccgcatgtgagttcaacctgctgatcgcgttcctggagaacccccgcaatgtcctatccagagaacggcttttgctcgcgagccgtgtgcgtggagaagaggtctacgatcgaagtatcgatgtcctaatcttgcgcttgcgccgaaagctggaggctgatgcggccaatccaaggctagtcaagacatgccgtggtgcagggtatttcttcaacgctgacgtagacgttagctacggaggcaccttggccgcctga

SEQ ID NO: 10970 - protein, 241 aa, Rhizobium loti
MKHVLVIDDDAAMRRLISQYLMMHALKVTAVNDSKQFNYVLSHEPVDLVVVDLNLGREDGLAIVRNLATKSDLPIIVISGDRLDEAEKVVALELGATDFIPKPFGLREFLARIRVGLRQRISSPRTKDHRSFRFGAWKLSVKQRRLICAERGEVKLTACEFNLLIAFLENPRNVLSRERLLLASRVRGEEVYDRSIDVLILRLRRKLEADAANPRLVKTCRGAGYFFNADVDVSYGGTLAA

SEQ ID NO: 10971 - DNA, 681 bp, Corynebacterium glutamicum
  CDS (1)..(681)
atgtcacagaaaattctcgtggttgatgatgatcccgccatctccgagatgctcaccatcgtgctcagcgcagaaggctttgacaccgtagctgtcaccgacggcgcactcgccgtggaaaccgcctcccgggaacaaccggatctgattttgctcgacttgatgcttccaggcatgaacggcatcgacatttgtcgcctcatccgccaagaatcctccgtacccatcatcatgctcaccgccaaaaccgacaccgttgatgtggtgctcggtttggaatccggtgcagacgattacgtgaacaagcctttcaaagcgaaagaacttgtcgcccgcatccgtgcccgcctccgcgcaaccgtggacgagcccagcgaaatcatcgaagtcggcgatctgtccatcgacgtcccagcacacaccgtcaaacgaaacggcgctgagatttccttgaccccactcgaattcgacctcctgctggaactcgcccgcaaaccacagcaagtattcacccgtgaagaattgctgggcaaagtgtggggctaccgccacgcatccgacactcgactggtcaacgttcacgttcagcgtctgcgcgccaagattgaaaaagatccagaaaatccgcagatcgtcctcaccgtccgcggtgttggctacaaaactggccacaacgattaa

SEQ ID NO: 10972 - protein, 226 aa, Corynebacterium glutamicum; identical to SEQ ID NO: 8536

SEQ ID NO: 10973 - DNA, 699 bp, Corynebacterium glutamicum
  CDS (1)..(699)
atgacgagaatcctgatcgttgaagatgaggaatcgttagcagatcctttggcctttcttcttcgcaaagaaggttttgacaccatcatcgccggtgatggcccaaccgcacttgtggagttcagtcgcaacgaaatcgacatcgtcctcttagacctcatgctcccaggcatgtctggcaccgacgtatgcaaagaactccgcagcgtatccactgttcccgtcatcatggtcaccgcccgcgactccgagatcgacaaagttgttggcctcgaactcggcgccgatgattatgtaaccaagccatattcttcccgcgaactcatcgcccgcatccgcgctgtcctgcgccgacgcggagttactgaaaccgaagccgaagaattaccacttgacgatcaaatcctcgaaggcggccgcgtccgcatggacgtcgattcccacaccgtcaccgtcggtggcgaaccagtgagcatgccactgaaggaattcgaccttctggagtacctcctccgaaacgccggccgagtcctcacccgcggacagctcatcgaccgaatttggggcgcagattacgtcggcgacaccaaaaccctcgacgttcatgtcaaaaggttgcgttccaagatcgaagaagagccatctcgccctcgttacctcgtgaccgtgcgtggattgggctacaaattcgagctgtag

SEQ ID NO: 10974 - protein, 232 aa, Corynebacterium glutamicum
MTRILIVEDEESLADPLAFLLRKEGFDTIIAGDGPTALVEFSRNEIDIVLLDLMLPGMSGTDVCKELRSVSTVPVIMVTARDSEIDKVVGLELGADDYVTKPYSSRELIARIRAVLRRRGVTETEAEELPLDDQILEGGRVRMDVDSHTVTVGGEPVSMPLKEFDLLEYLLRNAGRVLTRGQLIDRIWGADYVGDTKTLDVHVKRLRSKIEEEPSRPRYLVTVRGLGYKFEL

SEQ ID NO: 10975 - DNA, 720 bp, Xanthomonas campestris
  CDS (1)..(720)
atggacatgcaacaaccctgcgttcttgtggtcgacgacgaccccgacctgcgcaagctgatcggcgagttcctgagcgcccatggctaccaggtggatgtggccgagaatgtcgccgaaatgcgcaagcgcatcacacaacggcgtccggacctcatcgtactcgacgtgatgatgccgggagaagacgggctgagtgcggcgcgttcgctggccagcgaacgcggctcgcctgcggtgatcatgctgagcgcgctgggcaatgatacagaccgcatcatcgggctggaggttggcgccgacgattacctggccaaaccctgcaacccgcgcgagctgctggcgcgggtgcgcgccctgctgcgccgcagccaggtcaccagcgaccaggccgagccgcgcggcaatgtctacgagttcgccggttggcggctggacgtggtgcggcgcgacctgcgcgaccccaccggtatcttcatcaacctctccgacggcgaattcgccctgctgcgcaccttcgtggagcatccgcaacgcgtgctgagccgcgaccaactgctcgactacgcgcgcggccgcgataccgacgtctatgaccgcgccatcgacagccagatcagccggctgcgccgcaagatcaacgaacgcgtgcacaccgagctgattcgcaccgtgcgcaacgagggctacatgctgctgccgagcgtcgcgcgtctgtga

SEQ ID NO: 10976 - protein, 239 aa, Xanthomonas campestris
MDMQQPCVLVVDDDPDLRKLIGEFLSAHGYQVDVAENVAEMRKRITQRRPDLIVLDVMMPGEDGLSAARSLASERGSPAVIMLSALGNDTDRIIGLEVGADDYLAKPCNPRELLARVRALLRRSQVTSDQAEPRGNVYEFAGWRLDVVRRDLRDPTGIFINLSDGEFALLRTFVEHPQRVLSRDQLLDYARGRDTDVYDRAIDSQISRLRRKINERVHTELIRTVRNEGYMLLPSVARL

SEQ ID NO: 10977 - DNA, 720 bp, Xanthomonas axonopodis
  CDS (1)..(720)
atggacctgcaacaaccctgcgttctcgtggtcgacgacgacccggacctgcgcaagctgatcggcgaatttctgagcgcccacggctaccaggtggatatggccgaaaacgtggcggagatgcgctctgtcatggcgcagcgccgcccggacctcatcgtactcgacgtgatgatgccgggagaagatgggctgagtgcagcgcgcgccctggccagcgagcgcggttcacctgcggtcatcatgctcagcgcgctgggtaacgacaccgaccgcatcatcggcctggaagtcggcgccgacgattacctcgccaagccctgcaatccgcgcgaattgctggcgcgtgtgcgcgccctgctgcggcgcagccaggccagcaacgaacaggccgaccagcgcggaaacgtctacgaattcgccggctggcggctggacgtggtacgccgcgacctgcgcgaccctaccggcatcttcatcaatctgtccgacggcgagttcgcgctgctgcgcaccttcgtcgaacacccgcagcgcgtgctcagccgcgaccagttgctggactacgcccgtggccgcgacaccgacgtctacgaccgcgccatcgacagccagatcagccgcctgcgccgcaaaatcaatgagcgcgtccataccgaattgattcgcaccgtacgcaacgagggctacatgctgctgccgagcgtctcgcgcctgtga

SEQ ID NO: 10978 - protein, 239 aa, Xanthomonas axonopodis
MDLQQPCVLVVDDDPDLRKLIGEFLSAHGYQVDMAENVAEMRSVMAQRRPDLIVLDVMMPGEDGLSAARALASERGSPAVIMLSALGNDTDRIIGLEVGADDYLAKPCNPRELLARVRALLRRSQASNEQADQRGNVYEFAGWRLDVVRRDLRDPTGIFINLSDGEFALLRTFVEHPQRVLSRDQLLDYARGRDTDVYDRAIDSQISRLRRKINERVHTELIRTVRNEGYMLLPSVSRL

SEQ ID NO: 10979 - DNA, 696 bp, Thermoanaerobacter tengcongensis; identical to SEQ ID NO: 8545
  CDS (1)..(696)

SEQ ID NO: 10980 - protein, 231 aa, Thermoanaerobacter tengcongensis; identical to SEQ ID NO: 8546

SEQ ID NO: 10981 - DNA, 696 bp, Thermoanaerobacter tengcongensis; identical to SEQ ID NO: 8549
  CDS (1)..(696)

SEQ ID NO: 10982 - protein, 231 aa, Thermoanaerobacter tengcongensis; identical to SEQ ID NO: 8550

SEQ ID NO: 10983 - DNA, 723 bp, Thermoanaerobacter tengcongensis; identical to SEQ ID NO: 8551
  CDS (1)..(723)

SEQ ID NO: 10984 - protein, 240 aa, Thermoanaerobacter tengcongensis; identical to SEQ ID NO: 8552

SEQ ID NO: 10985 - DNA, 678 bp, Thermoanaerobacter tengcongensis
  CDS (1)..(678)
atggagagattgcttatcatagatgacgaagaaatgtttgttaagggattgaaactttctttagaagaggaaggatttgaagtggatgcggcttacgatggggaggaggggcttgaaaaggtcagaataggaaattacgacctggttattcttgatataatgcttcctaaaatggatggtttctcagtttgtagagaaataaggactttttcaaacattccaataataatgcttactgcaaggggagacgatgtggatagaattgtcgggatagaaataggagcagatgactatctagcaaagcctttcaatactcgagagttgattgcaagaattagggctcttttaagaagagcgtcaaatccctatgtgaagaaaaaagaagagataagaaggggagatttgtatattaacattcctgagagggcagtttacaaaagaggtaaaaagattgagctcacaaataaggagtttgaaatactagtgcttttagcttctaatcccggcaaagtgtacacaaaggataagcttttagatctcatatggggtgttgatttttatggcgatgcgaacacagtgacagtgcatgtgaggaagctcagggaaaaattagaggatgaccctgctaatccccagtacatttttaccaaatggggagcgggatattacatgaaatag

SEQ ID NO: 10986 - protein, 225 aa, Thermoanaerobacter tengcongensis
MERLLIIDDEEMFVKGLKLSLEEEGFEVDAAYDGEEGLEKVRIGNYDLVILDIMLPKMDGFSVCREIRTFSNIPIIMLTARGDDVDRIVGIEIGADDYLAKPFNTRELIARIRALLRRASNPYVKKKEEIRRGDLYINIPERAVYKRGKKIELTNKEFEILVLLASNPGKVYTKDKLLDLIWGVDFYGDANTVTVHVRKLREKLEDDPANPQYIFTKWGAGYYMK

SEQ ID NO: 10987 - DNA, 726 bp, Agrobacterium tumefaciens
  CDS (1)..(726)
atgaaacatattcttgtaatcgatgacgatgccgcgatgcgccatcttatcaaagaatatttaaccgttcacgcattacgggtcactgcggtatcagatagccagcaattcacccgcgtacttgcatccgagacagtcgatgtcgttgtcgtggatctcaatttagggcgtgaagacggactcgagatcgttcgcagtctggctacaaaatctgatgttccaattataatcatcagcggtgatcgccttgacgaggcggataaagttgtcgcgctcgagctaggagcatcagactttatagcaaaacctttcggaacgcgcgagttcctagcacgcatacgtgtggcattgcgcgagcgaccgaatgtcatgcgaaccaaagaccggcgcacgttttgtttcgctggctggacactgagtctcagacaacgccgtctaacatctacacaaggtggcgatgtgaaacttaccgccggggagttcaatcttctcgttgctttcctcgaaaagcctcgcgacgtgctatcccgagagcagctcctgattgcgagccgagttcgcgaggaggaagtatatgacagaagcatcgacgttctcattttgaggcttcgccgaaagcttgaggaggatgctgcgaaccctcacttgatcaaaacggccaggggcgccggctatttcttcgatgctgatgtcaatatttcctttggaggcatgatggcggcctga

SEQ ID NO: 10988 - protein, 241 aa, Agrobacterium tumefaciens
MKHILVIDDDAAMRHLIKEYLTVHALRVTAVSDSQQFTRVLASETVDVVVVDLNLGREDGLEIVRSLATKSDVPIIIISGDRLDEADKVVALELGASDFIAKPFGTREFLARIRVALRERPNVMRTKDRRTFCFAGWTLSLRQRRLTSTQGGDVKLTAGEFNLLVAFLEKPRDVLSREQLLIASRVREEEVYDRSIDVLILRLRRKLEEDAANPHLIKTARGAGYFFDADVNISFGGMMAA

SEQ ID NO: 10989 - DNA, 765 bp, Listeria monocytogenes; identical to SEQ ID NO: 8559
  CDS (41)..(754)

SEQ ID NO: 10990 - protein, 237 aa, Listeria monocytogenes; identical to SEQ ID NO: 8560

SEQ ID NO: 10991 - DNA, 687 bp, Clostridium perfringens; identical to SEQ ID NO: 8561
  CDS (1)..(687)

SEQ ID NO: 10992 - protein, 228 aa, Clostridium perfringens; identical to SEQ ID NO: 8562

SEQ ID NO: 10993 - DNA, 696 bp, Clostridium perfringens; identical to SEQ ID NO: 8565
  CDS (1)..(696)

SEQ ID NO: 10994 - protein, 231 aa, Clostridium perfringens; identical to SEQ ID NO: 8566

SEQ ID NO: 10995 - DNA, 705 bp, Clostridium perfringens
  CDS (1)..(705)
atggaaaagtataatgttttagttgttgaagacgaaaaggaaatagcagaggctattgaaatatatctaaaaaatcaaggatacaatgtatttaaaggaagtaatggtttagaaggattagaaatagttgaaaaggaagaggttcatttagctgttgttgacataatgatgcctaaaatggatggagctacaatggtaatgaaaattagagaaagttatgactttcctataataatgttatcagcaaaatcagaggatatggataaaattttaggacttaatattggagctgatgattatgtgacaaaaccatttaatccattagaacttcttgcaagagttaattctcaattaagaagatattctaaatacttaaacatggtgaaaaaggatgagaagaaaacaaattcttattccataggtggattagaggttaatagtgatagaaaagaagtaatattagatggagatgtagtaaaagtaactcctatagaatttaaaatacttcaattacttattaagagtccaggaagagttttttcagcagaagaaatatatgaaagagtatggaatgaaaatgcagtaaacacagacactgtaatggtccatgtaagaaatataagagaaaaaatagagatagatccaaaaaatccaaaatatttaaaggtggtgtggggagttggctataaaatcgaaaagcaataa

SEQ ID NO: 10996 - protein, 234 aa, Clostridium perfringens
MEKYNVLVVEDEKEIAEAIEIYLKNQGYNVFKGSNGLEGLEIVEKEEVHLAVVDIMMPKMDGATMVMKIRESYDFPIIMLSAKSEDMDKILGLNIGADDYVTKPFNPLELLARVNSQLRRYSKYLNMVKKDEKKTNSYSIGGLEVNSDRKEVILDGDVVKVTPIEFKILQLLIKSPGRVFSAEEIYERVWNENAVNTDTVMVHVRNIREKIEIDPKNPKYLKVVWGVGYKIEKQ

SEQ ID NO: 10997 - DNA, 660 bp, Ralstonia solanacearum; identical to SEQ ID NO: 8569
  CDS (1)..(660)

SEQ ID NO: 10998 - protein, 219 aa, Ralstonia solanacearum; identical to SEQ ID NO: 8570

SEQ ID NO: 10999 - DNA, 723 bp, Ralstonia solanacearum
  CDS (1)..(723)
atggaaaattccggtcacaagattctcgtcgtcgacgacgatccccgcctgcgcgacctgctgcgccgctaccttggggaacagggcttcaccgtgctggtggcggaaaacgccacggccatgaacaaactctggctgcgcgagcgcttcgacctgctggtgctcgacctgatgatgccgggcgaagacggcctgtcgatctgccgacgcctgcggggcgccaacgaccagacaccgatcatcatgctcaccgccaagggcgaggacgtggaccgcatcgtcggcctggagatgggcgccgacgactacctgcccaagccgttcaacccgcgcgagctgatcgcccgcatccatgccgtgctgcgccgccgcggtccggccgagattcccggcgccccgtcggagacgcccgagaccttcgccttcggcgacttcgtgctgaacctggccacccgcacgctcaagaagaacgacgaggaaatcaccctcaccacgggcgaattctccgtgctcaaggtgttcgcgcgccacccgcgccagccgctgtcgcgcgagaagctgatggagatggcgcgcggccgcgagtacgaggtcttcgaccgcagcctggacgtgcagatctcgcgcctgcgcaagctgatcgagccggacgcgagcaacccgcgcttcatccagacggtctggggcctgggctacgtgttcatcccggacggcgccaagtaa

SEQ ID NO: 11000 - protein, 240 aa, Ralstonia solanacearum
MENSGHKILVVDDDPRLRDLLRRYLGEQGFTVLVAENATAMNKLWLRERFDLLVLDLMMPGEDGLSICRRLRGANDQTPIIMLTAKGEDVDRIVGLEMGADDYLPKPFNPRELIARIHAVLRRRGPAEIPGAPSETPETFAFGDFVLNLATRTLKKNDEEITLTTGEFSVLKVFARHPRQPLSREKLMEMARGREYEVFDRSLDVQISRLRKLIEPDASNPRFIQTVWGLGYVFIPDGAK

SEQ ID NO: 11001 - DNA, 693 bp, Salmonella typhimurium
  CDS (1)..(693)
atgtcacatcacattgttattgttgaggatgaacctgttactcaggccagattacaggcctattttgagcaggaggggtatcgcgtttcggtgaccgacagcggcgcgggcctgcgtgacatcatggagcatgagcacgtttcgctgatcctgctggatatcaacctccccgatgaaaacgggttgatgctgaccagggcgctacgcgaacgttccacggtgggcattattctggtgacggggcgttgcgaccaaatcgaccgcatcgtcgggctggagatgggcgcggacgactacgtcaccaagccgctggaactgcgcgagctggtagtgcgggtaaaaaatcttttgtggcgtatcgatctggcccgccccacgccgcaaaatgccagtgaaaactgctatatgttttccggctactgcctgaacgtgatgaatcacacgctggagcacaacggtgaagccattaagcttacgcgcgcggagtacgagctactgctggcctttgtgaccaacccaggcaaagtgctgcatcgcgaacgtctgctgcgaatgctttccgcccgccgcgtagagactccggatctccgcacgattgatgtcctggttcgccgcttacgtcataaaattacgccggaactgctggtcacacagcatggcgaaggctactttttagcctcggaggtgtattga

SEQ ID NO: 11002 - protein, 230 aa, Salmonella typhimurium
MSHHIVIVEDEPVTQARLQAYFEQEGYRVSVTDSGAGLRDIMEHEHVSLILLDINLPDENGLMLTRALRERSTVGIILVTGRCDQIDRIVGLEMGADDYVTKPLELRELVVRVKNLLWRIDLARPTPQNASENCYMFSGYCLNVMNHTLEHNGEAIKLTRAEYELLLAFVTNPGKVLHRERLLRMLSARRVETPDLRTIDVLVRRLRHKITPELLVTQHGEGYFLASEVY

SEQ ID NO: 11003 - DNA, 690 bp, Enterococcus faecalis
  CDS (1)..(690)
atggctaaaatactaattttagatgatgaaaaagagattgtaagtcttctaagtacgctactttctaacgaaggatatgaggtttatgaggctatgtcaggaaaagaaagcttggagattatagaaaataacaagatcgatttagccatactagatgtcatgcttcccgatatttccggttttgatgtattgcaaagcattagagaaaaacaattttttcctgtgttgatgctaactgctcgaggtcaggatatggataaaattactggactgtctatgggggcagatgactatattgttaagccgttcaatccttttgaagtgttggctagagtgaaaacacagctacgtagatatcaaacgtataattctcaaagtatagatgaaacaaatgaatatgcaaaaaatggattaaatatatctgtcaacagtcgaaaagtattcttatatgatgaagaaattaaattaacgcctattgaatttgatatcttgtggtatttgtgtagaaatgaaggtcgcgtaatatcgtcagaagagttatttgaaaaagtctggaaagaagactatctagagaataataatactgttatggcgcatattgctaaaattagagaaaagatgcatgaaaagccgagacagccaaatattataaaaacggtatggggagtaggttatacaattgaaaaataa

SEQ ID NO: 11004 - protein, 229 aa, Enterococcus faecalis
MAKILILDDEKEIVSLLSTLLSNEGYEVYEAMSGKESLEIIENNKIDLAILDVMLPDISGFDVLQSIREKQFFPVLMLTARGQDMDKITGLSMGADDYIVKPFNPFEVLARVKTQLRRYQTYNSQSIDETNEYAKNGLNISVNSRKVFLYDEEIKLTPIEFDILWYLCRNEGRVISSEELFEKVWKEDYLENNNTVMAHIAKIREKMHEKPRQPNIIKTVWGVGYTIEK

SEQ ID NO: 11005 - DNA, 708 bp, Streptococcus mutans
  CDS (1)..(708)
atgaagaaaattctaatcgttgacgatgaaaaaccaatttctgatatcatcaagtttaacttggctaaggaaggttatgacacgattacagcctttgatgggcgtgaagcattaagtaaatatgaagaagaaaatcctgacttgattatattggacttaatgttaccagaactagacggtcttgaagtggctaaggaagttagaaaaaacagccatgttccaattattatgttatcagctaaagacagtgagtttgataaggttattggtcttgaaattggtgctgatgattatgtgactaaacctttttctaatcgtgaattactggcgcgtgtaaaagcgcatcttcgccgtactgaaaatattgaatccgcagtggctgaggaaaatgcttcaggtatacctgaaattattattggggacttgcaaatcttaccagatgcttttgttgctaaaaaacgtggaacagaggtagagttaactcaccgtgagtttgagctgttgcatcacttagcgacacacacaggtcaggtgatgacgcgtgaacatttacttgaaacggtttggggctatgattattttggagatgtccgtactgttgatgttactgttcgtcgtctgcgtgaaaaaattgaagatacacctagtcgtccagagtacattttgacgcgacgcggtgttggttattacatgaaatcatatgactaa

SEQ ID NO: 11006 - protein, 235 aa, Streptococcus mutans
MKKILIVDDEKPISDIIKFNLAKEGYDTITAFDGREALSKYEEENPDLIILDLMLPELDGLEVAKEVRKNSHVPIIMLSAKDSEFDKVIGLEIGADDYVTKPFSNRELLARVKAHLRRTENIESAVAEENASGIPEIIIGDLQILPDAFVAKKRGTEVELTHREFELLHHLATHTGQVMTREHLLETVWGYDYFGDVRTVDVTVRRLREKIEDTPSRPEYILTRRGVGYYMKSYD

SEQ ID NO: 11007 - DNA, 702 bp, Rhizobium loti
  CDS (1)..(702)
atggcaacaatcgcgcttgtcgatgacgaccgcaacattctgacgtcggtgtcgatcgccctcgaatccgagggatatcgcgtcgagacctacacggatggtgcgtccgcgctggaaggcctggcggcgcgtccgccgaatcttgccatcctcgacatcaagatgccgcgcatggacggcatggagctcttgcgccggatgcgccagaagtccgacctgccggtgatcttcctgacctccaaggacgacgagatcgatgaattgttcggcctcaagatgggcgccgacgatttcatccgcaaaccgttctcgcagcgcctgcttgtcgagcgggtgcgcgccgttctgcgccgcgccagcgcccgcgaggctgcggcaaaggcgcccagccagcaggcccgctcgctcgagcgcggccagctcgtcatggaccaggagcgccacacctgcacctggaagggcgaaccggtgacgctcaccgtcaccgaattcctgatcctgcattcgctggcgcagcgtcccggtgtcgtaaaaagccgtgatgcgctgatggattcggcctatgatgagcaggtctatgtcgatgaccgcacgatcgacagccacatcaagcggctgcgcaagaagttcaaggctgtcgacgacgacttcgagatgatcgaaaccctttacggcgtgggatatcggttccgagaagcgtga

SEQ ID NO: 11008 - protein, 233 aa, Rhizobium loti
MATIALVDDDRNILTSVSIALESEGYRVETYTDGASALEGLAARPPNLAILDIKMPRMDGMELLRRMRQKSDLPVIFLTSKDDEIDELFGLKMGADDFIRKPFSQRLLVERVRAVLRRASAREAAAKAPSQQARSLERGQLVMDQERHTCTWKGEPVTLTVTEFLILHSLAQRPGVVKSRDALMDSAYDEQVYVDDRTIDSHIKRLRKKFKAVDDDFEMIETLYGVGYRFREA

SEQ ID NO: 11009 - DNA, 726 bp, Rhizobium loti
  CDS (1)..(726)
atgcgggcaagaatagtgatcgtcgaggacgagcccgacctgagggacgcggttgccgaatatctcggcgccgccggctatgatgtggcgaccgccgaaacggccgccgccgcgcgcagcctgatcgagacccaagccttccatctggccattctcgacatcgccatgcccggcgaggacgggctgtcgctcggccgctggctgcgctcgagaatgccgatcggcatcatctacgcgaccgccgccggcacggcgctcgaccgcatcgtcgggctggagctcggagccgacgactatatcgtcaagccatacgaactgcgcgaagtgctggcgagggtgcgcagcgtgctgcggcgcgttccgcagccgaccgaactgctcgacaggaagaccaggacggaccgccgttccgtcaccttcggcccgttccaggccgatctcgacggcaggctggtcaccggcgccaacggcaccgtgatcgacatggccaagagcgaattcgacgtgctggaggttttcctgacccgcgccaaccggctgctgacccgcgccgcgatctcggaggcgatcggcttcaccgaggatccggaatcgtcgcgcgccgtcgacatccgcatcatgcgcctgcgcaagaaaatcgaggccgatccggccaacccgaaattcctgcgcacggtgcgcggcgaaggctatatcttctcgctgccgaccggcgacagcaactga

SEQ ID NO: 11010 - protein, 241 aa, Rhizobium loti
MRARIVIVEDEPDLRDAVAEYLGAAGYDVATAETAAAARSLIETQAFHLAILDIAMPGEDGLSLGRWLRSRMPIGIIYATAAGTALDRIVGLELGADDYIVKPYELREVLARVRSVLRRVPQPTELLDRKTRTDRRSVTFGPFQADLDGRLVTGANGTVIDMAKSEFDVLEVFLTRANRLLTRAAISEAIGFTEDPESSRAVDIRIMRLRKKIEADPANPKFLRTVRGEGYIFSLPTGDSN

SEQ ID NO: 11011 - DNA, 717 bp, Rhizobium loti
  CDS (1)..(717)
atgaaatccgacgcacacatactgatcgtcgacgacgacaagggcatccgcgacctgcttcaggaattcttccagaagcgggggctgcacacttcggttgccgcggacggtaccgagatggaggccgtcctgcgccgcgcgcaggtggacctcatcgtgctcgacgtgatgttgcccggcaagagcgggctggaactgtgccgcgatctgcgcgcccagtactcgacgccgatcatcatgctgaccgccgtcaccgagaccaccgaccgcgtcgtcggcctggaaatgggcgccgacgactatgtgcccaagcccttcgatccgcgcgaactcctggcgcgcatccgtgccgtgctgcggcgcaatggtgccgccgagccgaagcgcgccaccgccaagcagatctaccgtttcgccggctggacgatggactgttcgcggcgccggctgacggcgcccgacgatgtcagggtcgagctcaccatggccgaattcaacctgctgcagaccttcgtcaagagcgcccagcgcgtgctgacccgcgaccagctcatcgaactctccggcggcgacagcgactattccttcgaccgcagcatcgacatcctggtcagccggctgcggcgcaagatggaagatgacccaaaaacgccgaaactgatcctgacggtgcgcagcggcggctaccagttcctgcccgagacgacctccgaatga

SEQ ID NO: 11012 - protein, 238 aa, Rhizobium loti
MKSDAHILIVDDDKGIRDLLQEFFQKRGLHTSVAADGTEMEAVLRRAQVDLIVLDVMLPGKSGLELCRDLRAQYSTPIIMLTAVTETTDRVVGLEMGADDYVPKPFDPRELLARIRAVLRRNGAAEPKRATAKQIYRFAGWTMDCSRRRLTAPDDVRVELTMAEFNLLQTFVKSAQRVLTRDQLIELSGGDSDYSFDRSIDILVSRLRRKMEDDPKTPKLILTVRSGGYQFLPETTSE

SEQ ID NO: 11013 - DNA, 768 bp, Rhizobium loti
  CDS (1)..(768)
atgcaggctgcggcaagctccggccggatcgatctgaacgccgagttcaaatcggcgaggcaaggcccgcatatcctcattgtcgaagacgatatcgagatcgcgcggatgctgggcgagacgctcactgaaaacggcatgatcgtcgaaatcgccggcaacggcgcccgcatgaacgccgcgcttcgcaaccagaaattcgatctcatcgtgctcgatatcatgctgcctggcgagaacggcctcagcatctgccgccggctccgtgcgcacacgaacgttccgatcctgatgctgaccgcgcttggcgaggaaatcgaccgcatcttcggactggaaatcggcgccgacgactacgtgaccaaaccgttcagcgcgcgcgaactgacggcaaggataagggcgctgctgcgccgcacggcctacgctcccgacgaacgggaccggacaaaggtgcttcgcttcaacggctggcgcctcgatcccgttcgccggcaattgcatgatcccagcaatgcgcgggttgcgaccacgacgcatgaattcgatcttctgctggcgttttgccgcaatgcgggccgggttctgtcgcgcgaggagcttctcagcgtcacccatgccgggcttgccgggccgatcgagcgaagcgtcgatgtccatgtcagccggatccgccagaagatcgaaaaggatgcgcgcgatccggttcttctcaaaactgtccggctgggtggctatatcttcaccgccacggtggaggaagcgtga

SEQ ID NO: 11014 - protein, 255 aa, Rhizobium loti
MQAAASSGRIDLNAEFKSARQGPHILIVEDDIEIARMLGETLTENGMIVEIAGNGARMNAALRNQKFDLIVLDIMLPGENGLSICRRLRAHTNVPILMLTALGEEIDRIFGLEIGADDYVTKPFSARELTARIRALLRRTAYAPDERDRTKVLRFNGWRLDPVRRQLHDPSNARVATTTHEFDLLLAFCRNAGRVLSREELLSVTHAGLAGPIERSVDVHVSRIRQKIEKDARDPVLLKTVRLGGYIFTATVEEA

SEQ ID NO: 11015 - DNA, 711 bp, Streptococcus pyogenes
  CDS (1)..(711)
atgaaaaaaatacttattgtggatgatgaaaaaccgatttctgacattattaagtttaatttgacaaaagaaggttatgacattgttacagcttttgatggacgcgaagcggtaacaatttttgaagaagaaaagccagatttaattattcttgatttgatgctccctgagttggacggtcttgaagtagccaaggaaattcgtaaaaccagtcatgtcccgattattatgttgtcggctaaagatagtgagtttgacaaggttattggacttgaaattggggctgatgattacgtgaccaagcccttttctaatcgggaattgctggcgcgtgtcaaggctcatctgcgtcgtaccgaaactattgaaacggctgttgcagaagaaaatgcttcttcaggtacacaggaactgaccattggtaatttacagattttaccagatgcgtttgttgctaaaaaacatggtcaagaggtagagttgacccatcgtgaatttgaactattgcatcatctagctaaccatatggggcaggtgatgacacgagaacacttattggaaattgtttggggatatgattattttggcgatgtgcgcacggttgatgtgactgttcgtcgcctccgtgaaaaaattgaagacacaccaagtcgtcctgagtatattttaacaagacgtggtgttgggtactacatgaaatcttatgactag

SEQ ID NO: 11016 - protein, 236 aa, Streptococcus pyogenes
MKKILIVDDEKPISDIIKFNLTKEGYDIVTAFDGREAVTIFEEEKPDLIILDLMLPELDGLEVAKEIRKTSHVPIIMLSAKDSEFDKVIGLEIGADDYVTKPFSNRELLARVKAHLRRTETIETAVAEENASSGTQELTIGNLQILPDAFVAKKHGQEVELTHREFELLHHLANHMGQVMTREHLLEIVWGYDYFGDVRTVDVTVRRLREKIEDTPSRPEYILTRRGVGYYMKSYD

SEQ ID NO: 11017 - DNA, 708 bp, Streptococcus thermophilus; identical to SEQ ID NO: 8581
  CDS (1)..(708)

SEQ ID NO: 11018 - protein, 235 aa, Streptococcus thermophilus; identical to SEQ ID NO: 8582

SEQ ID NO: 11019 - DNA, 732 bp, Pasteurella multocida
  CDS (1)..(732)
atggatatacaaatgcaacaaaatacttctcttcttgtcattgatgatgatgttcaagtttgtgaattgcttaccgatatttttgaggaacatggctatactgttatgacggctcaaaccggtcagcaagcgttagctttgttgcaatcgactccgcacttttcattaatttttcttgatttaattctgcctgatgtaaatggattaattctcttacagcgtttaaaaagcctgaccactgcccctgtgattatgttaagtgggctagattctgaatccgatattgttgttggcttagaaatgggtgctgatgactacatctccaaacccttttatcctcgcgtggtcgttgcaagagcgaaagtcgcgttacgtcgccatcagccacaacctttttcaactagcgcctcacatcaaggttttacttttcatcattgggtgctagatacacaaaatcggaaattatattcgccacaaaaagtggatattgagctgacgcaaggagaatacaccttattacacgccttagtttctcatgcacaaaaagttctttctcgtgaaaagttacttgaactgacacacacggaaagcttagaaatttttgaccgcactgtcgatgtgctcattatgcggttacgtaaaaaaattgagcctaaccccaaggcaccaacctatattcaaactgttcgcggcatgggttatttatttgccgtcgcggttgagcgctgttaa

SEQ ID NO: 11020 - protein, 243 aa, Pasteurella multocida
MDIQMQQNTSLLVIDDDVQVCELLTDIFEEHGYTVMTAQTGQQALALLQSTPHFSLIFLDLILPDVNGLILLQRLKSLTTAPVIMLSGLDSESDIVVGLEMGADDYISKPFYPRVVVARAKVALRRHQPQPFSTSASHQGFTFHHWVLDTQNRKLYSPQKVDIELTQGEYTLLHALVSHAQKVLSREKLLELTHTESLEIFDRTVDVLIMRLRKKIEPNPKAPTYIQTVRGMGYLFAVAVERC

SEQ ID NO: 11021 - DNA, 711 bp, Pasteurella multocida
  CDS (1)..(711)
atgggaacgccacaaattttaattgttgaagacgaagcaatcaccagaaataccttaaaaagtatttttgaggcggagggttatgaagtatttgaggcggcagacggcgcacagatgcaccgtattctgtctaataaagtgattaatcttgtcattatggatatcaacttacccggtaagaatggacttatgcttgcccgcgaactacgagaaacgaccaataccgcattaatgtttttaactggtcgcgataatgaagtggataaaattcttggtctagaaatcggtgcggatgattacatcacaaaaccattcaatccaagagaattaaccattcgtgcacgaaatttattacaacgcacgatgcaagaaaatagtaaagatagccatcatcctattgagcaatatcgctttaatggctggacactagacttaaatagccgcacgttaattaatccagaaggggaagaatataaacttccacgcagtgaattccgtgcgatgttacatttctgtgaaaacccaggcaaaattcaaacccgtgaagaattattgaagaaaatgacgggacgtgaattaaagccacaagatcggacagtagatgtcactattcgtcgtattcgcaaacattttgaagatcatccagaaaccccagaaattatcgccacgatccatggtgaaggttatcgtttctgtggtgaattggaataa

SEQ ID NO: 11022 - protein, 236 aa, Pasteurella multocida
MGTPQILIVEDEAITRNTLKSIFEAEGYEVFEAADGAQMHRILSNKVINLVIMDINLPGKNGLMLARELRETTNTALMFLTGRDNEVDKILGLEIGADDYITKPFNPRELTIRARNLLQRTMQENSKDSHHPIEQYRFNGWTLDLNSRTLINPEGEEYKLPRSEFRAMLHFCENPGKIQTREELLKKMTGRELKPQDRTVDVTIRRIRKHFEDHPETPEIIATIHGEGYRFCGELE

SEQ ID NO: 11023 - DNA, 771 bp, Streptomyces coelicolor; identical to SEQ ID NO: 8591
  CDS (1)..(771)

SEQ ID NO: 11024 - protein, 256 aa, Streptomyces coelicolor; identical to SEQ ID NO: 8592

SEQ ID NO: 11025 - DNA, 723 bp, Bacillus sp
  CDS (1)..(723)
atgacgttagaagagaacaaaatcctcatggtggatgatgacgaacatatcttaaacttattaataacttgctttgaaaaggaaggtttcagcaatatttccacagctatgacagggagcgaaacccttctgaaaatcgatcaggaacttccaaatattattttattagatgtcatgcttccggacactgatggcttcaccttatgcagcaaaatacgctcgcatacaaatgtgccgatactcttcttaacggcaaaaacaacagatttagataaattgcaagggtttagttttgggggagatgactatattactaaaccatttaatccactagaaattgtagctcgtgtaaaagcccaattaaagagaacgactcaactctcttcttcttaccctctaaaacaggtatacgattatgaatattttaaaatagatcccaataccggaagacttgttgttaacgggacaagaatagattgccctgctcaggaaatgaaacttctgatttatttctgtgaacatcccaatcaaattttaagtaaacaccaaatttataaagatgtgtggggggagttttatggcggagatagtactgtaatggtacatgtaagacgattacgtgaaaaattagaggaagacccgagcagacctagatggattaaaacggttcgaggacagggctatatatttgaagcagagcctatagatgaggatttattttga

SEQ ID NO: 11026 - protein, 240 aa, Bacillus sp
MTLEENKILMVDDDEHILNLLITCFEKEGFSNISTAMTGSETLLKIDQELPNIILLDVMLPDTDGFTLCSKIRSHTNVPILFLTAKTTDLDKLQGFSFGGDDYITKPFNPLEIVARVKAQLKRTTQLSSSYPLKQVYDYEYFKIDPNTGRLVVNGTRIDCPAQEMKLLIYFCEHPNQILSKHQIYKDVWGEFYGGDSTVMVHVRRLREKLEEDPSRPRWIKTVRGQGYIFEAEPIDEDLF

SEQ ID NO: 11027 - DNA, 954 bp, Rhizobium etli
  CDS (1)..(954)
atgtcatcataccctttcgagcctacggcgacatttacgaggtggaagaaatctggctcgccgctgatgcgcgccgtcggggagaggcgattggcgatcttctggatcagcactagatgttgctcaactttcaagcaggcgagatatgtatcgggttatgtttgtaacaaatcatttttatgcacgctcagcctcagccgctgggatcctggaatgaaaggtgaacggttgaaacacgttcttgtcattgatgacgacctcgcgatgcggcatcttatcgtcgaatgtctcacggttcatgccttgaaggtgactgccgtagccgacagccagcagtttaaccgcgtcctctcatccgagaccgtcgatgttgtggtcgttgatctcaatctgggacgtgaggatgggcttgaaatcgtccgcacgctagcaacaaaatcagacgttccgatcataatcatcagcggagatcgcctggaagaagcggacaaggtcttggctctcgaactcggagccaccgattttatcgcaaaacccttcggaacgcgggagtttctggcacggatccgcgttgccttgcgtgtgcgtccgaccgtcgcgcgcaccaaggatcggcgcacattctatttcgacggctggacacttaatctcagacaacgccgtttgacttcggaaggcggcgccgaggtcaagctcactgcaggtgagttcaaccttctggtcgcattcctcgagaaaccgcgcgatgtgttatcccgcgagcagcttctgattgcgagccgggtgcgcgaagaggaggtatatgaccgaagcatcgacgtcctcatcctgaggcttcgccgcaagctcgagcaagatgcggcgaaccctcggctgatcaagactgcaagaggtgccggctacttcttcgatattgatgtgaatgtttcctacggaggagtgatggctgcctga

SEQ ID NO: 11028 - protein, 317 aa, Rhizobium etli
MSSYPFEPTATFTRWKKSGSPLMRAVGERRLAIFWISTRCCSTFKQARYVSGYVCNKSFLCTLSLSRWDPGMKGERLKHVLVIDDDLAMRHLIVECLTVHALKVTAVADSQQFNRVLSSETVDVVVVDLNLGREDGLEIVRTLATKSDVPIIIISGDRLEEADKVLALELGATDFIAKPFGTREFLARIRVALRVRPTVARTKDRRTFYFDGWTLNLRQRRLTSEGGAEVKLTAGEFNLLVAFLEKPRDVLSREQLLIASRVREEEVYDRSIDVLILRLRRKLEQDAANPRLIKTARGAGYFFDIDVNVSYGGVMAA

SEQ ID NO: 11029 - DNA, 726 bp, Zymomonas mobilis
  CDS (1)..(726)
atggcaagccagacgattatgatcgtcgaagacgatgcttctttacgagcgttaattgctcgcgtgctgaaagagaatggctacataccttgtccagtaggctctggcgaagaaatgtgggaagagttacaaagccgaacggtcgatcttattttaatggatgtcatgctgcctggtaaaaacgggttggatctaacgcgcgaattacgcagcaatagccaatatatggcaattccggttattttcttgagtgcgcgcgatgacgaaactgatcgagttgtcggattagaactgggtggggatgattatatcccgaagccttttggtaaaaaagaattggtagcaagagttcgtgccgttttgcgacgcagtcaagcggttaaagaagcggatgggaatccacaaagtcaccttattcattttgaaggctgggtacttgaccctgaccgccgtgaacttcattctccgacaggggctggcgtcgaattgtcaggtgccgaatttgatctgctcttatcctttttacaacatgcacaacgagtgatcgggcgcgaaaggctgttagaattatctcgcagtcggctaagcgaggcttctgaccgaagtattgatgttttagtcagtcgattgcgtcgtaaactgtctagccaaacagaggctggtgacatgatacgcaccattcgcggggtcggctatatgtttacagtaccggtttctcaggattga

SEQ ID NO: 11030 - protein, 241 aa, Zymomonas mobilis
MASQTIMIVEDDASLRALIARVLKENGYIPCPVGSGEEMWEELQSRTVDLILMDVMLPGKNGLDLTRELRSNSQYMAIPVIFLSARDDETDRVVGLELGGDDYIPKPFGKKELVARVRAVLRRSQAVKEADGNPQSHLIHFEGWVLDPDRRELHSPTGAGVELSGAEFDLLLSFLQHAQRVIGRERLLELSRSRLSEASDRSIDVLVSRLRRKLSSQTEAGDMIRTIRGVGYMFTVPVSQD

SEQ ID NO: 11031 - DNA, 705 bp, Rhodobacter capsulatus
  CDS (1)..(705)
atgaagacgtcctatcatatccttgtcgtcgaagatgatccggtggggcggcagacgctggccgcctatctggtgaaggacaatcaccgcgtcagcgaggcgggcgacggcgaagagatgcgccgcatcttcgcgcggggcgatgtcgacgtgatcctgttcgacatcaaccttaccgggcgcaggacgggctcgcttttgcgcgaattgcggcggcaatccgaggtgggggtgatcatggtcacctcgcggcgcgaggatgtggaccggatcgtggcgctggaactgggcgccgatgattacgtgaccaagccctacaacatgcgcgagatcctgccgcgcacgcgcaatttggcgcgccgagtgacggcggcgcgggtggtgaaggcggatgagtcgcgcaagagcttcgagggctggacgcttgacatcgcgcattggacgctgagcgacccggcgggcgaggcggtgaagatgacaagggcggaattcgaactgctggccaccttcgtcacccatccggggcaggtgctgagccgcgatcagctgatgacgcatgtacagcccgccgcgggcatgaaagcttacgatacgcaccatatcgacgtgctggtgcggcgggtgcgccgcaagatcgagcccgataccggccaagccccggctgatgtacaccgtgcacgggttgggtacgtgttttcggcttga

SEQ ID NO: 11032 - protein, 234 aa, Rhodobacter capsulatus
MKTSYHILVVEDDPVGRQTLAAYLVKDNHRVSEAGDGEEMRRIFARGDVDVILFDINLTGRRTGSLLRELRRQSEVGVIMVTSRREDVDRIVALELGADDYVTKPYNMREILPRTRNLARRVTAARVVKADESRKSFEGWTLDIAHWTLSDPAGEAVKMTRAEFELLATFVTHPGQVLSRDQLMTHVQPAAGMKAYDTHHIDVLVRRVRRKIEPDTGQAPADVHRARVGYVFSA

SEQ ID NO: 11033 - DNA, 714 bp, Lactobacillus sakei; identical to SEQ ID NO: 8597
  CDS (1)..(714)

SEQ ID NO: 11034 - protein, 237 aa, Lactobacillus sakei; identical to SEQ ID NO: 8598

SEQ ID NO: 11035 - DNA, 714 bp, Lactobacillus sakei
  CDS (1)..(714)
atgaaaacgattctagtggtagacgatgaaccagcaatcttgacactgttgagatataatctggagcaagaacatttcaaggtaatgacggcaacggatggcgcccaagcgctaacgatggccttacagcaaaaatttgattttatcattttggatttgatgttacccaaactagatgggattgcggtaacgaaaaaaattcgggaagctaaattaaaaacgccaattatgattttaacggctaaggacaacgaaacggataagattgttgggcttgaagttggcgccgacgattacgtgacgaaaccttttagcccccgcgaaatcatcgctcgaattcgagccattgaacgccggaccactcagcctattgaacaaccagttgaacaggcgtctgaaacgattgtggtcggtgatttaagtgtggacgaaaccgaagtaatcgcaaaaaaaggcgatcataagttgcacttaacgccgaaagaattcgaattattagtgtattttatgcatcgactcaataaggtgcaaagtcgtgaaaaattattaaatgccgtttggggattcgattacccagctgaaacccgaatggttgacattcaagtgagtcatttgcgtgaaaagattgaagataatccgcgccatcctgtttatctaaaaacggttcgtggttttggttatcaattagaggatcccgcacatgaccaagcatga

SEQ ID NO: 11036 - protein, 237 aa, Lactobacillus sakei
MKTILVVDDEPAILTLLRYNLEQEHFKVMTATDGAQALTMALQQKFDFIILDLMLPKLDGIAVTKKIREAKLKTPIMILTAKDNETDKIVGLEVGADDYVTKPFSPREIIARIRAIERRTTQPIEQPVEQASETIVVGDLSVDETEVIAKKGDHKLHLTPKEFELLVYFMHRLNKVQSREKLLNAVWGFDYPAETRMVDIQVSHLREKIEDNPRHPVYLKTVRGFGYQLEDPAHDQA

SEQ ID NO: 11037 - DNA, 687 bp, Mycobacterium smegmatis; identical to SEQ ID NO: 8601
  CDS (1)..(687)

SEQ ID NO: 11038 - protein, 228 aa, Mycobacterium smegmatis; identical to SEQ ID NO: 8602

SEQ ID NO: 11039 - DNA, 750 bp, Cyanidium caldarium
  CDS (1)..(750)
atgagaatagaaaataaacaaaataagagacagcaccatctcctcatagtggatgacgaaaataacatcaggaaaattttacaaactagattgacgctgcttggttattccgtatctaccgcgtgcaacggagaagaagctcttaaaatatttacaactcattccatcgatctaatcatccttgatgtgatgatgccaaaattagacggctatggtgtttgtcaagaaatcagaaaagagtctgatattccaattataatgctcacagctttggaagatgtattagacaaagtcacgggattagaactaggtgccgacgattatgtcattaaacctttctctccaagagaactagaggcacgtattcaatctatcttaagaagaattcaaacaagaaatgctaagctgaaaccatatgacaacataaacttatttaaaacaggttccttaaatattgatttagagaagaaacaaatttataagaataatgaattaataagattaacagaaatggaatttagcttacttgaattgcttgttagccaatcaggcaaagcattttccagatcaaaaatactaaaagaagtttggggttacaagttaagtaaacatgagccaatagcagatactagaatagtagatgtacacatttcgagattacgagcaaaactagaggatgatccaactaaccctacattaatcttaactgcgagggggacaggatatttgtgcaggaaattaataacttga

SEQ ID NO: 11040 - protein, 249 aa, Cyanidium caldarium
MRIENKQNKRQHHLLIVDDENNIRKILQTRLTLLGYSVSTACNGEEALKIFTTHSIDLIILDVMMPKLDGYGVCQEIRKESDIPIIMLTALEDVLDKVTGLELGADDYVIKPFSPRELEARIQSILRRIQTRNAKLKPYDNINLFKTGSLNIDLEKKQIYKNNELIRLTEMEFSLLELLVSQSGKAFSRSKILKEVWGYKLSKHEPIADTRIVDVHISRLRAKLEDDPTNPTLILTARGTGYLCRKLIT

SEQ ID NO: 11041 - DNA, 765 bp, Guillardia theta; identical to SEQ ID NO: 8603
  CDS (1)..(765)

SEQ ID NO: 11042 - protein, 254 aa, Guillardia theta; identical to SEQ ID NO: 8604

SEQ ID NO: 11043 - DNA, 708 bp, Lactobacillus johnsonii; identical to SEQ ID NO: 8615
  CDS (1)..(708)

SEQ ID NO: 11044 - protein, 235 aa, Lactobacillus johnsonii; identical to SEQ ID NO: 8616

SEQ ID NO: 11045 - DNA, 705 bp, Bacillus cereus
  CDS (1)..(705)
atgtatgaagcaaatattttgctcgttgatgatgaaacagcaattttacaattactaactaccattcttgaaaaagaaggtttttctcatattacaactgcaacatcagctgaaatagctttatctctcacagagcaaaacgattacgacttaattattttagatgtcatgcttcctggacaatctggttttgatatttgtcccatcattcgacagaaaacagattgccctatcttcttcctcacagctaaagcatctgatttagataaaatatctggatttgcacacggtgcagatgattatattacgaagccatttaatccacttgaagtagtagctcgtatgaaagcacaactccgaagacatatgaagcaagtaatgacacatgaacaaaaagcacactctagttcatttggtagatttgcaattgatcgcgattccgcagaactgacagtgaatggacatgttgtcgaatgttctgctcagctatttcagctattactcttcttttgcgagaatccgaactacgtattttcgaaagaagaaatatacgaaaaagtttggggagcacctgcctacaatggcgatgacaataccgttatggttcacattcgaaaactacgtgaaaaaattgaacaagacccaagtaaaccagaatatataaaaaccgttcgtggacttggctataagttcattacaaagtag

SEQ ID NO: 11046 - protein, 234 aa, Bacillus cereus
MYEANILLVDDETAILQLLTTILEKEGFSHITTATSAEIALSLTEQNDYDLIILDVMLPGQSGFDICPIIRQKTDCPIFFLTAKASDLDKISGFAHGADDYITKPFNPLEVVARMKAQLRRHMKQVMTHEQKAHSSSFGRFAIDRDSAELTVNGHVVECSAQLFQLLLFFCENPNYVFSKEEIYEKVWGAPAYNGDDNTVMVHIRKLREKIEQDPSKPEYIKTVRGLGYKFITK

SEQ ID NO: 11047 - DNA, 753 bp, Bacillus cereus
  CDS (1)..(753)
atgaaccgttgtggtaaaagtacgcaacgggtagaaatggaaaatgaatcaagaattttaattgtagacgatgaggatcgtattcgtcgtttgttgaaaatgtatttagaaagagaacaatacacaattgaagaagcagacaatggtgatacagctttagaaatggcgttgcaaaatgattatgatttaatcctattagatcttatgatgcctggtaaagatggtattgaagtatgtaaaggggttcgtgagaagaaagcaacgccaattattatgttgacagcaaaaggtgaagaagtaaatcgagtacaagggtttgaggtaggaactgatgattatattgtgaaaccatttagcccacgtgaagtagtgcttcgagtgaaagcggtcttacgccgttctgtaccaacaacattctttacacaagatacaacgacaaaagatgttactgtgttccctcatttaacaattgataatgatgcacaccgtgttacagcagatgggaatgaagtgaatttaacaccgaaagagtacgaattactattattcttagcgaaagcgcctgataaggtatttgatcgtgagcaattgttaaaagaagtatggcaatatgaattcttcggagatttacgtacagttgatacgcatgtaaagcgtttacgtgagaagttaagcaaaaaatcaccagatgctgcgaagatgattgttaccgtttggggcgtaggttataagtttgaggttgtgaacgactga

SEQ ID NO: 11048 - protein, 250 aa, Bacillus cereus
MNRCGKSTQRVEMENESRILIVDDEDRIRRLLKMYLEREQYTIEEADNGDTALEMALQNDYDLILLDLMMPGKDGIEVCKGVREKKATPIIMLTAKGEEVNRVQGFEVGTDDYIVKPFSPREVVLRVKAVLRRSVPTTFFTQDTTTKDVTVFPHLTIDNDAHRVTADGNEVNLTPKEYELLLFLAKAPDKVFDREQLLKEVWQYEFFGDLRTVDTHVKRLREKLSKKSPDAAKMIVTVWGVGYKFEVVND

SEQ ID NO: 11049 - DNA, 690 bp, Desulfovibrio vulgaris; identical to SEQ ID NO: 8629
  CDS (1)..(690)

SEQ ID NO: 11050 - protein, 229 aa, Desulfovibrio vulgaris; identical to SEQ ID NO: 8630

SEQ ID NO: 11051 - DNA, 723 bp, Rhodopseudomonas palustris
  CDS (1)..(723)
atgagcaccgcaccaccatcgattctcgtcgtcgaggacgaccgcgagacccgcgcgctgatcgccaaatatctccgcgccaacaactgcaacgtcgccaccgccgcggacggccgcgagatggagcgctggatcgccgatcatcgcgtcgatctggtcgtgctcgacgtgatgctgccgggcgaggacgggctcagcctgtgccggaagatccgcgccaattcggcgctgccgatcatcatgctgaccgcgcggggcgacgacgtcgaccgcatcctcggcctcgagatgggcgccgacgattacttgccgaagccgttcaatccgcgcgaactgctggcacggattcgctcggtgctgcgccggcaggcgagcgccgtcaccgccagcgccacacccggcgccaccacgctcggcttcctcggctggcggatggattgccggcggcgcgaactgcgcaatcccgacggcgcgctggtggcgatgaccagcgccgaattcgacctgctgcaggcgctgtgcgagcgcgccggccgggtgctgtcgcgcgaggcgctgctcgatctcacccatggccgcaacgtcggcgcgttcgagcgctcgatcgacgtgctgatcagccgcatccgccgcaagatcgaacccgatccgcgcgaagccacgctgatcaagacggtgcgggccggtggctacgtgttcacgccggaggtcgaaaccgcatga

SEQ ID NO: 11052 - protein, 240 aa, Rhodopseudomonas palustris
MSTAPPSILVVEDDRETRALIAKYLRANNCNVATAADGREMERWIADHRVDLVVLDVMLPGEDGLSLCRKIRANSALPIIMLTARGDDVDRILGLEMGADDYLPKPFNPRELLARIRSVLRRQASAVTASATPGATTLGFLGWRMDCRRRELRNPDGALVAMTSAEFDLLQALCERAGRVLSREALLDLTHGRNVGAFERSIDVLISRIRRKIEPDPREATLIKTVRAGGYVFTPEVETA

SEQ ID NO: 11053 - DNA, 741 bp, Rhodopseudomonas palustris
  CDS (1)..(741)
atgagccagaacccgcacatcatcgtcgtcgacgacgaagccccggcccgcgagatggtcggcgactatctcaagatgcacggcttcgccgtcaccctgtgcgatggcggcaagagcctgcgcgccgagattgccaccaagcttccggacctggtggtgctggacctcaacatgccggaagaggacgggctgtccatcatccgcgacctcaaggccaagtccaacgtcccggtgatcatgctgaccgcgaccgccagcccgatcgaccgcgtggtcggcctcgaactcggcgccgacgattacgtcgccaaaccctgcgagctgcgcgaattgatggcgcgcattcgttcggtgctgcgccgcgcggcgccgccgaagcccgttgccgcagagcctgcaagcgctgccaaggccgacaacgcccagctggtgcggttcggcaccaaatggctcgacctcgaagcccaggcgctgcgcgacgacgacggcaatgagcatccgctgacggcgtctgaattcggcctgctgaaggtgttcgctgccaatcccaaacgggtgctgtcgcgcgagcggctgctggagctggcgaacgcacgcgacgccgaggccttcgaccgcgcggtcgatctccgcatcatgcggatccggcgcaagatcgagccggacccgacaaagccggccgtaattcggacaattcgcggcggcggctatttgttctcgccggccagcgaccgcgcctga

SEQ ID NO: 11054 - protein, 246 aa, Rhodopseudomonas palustris
MSQNPHIIVVDDEAPAREMVGDYLKMHGFAVTLCDGGKSLRAEIATKLPDLVVLDLNMPEEDGLSIIRDLKAKSNVPVIMLTATASPIDRVVGLELGADDYVAKPCELRELMARIRSVLRRAAPPKPVAAEPASAAKADNAQLVRFGTKWLDLEAQALRDDDGNEHPLTASEFGLLKVFAANPKRVLSRERLLELANARDAEAFDRAVDLRIMRIRRKIEPDPTKPAVIRTIRGGGYLFSPASDRA

SEQ ID NO: 11055 - DNA, 681 bp, Corynebacterium diphtheriae; identical to SEQ ID NO: 8637
  CDS (1)..(681)

SEQ ID NO: 11056 - protein, 226 aa, Corynebacterium diphtheriae; identical to SEQ ID NO: 8638

SEQ ID NO: 11057 - DNA, 699 bp, Corynebacterium diphtheriae; identical to SEQ ID NO: 8639
  CDS (1)..(699)

SEQ ID NO: 11058 - protein, 232 aa, Corynebacterium diphtheriae; identical to SEQ ID NO: 8640

SEQ ID NO: 11059 - DNA, 720 bp, Photobacterium profundum
  CDS (1)..(720)
atgcaggaaaattataaaattctggttgttgatgacgacatgcgtttacgcgcattattagaacgttacttgtcggaacaaggtttccaagtacgtagcgtcgcaaacggcgagcaaatggaccgcttgttatcccgtgaaacatttcacttaatggtgctagatctaatgctaccgggtgaagatggcttgtctatttgtcgtcgcttacgcaatgccaataataagctaccgattcttatgctgaccgcaaaaggcgatgaagttgatcgtattgtagggctagaagttggcgcagatgattatttgccaaaaccgtttaacccgcgtgaattactggctcgtattcgtgctgtactacgccgccagaccattgaagcacctggtgccccaagtgtgaatagcaaaattgtcgagtttggtgaattccgtttgaatctaggcacacgcgagatgttccgtggtgaagcgccgatgcctctaacctccggcgaatttgcagtattgaaagcgttagtgaccaatgcgcgtgagccgatgtcgcgtgataaattgatgaatatggcgcgtggtcgtgaatattctgcgatggaacgctctatcgatgtacagatttctcgtttgcgtcgaatggttgaagaagatccaagtcgccctcgttacattcaaacagtatggggtttaggttacgttttcgtgcccgacggtaacgagaagtaa

SEQ ID NO: 11060 - protein, 239 aa, Photobacterium profundum
MQENYKILVVDDDMRLRALLERYLSEQGFQVRSVANGEQMDRLLSRETFHLMVLDLMLPGEDGLSICRRLRNANNKLPILMLTAKGDEVDRIVGLEVGADDYLPKPFNPRELLARIRAVLRRQTIEAPGAPSVNSKIVEFGEFRLNLGTREMFRGEAPMPLTSGEFAVLKALVTNAREPMSRDKLMNMARGREYSAMERSIDVQISRLRRMVEEDPSRPRYIQTVWGLGYVFVPDGNEK

SEQ ID NO: 11061 - DNA, 720 bp, Photobacterium profundum
  CDS (1)..(720)
atgcaaacccctcacattctaattgtagaagacgagcacgtaacacgtaatacccttaagagcatttttgaagctgagggttacactgtctttgaagccaatgacggcgctgaaatgcaccagatgctttctgagcaccccgttcaccttgttatcatggacatcaacctaccaggtaaaaatggtttattactagcacgtgaacttcgcgagcaaggtgatatggctcttatgttcctgacaggtcgtgacaacgaagttgataagattttaggtcttgaaattggtgctgatgattacatcactaaaccattcaaccctcgtgagttaactattcgtgcgcgtaacttactgacacgtgcgatgaaccaaggtctaccaactgaagataagaaattggtagagcgttatgagttcaatggttggtctttagaaatcaacagccgttctttggttagcccaagtggtgaccaatttaagcttcctcgttctgaattccgtgctttacttcacttctgtgaaaacccaggcaaaattcaaacgcgtggcgatcttctgaagaagatgactggtcgtgaacttaagcctcacgaccgtacggttgacgtaactattcgtcgtatccgtaagcactttgaatctgttgctgatacacctgaaatcgttgcaacgattcatggtgaaggttaccgtttctgcggtgatctaaacgaagaataa

SEQ ID NO: 11062 - protein, 239 aa, Photobacterium profundum
MQTPHILIVEDEHVTRNTLKSIFEAEGYTVFEANDGAEMHQMLSEHPVHLVIMDINLPGKNGLLLARELREQGDMALMFLTGRDNEVDKILGLEIGADDYITKPFNPRELTIRARNLLTRAMNQGLPTEDKKLVERYEFNGWSLEINSRSLVSPSGDQFKLPRSEFRALLHFCENPGKIQTRGDLLKKMTGRELKPHDRTVDVTIRRIRKHFESVADTPEIVATIHGEGYRFCGDLNEE

SEQ ID NO: 11063 - DNA, 714 bp, Photobacterium profundum
  CDS (1)..(714)
atgagtcatcacgtacttgttgtagaagatgaaattgttacccgaaccaaacttgttgggtattttgagaatgagggttaccaagtaagccaagctgagaatggtgagcagatgcgagagattatgatggtcgaaaatatcgatctcattatgctcgatattaacttgcctggtgagaatggtttactgcttacacgtgaactaagaagccgctcagaggtgggtattattcttgtcaccggtcgtaccgatagcatcgatcgtatcgtgggtttagagatgggtgccgacgattatgtgacgaaaccgttcgagctaagagaactgcttgtaagagtgaaaaacttattatggcgcatggacttagtcgaaaaagcgcgcagtgaaacgttagttgaaatacatgaagataacatcattcgtttcagtgattggcaatttgatattaacagacgagcattgactcataacggtcagccagtgaagttaactaaagctgaatatgagcttttagtggcgttttcttcgcaccaaaatgttgtattaagtcgtgaaagaattctgaatatgttgagccatcgtgtagaggctcctaatgatagaactatcgatgttctgattcgaagaatgcgttcgaaaatggaagttgacccgaaaaatccacaaatttttgttaccgttcatggtgaaggttacatgtttgctggcgattaa

SEQ ID NO: 11064 - protein, 237 aa, Photobacterium profundum
MSHHVLVVEDEIVTRTKLVGYFENEGYQVSQAENGEQMREIMMVENIDLIMLDINLPGENGLLLTRELRSRSEVGIILVTGRTDSIDRIVGLEMGADDYVTKPFELRELLVRVKNLLWRMDLVEKARSETLVEIHEDNIIRFSDWQFDINRRALTHNGQPVKLTKAEYELLVAFSSHQNVVLSRERILNMLSHRVEAPNDRTIDVLIRRMRSKMEVDPKNPQIFVTVHGEGYMFAGD

SEQ ID NO: 11065 - DNA, 786 bp, Photobacterium profundum
  CDS (1)..(786)
atgtggatttttatggacagttccgctttaccttcactacctcatctattaatcgttgatgaccatagcgagatccgtgatttgttaaagcgttttctaagccagcataattatcgggtttctgttgccgcagatgggaatgaaatggagcaatgccttcgagacaattcaatcgatttgatcgtgttggatttaatgctgcccggaaaagatggattaaccttatgccgtgaattgcgtgttcattcgaatataccggtgataatgctgacagcgatgggcgaggaggtagataaaatcattgggctcgaaatgggcgcggatgattatttgcctaagccgtttaatccacgcgaattattagcccgcgtaaaagctgtgattcgtcgttttaatgcgatacctgaaggtaagtcagtacgtcagtcgaaagtggattctgttgaagaggcgcaagataaagaaagctatgtttatcgctttaatcgttggtgttttgatattggtcagcgtgaattaacagacaacgatggtattgctgtttcattaacgagtgcagaatttacattattgaaagtatttgttgaacatccaagaaaagtattaagccgagagcagctattggatttggccaaagggcgagagaccgatgtatatgatcgttctattgatactattattagccgattacggaagaagttagaaatcgatcataaaaagcctgaattaatcaagacgatttggggtgggggctatcaactggtgtgcgaggtaacacatgattaa

SEQ ID NO: 11066 - protein, 261 aa, Photobacterium profundum
MWIFMDSSALPSLPHLLIVDDHSEIRDLLKRFLSQHNYRVSVAADGNEMEQCLRDNSIDLIVLDLMLPGKDGLTLCRELRVHSNIPVIMLTAMGEEVDKIIGLEMGADDYLPKPFNPRELLARVKAVIRRFNAIPEGKSVRQSKVDSVEEAQDKESYVYRFNRWCFDIGQRELTDNDGIAVSLTSAEFTLLKVFVEHPRKVLSREQLLDLAKGRETDVYDRSIDTIISRLRKKLEIDHKKPELIKTIWGGGYQLVCEVTHD

SEQ ID NO: 11067 - DNA, 702 bp, Photobacterium profundum
  CDS (1)..(702)
atgacttacaaaattttgattgtagaagacgaccctattattaggatgaagattaaggggcacttcgcccaggctggtcacactgttttcgaggctgataacggtgttgggatgaaagagatccttaaccgcgagaaaattgatttgatcctgctggatattaacttaccaggagaagacggcatacagctcacccgtgacgtgaggaacacatctgacattgctatcatcatggtcacagggcgaactgaccccatcgaccggattttaggccttgaaatgggcgcagatgactatgtaaccaagcctgtagaaccacgagagctgctggtacgtgcaaaaaatttgctatggcgtatccagcttacccgtgacgctttggaacaggcagaggctgcctggtcgcaactggaaaaggatgatagtacattccggttcctggattttgaatttgatgttgctcagcgtcagctgtcaaagtgtcaagatatggtaaagctaaccaaagctgaatatgagttgctggtcgctttcatcacgcaccccaaccgggttttaggtcgagacaggcttctaaacctgatctctcatcgagttgatacaccgagcgatcgtaccgttgacgttttgatccgccggctgagaaacaagatggaagaaagcatcaaaaaccccaagatttttatcaccatacacgggtga

SEQ ID NO: 11068 - protein, 233 aa, Photobacterium profundum
MTYKILIVEDDPIIRMKIKGHFAQAGHTVFEADNGVGMKEILNREKIDLILLDINLPGEDGIQLTRDVRNTSDIAIIMVTGRTDPIDRILGLEMGADDYVTKPVEPRELLVRAKNLLWRIQLTRDALEQAEAAWSQLEKDDSTFRFLDFEFDVAQRQLSKCQDMVKLTKAEYELLVAFITHPNRVLGRDRLLNLISHRVDTPSDRTVDVLIRRLRNKMEESIKNPKIFITIHG

SEQ ID NO: 11069 - DNA, 726 bp, Photobacterium profundum
  CDS (1)..(726)
atgattgcgaacaaaaaggtgctcgtcgttgatgacgatcaggagattcgcgagctcttagacgagtatttgaccaagtctggttttactgtcaccaccgctgctgaaggtgaagaaatgaagcgccgtttagcgggtggataccctgacttaattttaatggatgtgatgatgccgggtgacgatgggttcactttgtgccaatacattcgtaaaacgtcggatgtgccaattattatgctgacagccgtgtcggatgaaatggatcagatcattgggttagagctcggtgcagatgattatattgcgaaaccttttagtcctaggcagttaatggcacgtattaaagcattattgcgtcgtgttaaaccaaccgtcacgcagaaaatgcctgaaacacccaagtctattttgttctctcattggcgtttagagacggcttctcatcgtttatatgatttagaaaagggcaaagactacgagttaactggcagtgatttttcgttgttaatgttgtttttgtcgcgccctaatgaaattttagatcgcgatacgatttcttgtgccacgcgtggtcgagaagccttaccatcagagcgtggtattgatgtgcaattaagccgcttacgtcaacgtttaggcgataaaggcaaaacgcagcgtattatcaaaacaagccgtggtaatggctatatcttcatccctgaagtgaaatacgaaagctag

SEQ ID NO: 11070 - protein, 241 aa, Photobacterium profundum
MIANKKVLVVDDDQEIRELLDEYLTKSGFTVTTAAEGEEMKRRLAGGYPDLILMDVMMPGDDGFTLCQYIRKTSDVPIIMLTAVSDEMDQIIGLELGADDYIAKPFSPRQLMARIKALLRRVKPTVTQKMPETPKSILFSHWRLETASHRLYDLEKGKDYELTGSDFSLLMLFLSRPNEILDRDTISCATRGREALPSERGIDVQLSRLRQRLGDKGKTQRIIKTSRGNGYIFIPEVKYES

SEQ ID NO: 11071 - DNA, 21 bp, Primer
atgcagaccccgcacattctt

SEQ ID NO: 11072 - DNA, 24 bp, Primer
ttaatcttccagatcaccgcagaa

SEQ ID NO: 11073 - DNA, 1062 bp, Escherichia coli K12; identical to SEQ ID NO: 2732
  CDS (1)..(1062)

SEQ ID NO: 11074 - protein, 353 aa, Escherichia coli K12; identical to SEQ ID NO: 2733

SEQ ID NO: 11075 - DNA, 1444 bp, Pseudomonas fluorescens; identical to SEQ ID NO: 2734
  CDS (156)..(1214)

SEQ ID NO: 11076 - protein, 352 aa, Pseudomonas fluorescens; identical to SEQ ID NO: 2735

SEQ ID NO: 11077 - DNA, 1484 bp, Haemophilus influenzae; identical to SEQ ID NO: 2736
  CDS (278)..(1342)

SEQ ID NO: 11078 - protein, 354 aa, Haemophilus influenzae; identical to SEQ ID NO: 2737

SEQ ID NO: 11079 - DNA, 1131 bp, Thermus aquaticus; identical to SEQ ID NO: 2738
  CDS (62)..(1084)

SEQ ID NO: 11080 - protein, 340 aa, Thermus aquaticus; identical to SEQ ID NO: 2739

SEQ ID NO: 11081 - DNA, 1196 bp, Aquifex pyrophilus; identical to SEQ ID NO: 2740
  CDS (51)..(1097)

SEQ ID NO: 11082 - protein, 348 aa, Aquifex pyrophilus; identical to SEQ ID NO: 2741

SEQ ID NO: 11083 - DNA, 1023 bp, Rickettsia prowazekii; identical to SEQ ID NO: 2742
  CDS (1)..(1023)

SEQ ID NO: 11084 - protein, 340 aa, Rickettsia prowazekii; identical to SEQ ID NO: 2743

SEQ ID NO: 11085 - DNA, 1329 bp, Myxococcus xanthus; identical to SEQ ID NO: 2744
  CDS (201)..(1229)

SEQ ID NO: 11086 - protein, 342 aa, Myxococcus xanthus; identical to SEQ ID NO: 2745

SEQ ID NO: 11087 - DNA, 1394 bp, Legionella pneumophila; identical to SEQ ID NO: 2746
  CDS (166)..(1212)

SEQ ID NO: 11088 - protein, 348 aa, Legionella pneumophila; identical to SEQ ID NO: 2747

SEQ ID NO: 11089 - DNA, 1224 bp, Treponema pallidum subsp. pallidum (syphilis spirochete); identical to SEQ ID NO: 2748
  CDS (1)..(1224): k means g or t/u

SEQ ID NO: 11090 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 11091 - DNA, 1050 bp, Clostridium acetobutylicum; identical to SEQ ID NO: 2750
  CDS (1)..(1050)

SEQ ID NO: 11092 - protein, 349 aa, Clostridium acetobutylicum; identical to SEQ ID NO: 2751

SEQ ID NO: 11093 - DNA, 1047 bp, Listeria innocua; identical to SEQ ID NO: 2752
  CDS (1)..(1047)

SEQ ID NO: 11094 - protein, 348 aa, Listeria innocua; identical to SEQ ID NO: 2753

SEQ ID NO: 11095 - DNA, 1137 bp, Brucella melitensis; identical to SEQ ID NO: 2754
  CDS (1)..(1137)

SEQ ID NO: 11096 - protein, 378 aa, Brucella melitensis; identical to SEQ ID NO: 2755

SEQ ID NO: 11097 - DNA, 1062 bp, Salmonella enterica subsp. enterica serovar Typhi; identical to SEQ ID NO: 2756
  CDS (1)..(1062)

SEQ ID NO: 11098 - protein, 353 aa, Salmonella enterica subsp. enterica serovar Typhi; identical to SEQ ID NO: 2757

SEQ ID NO: 11099 - DNA, 1074 bp, Nostoc sp. PCC 7120; identical to SEQ ID NO: 2758
  CDS (1)..(1074)

SEQ ID NO: 11100 - protein, 357 aa, Nostoc sp. PCC 7120; identical to SEQ ID NO: 2759

SEQ ID NO: 11101 - DNA, 1044 bp, Xylella fastidiosa; identical to SEQ ID NO: 2760
  CDS (1)..(1044)

SEQ ID NO: 11102 - protein, 347 aa, Xylella fastidiosa; identical to SEQ ID NO: 2761

SEQ ID NO: 11103 - DNA, 1164 bp, Lactococcus lactis subsp. lactis; identical to SEQ ID NO: 2762
  CDS (1)..(1164)

SEQ ID NO: 11104 - protein, 387 aa, Lactococcus lactis subsp. lactis; identical to SEQ ID NO: 2763

SEQ ID NO: 11105 - DNA, 2025 bp, Borrelia burgdorferi (Lyme disease spirochete); identical to SEQ ID NO: 2764
  CDS (25)..(1122)

SEQ ID NO: 11106 - protein, 365 aa, Borrelia burgdorferi (Lyme disease spirochete); identical to SEQ ID NO: 2765

SEQ ID NO: 11107 - DNA, 1728 bp, Deinococcus radiodurans; identical to SEQ ID NO: 2766
  CDS (399)..(1490)

SEQ ID NO: 11108 - protein, 363 aa, Deinococcus radiodurans; identical to SEQ ID NO: 2767

SEQ ID NO: 11109 - DNA, 1071 bp, Caulobacter crescentus; identical to SEQ ID NO: 2768
  CDS (1)..(1071)

SEQ ID NO: 11110 - protein, 356 aa, Caulobacter crescentus; identical to SEQ ID NO: 2769

SEQ ID NO: 11111 - DNA, 1199 bp, Thermotoga maritima; identical to SEQ ID NO: 2770
  CDS (67)..(1137)

SEQ ID NO: 11112 - protein, 356 aa, Thermotoga maritima; identical to SEQ ID NO: 2771

SEQ ID NO: 11113 - DNA, 1662 bp, Arabidopsis thaliana (mouse-ear cress); identical to SEQ ID NO: 2772
  CDS (368)..(1498)

SEQ ID NO: 11114 - protein, 376 aa, Arabidopsis thaliana (mouse-ear cress); identical to SEQ ID NO: 2773

SEQ ID NO: 11115 - DNA, 1038 bp, Aquifex aeolicus; identical to SEQ ID NO: 2774
  CDS (1)..(1038)

SEQ ID NO: 11116 - protein, 345 aa, Aquifex aeolicus; identical to SEQ ID NO: 2775

SEQ ID NO: 11117 - DNA, 1062 bp, Chlamydophila pneumoniae, Chlamydia pneumoniae; identical to SEQ ID NO: 2776
  CDS (1)..(1062)

SEQ ID NO: 11118 - protein, 353 aa, Chlamydophila pneumoniae, Chlamydia pneumoniae; identical to SEQ ID NO: 2777

SEQ ID NO: 11119 - DNA, 1047 bp, Neisseria meningitidis; identical to SEQ ID NO: 2778
  CDS (1)..(1047)

SEQ ID NO: 11120 - protein, 348 aa, Neisseria meningitidis; identical to SEQ ID NO: 2779

SEQ ID NO: 11121 - DNA, 1032 bp, Campylobacter jejuni; identical to SEQ ID NO: 2780
  CDS (1)..(1032)

SEQ ID NO: 11122 - protein, 343 aa, Campylobacter jejuni; identical to SEQ ID NO: 2781

SEQ ID NO: 11123 - DNA, 1065 bp, Chlamydia muridarum, Chlamydia trachomatis MoPn; identical to SEQ ID NO: 2782
  CDS (1)..(1065)

SEQ ID NO: 11124 - protein, 354 aa, Chlamydia muridarum, Chlamydia trachomatis MoPn; identical to SEQ ID NO: 2783

SEQ ID NO: 11125 - DNA, 1050 bp, Bacillus halodurans; identical to SEQ ID NO: 2784
  CDS (1)..(1050)

SEQ ID NO: 11126 - protein, 349 aa, Bacillus halodurans; identical to SEQ ID NO: 2785

SEQ ID NO: 11127 - DNA, 1229 bp, Streptococcus pneumoniae; identical to SEQ ID NO: 2786
  CDS (26)..(1192)

SEQ ID NO: 11128 - protein, 388 aa, Streptococcus pneumoniae; identical to SEQ ID NO: 2787

SEQ ID NO: 11129 - DNA, 1251 bp, Agrobacterium tumefaciens; identical to SEQ ID NO: 2788
  CDS (1)..(1251)

SEQ ID NO: 11130 - protein, 416 aa, Agrobacterium tumefaciens; identical to SEQ ID NO: 2789

SEQ ID NO: 11131 - DNA, 1044 bp, Staphylococcus aureus; identical to SEQ ID NO: 2790
  CDS (1)..(1044)

SEQ ID NO: 11132 - protein, 347 aa, Staphylococcus aureus; identical to SEQ ID NO: 2791

SEQ ID NO: 11133 - DNA, 1506 bp, Acinetobacter calcoaceticus; identical to SEQ ID NO: 2792
  CDS (403)..(1452)

SEQ ID NO: 11134 - protein, 349 aa, Acinetobacter calcoaceticus; identical to SEQ ID NO: 2793

SEQ ID NO: 11135 - DNA, 1479 bp, Brucella abortus; identical to SEQ ID NO: 2794
  CDS (316)..(1398)

SEQ ID NO: 11136 - protein, 360 aa, Brucella abortus; identical to SEQ ID NO: 2795

SEQ ID NO: 11137 - DNA, 981 bp, Streptococcus pyogenes; identical to SEQ ID NO: 2796
  CDS (1)..(981)

SEQ ID NO: 11138 - protein, 326 aa, Streptococcus pyogenes; identical to SEQ ID NO: 2797

SEQ ID NO: 11139 - DNA, 1349 bp, Leptospira biflexa; identical to SEQ ID NO: 2798
  CDS (107)..(1270)

SEQ ID NO: 11140 - protein, 387 aa, Leptospira biflexa; identical to SEQ ID NO: 2799

SEQ ID NO: 11141 - DNA, 1762 bp, Xanthomonas campestris pv. campestris; identical to SEQ ID NO: 2800
  CDS (159)..(1190)

SEQ ID NO: 11142 - protein, 343 aa, Xanthomonas campestris pv. campestris; identical to SEQ ID NO: 2801

SEQ ID NO: 11143 - DNA, 1212 bp, Aeromonas salmonicida; identical to SEQ ID NO: 2802
  CDS (151)..(1212)

SEQ ID NO: 11144 - protein, 353 aa, Aeromonas salmonicida; identical to SEQ ID NO: 2803

SEQ ID NO: 11145 - DNA, 1433 bp, Azotobacter vinelandii; identical to SEQ ID NO: 2804
  CDS (311)..(1360)

SEQ ID NO: 11146 - protein, 349 aa, Azotobacter vinelandii; identical to SEQ ID NO: 2805

SEQ ID NO: 11147 - DNA, 1108 bp, Acetobacter polyoxogenes; identical to SEQ ID NO: 2806
  CDS (35)..(1081)

SEQ ID NO: 11148 - protein, 348 aa, Acetobacter polyoxogenes; identical to SEQ ID NO: 2807

SEQ ID NO: 11149 - DNA, 1230 bp, Neisseria gonorrhoeae; identical to SEQ ID NO: 2808
  CDS (133)..(1179)

SEQ ID NO: 11150 - protein, 348 aa, Neisseria gonorrhoeae; identical to SEQ ID NO: 2809

SEQ ID NO: 11151 - DNA, 1649 bp, Bacteroides fragilis; identical to SEQ ID NO: 2810
  CDS (351)..(1307)

SEQ ID NO: 11152 - protein, 318 aa, Bacteroides fragilis; identical to SEQ ID NO: 2811

SEQ ID NO: 11153 - DNA, 1349 bp, Methylobacillus sp; identical to SEQ ID NO: 2812
  CDS (293)..(1327)

SEQ ID NO: 11154 - protein, 344 aa, Methylobacillus sp; identical to SEQ ID NO: 2813

SEQ ID NO: 11155 - DNA, 1320 bp, Vibrio anguillarum; identical to SEQ ID NO: 2814
  CDS (166)..(1212)

SEQ ID NO: 11156 - protein, 348 aa, Vibrio anguillarum; identical to SEQ ID NO: 2815

SEQ ID NO: 11157 - DNA, 1394 bp, Anabaena variabilis; identical to SEQ ID NO: 2816
  CDS (125)..(1201)

SEQ ID NO: 11158 - protein, 358 aa, Anabaena variabilis; identical to SEQ ID NO: 2817

SEQ ID NO: 11159 - DNA, 1334 bp, Bacillus subtilis; identical to SEQ ID NO: 2818
  CDS (215)..(1258)

SEQ ID NO: 11160 - protein, 347 aa, Bacillus subtilis; identical to SEQ ID NO: 2819

SEQ ID NO: 11161 - DNA, 1348 bp, Proteus mirabilis; identical to SEQ ID NO: 2820
  CDS (151)..(1218)

SEQ ID NO: 11162 - protein, 355 aa, Proteus mirabilis; identical to SEQ ID NO: 2821

SEQ ID NO: 11163 - DNA, 1384 bp, Pseudomonas aeruginosa; identical to SEQ ID NO: 2822
  CDS (145)..(1185)

SEQ ID NO: 11164 - protein, 346 aa, Pseudomonas aeruginosa; identical to SEQ ID NO: 2823

SEQ ID NO: 11165 - DNA, 1352 bp, Pseudomonas cepacia; identical to SEQ ID NO: 2824
  CDS (223)..(1266)

SEQ ID NO: 11166 - protein, 347 aa, Pseudomonas cepacia; identical to SEQ ID NO: 2825

SEQ ID NO: 11167 - DNA, 1047 bp, Synechococcus sp; identical to SEQ ID NO: 2826
  CDS (1)..(1047)

SEQ ID NO: 11168 - protein, 348 aa, Synechococcus sp; identical to SEQ ID NO: 2827

SEQ ID NO: 11169 - DNA, 1190 bp, Aquaspirillum magnetotacticum; identical to SEQ ID NO: 2828
  CDS (112)..(1146)

SEQ ID NO: 11170 - protein, 344 aa, Aquaspirillum magnetotacticum; identical to SEQ ID NO: 2829

SEQ ID NO: 11171 - DNA, 1841 bp, Rhizobium leguminosarum bv. viciae; identical to SEQ ID NO: 2830
  CDS (32)..(1087)

SEQ ID NO: 11172 - protein, 351 aa, Rhizobium leguminosarum bv. viciae; identical to SEQ ID NO: 2831

SEQ ID NO: 11173 - DNA, 1047 bp, Rhizobium meliloti; identical to SEQ ID NO: 2832
  CDS (1)..(1047)

SEQ ID NO: 11174 - protein, 348 aa, Rhizobium meliloti; identical to SEQ ID NO: 2833

SEQ ID NO: 11175 - DNA, 2762 bp, Mycobacterium tuberculosis; identical to SEQ ID NO: 2834
  CDS (311)..(2683)

SEQ ID NO: 11176 - protein, 790 aa, Mycobacterium tuberculosis; identical to SEQ ID NO: 2835

SEQ ID NO: 11177 - DNA, 1249 bp, Methylomonas clara; identical to SEQ ID NO: 2836
  CDS (123)..(1151)

SEQ ID NO: 11178 - protein, 342 aa, Methylomonas clara; identical to SEQ ID NO: 2837

SEQ ID NO: 11179 - DNA, 1065 bp, Enterobacter agglomerans; identical to SEQ ID NO: 2838
  CDS (1)..(1065)

SEQ ID NO: 11180 - protein, 354 aa, Enterobacter agglomerans; identical to SEQ ID NO: 2839

SEQ ID NO: 11181 - DNA, 1125 bp, Streptomyces lividans; identical to SEQ ID NO: 2840
  CDS (1)..(1125)

SEQ ID NO: 11182 - protein, 374 aa, Streptomyces lividans; identical to SEQ ID NO: 2841

SEQ ID NO: 11183 - DNA, 1347 bp, Rhodobacter sphaeroides; identical to SEQ ID NO: 2842
  CDS (220)..(1251)

SEQ ID NO: 11184 - protein, 343 aa, Rhodobacter sphaeroides; identical to SEQ ID NO: 2843

SEQ ID NO: 11185 - DNA, 1065 bp, Vibrio cholerae; identical to SEQ ID NO: 2844
  CDS (1)..(1065)

SEQ ID NO: 11186 - protein, 354 aa, Vibrio cholerae; identical to SEQ ID NO: 2845

SEQ ID NO: 11187 - DNA, 1068 bp, Rhodobacter capsulatus; identical to SEQ ID NO: 2846
  CDS (1)..(1068)

SEQ ID NO: 11188 - protein, 355 aa, Rhodobacter capsulatus; identical to SEQ ID NO: 2847

SEQ ID NO: 11189 - DNA, 1533 bp, Helicobacter pylori; identical to SEQ ID NO: 2848
  CDS (275)..(1318)

SEQ ID NO: 11190 - protein, 347 aa, Helicobacter pylori; identical to SEQ ID NO: 2849

SEQ ID NO: 11191 - DNA, 1065 bp, Synechocystis sp; identical to SEQ ID NO: 2850
  CDS (1)..(1065)

SEQ ID NO: 11192 - protein, 354 aa, Synechocystis sp; identical to SEQ ID NO: 2851

SEQ ID NO: 11193 - DNA, 1351 bp, Arabidopsis thaliana (mouse-ear cress); identical to SEQ ID NO: 2852
  CDS (1)..(1320)

SEQ ID NO: 11194 - protein, 439 aa, Arabidopsis thaliana (mouse-ear cress); identical to SEQ ID NO: 2853

SEQ ID NO: 11195 - DNA, 1392 bp, Pseudomonas putida; identical to SEQ ID NO: 2854
  CDS (111)..(1178)

SEQ ID NO: 11196 - protein, 355 aa, Pseudomonas putida; identical to SEQ ID NO: 2855

SEQ ID NO: 11197 - DNA, 1053 bp, Mycobacterium tuberculosis; identical to SEQ ID NO: 2856
  CDS (1)..(1053)

SEQ ID NO: 11198 - protein, 350 aa, Mycobacterium tuberculosis; identical to SEQ ID NO: 2857

SEQ ID NO: 11199 - DNA, 1053 bp, Wolinella succinogenes; identical to SEQ ID NO: 2858
  CDS (1)..(1053)

SEQ ID NO: 11200 - protein, 350 aa, Wolinella succinogenes; identical to SEQ ID NO: 2859

SEQ ID NO: 11201 - DNA, 1110 bp, Vibrio vulnificus; identical to SEQ ID NO: 2860
  CDS (1)..(1110)

SEQ ID NO: 11202 - protein, 369 aa, Vibrio vulnificus; identical to SEQ ID NO: 2861

SEQ ID NO: 11203 - DNA, 1068 bp, Photorhabdus luminescens; identical to SEQ ID NO: 2862
  CDS (1)..(1068)

SEQ ID NO: 11204 - protein, 355 aa, Photorhabdus luminescens; identical to SEQ ID NO: 2863

SEQ ID NO: 11205 - DNA, 1110 bp, Gloeobacter violaceus; identical to SEQ ID NO: 2864
  CDS (1)..(1110)

SEQ ID NO: 11206 - protein, 369 aa, Gloeobacter violaceus; identical to SEQ ID NO: 2865

SEQ ID NO: 11207 - DNA, 1053 bp, Chromobacterium violaceum; identical to SEQ ID NO: 2866
  CDS (1)..(1053)

SEQ ID NO: 11208 - protein, 350 aa, Chromobacterium violaceum; identical to SEQ ID NO: 2867

SEQ ID NO: 11209 - DNA, 1128 bp, Synechococcus sp; identical to SEQ ID NO: 2868
  CDS (1)..(1128)

SEQ ID NO: 11210 - protein, 375 aa, Synechococcus sp; identical to SEQ ID NO: 2869

SEQ ID NO: 11211 - DNA, 1128 bp, Rhodopirellula baltica; identical to SEQ ID NO: 2870
  CDS (1)..(1128)

SEQ ID NO: 11212 - protein, 375 aa, Rhodopirellula baltica; identical to SEQ ID NO: 2871

SEQ ID NO: 11213 - DNA, 1113 bp, Prochlorococcus marinus subsp; identical to SEQ ID NO: 2872
  CDS (1)..(1113)

SEQ ID NO: 11214 - protein, 370 aa, Prochlorococcus marinus subsp; identical to SEQ ID NO: 2873

SEQ ID NO: 11215 - DNA, 1140 bp, Prochlorococcus marinus; identical to SEQ ID NO: 2874
  CDS (1)..(1140)

SEQ ID NO: 11216 - protein, 379 aa, Prochlorococcus marinus; identical to SEQ ID NO: 2875

SEQ ID NO: 11217 - DNA, 1140 bp, Prochlorococcus marinus; identical to SEQ ID NO: 2876
  CDS (1)..(1140)

SEQ ID NO: 11218 - protein, 379 aa, Prochlorococcus marinus; identical to SEQ ID NO: 2877

SEQ ID NO: 11219 - DNA, 1038 bp, Helicobacter hepaticus; identical to SEQ ID NO: 2878
  CDS (1)..(1038)

SEQ ID NO: 11220 - protein, 345 aa, Helicobacter hepaticus; identical to SEQ ID NO: 2879

SEQ ID NO: 11221 - DNA, 1119 bp, Haemophilus ducreyi; identical to SEQ ID NO: 2880
  CDS (1)..(1119)

SEQ ID NO: 11222 - protein, 372 aa, Haemophilus ducreyi; identical to SEQ ID NO: 2881

SEQ ID NO: 11223 - DNA, 1048 bp, Campylobacter lari; identical to SEQ ID NO: 2882
  CDS (9)..(1043)

SEQ ID NO: 11224 - protein, 344 aa, Campylobacter lari; identical to SEQ ID NO: 2883

SEQ ID NO: 11225 - DNA, 1077 bp, Burkholderia fungorum; identical to SEQ ID NO: 2884
  CDS (1)..(1077)

SEQ ID NO: 11226 - protein, 358 aa, Burkholderia fungorum; identical to SEQ ID NO: 2885

SEQ ID NO: 11227 - DNA, 963 bp, Mycobacteriophage CJW1; identical to SEQ ID NO: 2886
  CDS (1)..(963)

SEQ ID NO: 11228 - protein, 320 aa, Mycobacteriophage CJW1; identical to SEQ ID NO: 2887

SEQ ID NO: 11229 - DNA, 1563 bp, Zymomonas mobilis; identical to SEQ ID NO: 2888
  CDS (231)..(1250)

SEQ ID NO: 11230 - protein, 339 aa, Zymomonas mobilis; identical to SEQ ID NO: 2889

SEQ ID NO: 11231 - DNA, 1038 bp, Bacillus megaterium; identical to SEQ ID NO: 2890
  CDS (1)..(1038)

SEQ ID NO: 11232 - protein, 345 aa, Bacillus megaterium; identical to SEQ ID NO: 2891

SEQ ID NO: 11233 - DNA, 1038 bp, Bacillus megaterium; identical to SEQ ID NO: 2892
  CDS (1)..(1038)

SEQ ID NO: 11234 - protein, 345 aa, Bacillus megaterium; identical to SEQ ID NO: 2893

SEQ ID NO: 11235 - DNA, 1044 bp, Bacillus amyloliquefaciens; identical to SEQ ID NO: 2894
  CDS (1)..(1044)

SEQ ID NO: 11236 - protein, 347 aa, Bacillus amyloliquefaciens; identical to SEQ ID NO: 2895

SEQ ID NO: 11237 - DNA, 1047 bp, Listeria monocytogenes; identical to SEQ ID NO: 2896
  CDS (1)..(1047): m means a or c

SEQ ID NO: 11238 - protein, 348 aa, Listeria monocytogenes; identical to SEQ ID NO: 2897
  misc_feature (228)..(228): Xaa can be Pro or Gln

SEQ ID NO: 11239 - DNA, 1035 bp, Oryza sativa; identical to SEQ ID NO: 2898
  CDS (1)..(1035)

SEQ ID NO: 11240 - protein, 344 aa, Oryza sativa; identical to SEQ ID NO: 2899

SEQ ID NO: 11241 - DNA, 1035 bp, Campylobacter lari; identical to SEQ ID NO: 2900
  CDS (1)..(1035)

SEQ ID NO: 11242 - protein, 344 aa, Campylobacter lari; identical to SEQ ID NO: 2901

SEQ ID NO: 11243 - DNA, 2035 bp, Borrelia hermsii; identical to SEQ ID NO: 2902
  CDS (256)..(1326)

SEQ ID NO: 11244 - protein, 356 aa, Borrelia hermsii; identical to SEQ ID NO: 2903

SEQ ID NO: 11245 - DNA, 1487 bp, Chlamydomonas reinhardtii; identical to SEQ ID NO: 2904
  CDS (121)..(1365)

SEQ ID NO: 11246 - protein, 414 aa, Chlamydomonas reinhardtii; identical to SEQ ID NO: 2905

SEQ ID NO: 11247 - DNA, 1669 bp, Streptococcus suis; identical to SEQ ID NO: 2906
  CDS (469)..(1500)

SEQ ID NO: 11248 - protein, 343 aa, Streptococcus suis; identical to SEQ ID NO: 2907

SEQ ID NO: 11249 - DNA, 1439 bp, Peanut witches; identical to SEQ ID NO: 2908
  CDS (218)..(1228)

SEQ ID NO: 11250 - protein, 336 aa, Peanut witches; identical to SEQ ID NO: 2909

SEQ ID NO: 11251 - DNA, 1377 bp, Myxococcus xanthus; identical to SEQ ID NO: 2910
  CDS (201)..(1277)

SEQ ID NO: 11252 - protein, 358 aa, Myxococcus xanthus; identical to SEQ ID NO: 2911

SEQ ID NO: 11253 - DNA, 1404 bp, Acidiphilium facilis; identical to SEQ ID NO: 2912
  CDS (187)..(1251)

SEQ ID NO: 11254 - protein, 354 aa, Acidiphilium facilis; identical to SEQ ID NO: 2913

SEQ ID NO: 11255 - DNA, 1059 bp, Actinobacillus actinomycetemcomitans; identical to SEQ ID NO: 2914
  CDS (1)..(1059)

SEQ ID NO: 11256 - protein, 352 aa, Actinobacillus actinomycetemcomitans; identical to SEQ ID NO: 2915

SEQ ID NO: 11257 - DNA, 1565 bp, Alcaligenes eutrophus; identical to SEQ ID NO: 2916
  CDS (194)..(1255)

SEQ ID NO: 11258 - protein, 353 aa, Alcaligenes eutrophus; identical to SEQ ID NO: 2917

SEQ ID NO: 11259 - DNA, 1047 bp, Amycolatopsis mediterranei; identical to SEQ ID NO: 2918
  CDS (1)..(1047)

SEQ ID NO: 11260 - protein, 348 aa, Amycolatopsis mediterranei; identical to SEQ ID NO: 2919

SEQ ID NO: 11261 - DNA, 1035 bp, Bacteroides thetaiotaomicron; identical to SEQ ID NO: 2920
  CDS (1)..(1035)

SEQ ID NO: 11262 - protein, 344 aa, Bacteroides thetaiotaomicron; identical to SEQ ID NO: 2921

SEQ ID NO: 11263 - DNA, 1194 bp, Bifidobacterium longum; identical to SEQ ID NO: 2922
  CDS (1)..(1194)

SEQ ID NO: 11264 - protein, 397 aa, Bifidobacterium longum; identical to SEQ ID NO: 2923

SEQ ID NO: 11265 - DNA, 1062 bp, Bordetella pertussis; identical to SEQ ID NO: 2924
  CDS (1)..(1062)

SEQ ID NO: 11266 - protein, 353 aa, Bordetella pertussis; identical to SEQ ID NO: 2925

SEQ ID NO: 11267 - DNA, 1089 bp, Bradyrhizobium japonicum; identical to SEQ ID NO: 2926
  CDS (1)..(1089)

SEQ ID NO: 11268 - protein, 362 aa, Bradyrhizobium japonicum; identical to SEQ ID NO: 2927

SEQ ID NO: 11269 - DNA, 2058 bp, Campylobacter fetus; identical to SEQ ID NO: 2928
  CDS (401)..(1438)

SEQ ID NO: 11270 - protein, 345 aa, Campylobacter fetus; identical to SEQ ID NO: 2929

SEQ ID NO: 11271 - DNA, 1458 bp, Chloroflexus aurantiacus; identical to SEQ ID NO: 2930
  CDS (116)..(1171)

SEQ ID NO: 11272 - protein, 351 aa, Chloroflexus aurantiacus; identical to SEQ ID NO: 2931

SEQ ID NO: 11273 - DNA, 1053 bp, Chlamydophila caviae; identical to SEQ ID NO: 2932
  CDS (1)..(1053)

SEQ ID NO: 11274 - protein, 350 aa, Chlamydophila caviae; identical to SEQ ID NO: 2933

SEQ ID NO: 11275 - DNA, 1087 bp, Chromatium vinosum; identical to SEQ ID NO: 2934
  CDS (1)..(1044)

SEQ ID NO: 11276 - protein, 347 aa, Chromatium vinosum; identical to SEQ ID NO: 2935

SEQ ID NO: 11277 - DNA, 1346 bp, Clostridium perfringens; identical to SEQ ID NO: 2936
  CDS (172)..(1230)

SEQ ID NO: 11278 - protein, 352 aa, Clostridium perfringens; identical to SEQ ID NO: 2937

SEQ ID NO: 11279 - DNA, 1053 bp, Clostridium tetani; identical to SEQ ID NO: 2938
  CDS (1)..(1053)

SEQ ID NO: 11280 - protein, 350 aa, Clostridium tetani; identical to SEQ ID NO: 2939

SEQ ID NO: 11281 - DNA, 1161 bp, Corynebacterium efficiens; identical to SEQ ID NO: 2940
  CDS (1)..(1161)

SEQ ID NO: 11282 - protein, 386 aa, Corynebacterium efficiens; identical to SEQ ID NO: 2941

SEQ ID NO: 11283 - DNA, 1402 bp, Corynebacterium glutamicum; identical to SEQ ID NO: 2942
  CDS (133)..(1263)

SEQ ID NO: 11284 - protein, 376 aa, Corynebacterium glutamicum; identical to SEQ ID NO: 2943

SEQ ID NO: 11285 - DNA, 1409 bp, Corynebacterium pseudotuberculosis; identical to SEQ ID NO: 2944
  CDS (223)..(1332)

SEQ ID NO: 11286 - protein, 369 aa, Corynebacterium pseudotuberculosis; identical to SEQ ID NO: 2945

SEQ ID NO: 11287 - DNA, 1032 bp, Coxiella burnetii; identical to SEQ ID NO: 2946
  CDS (1)..(1032)

SEQ ID NO: 11288 - protein, 343 aa, Coxiella burnetii; identical to SEQ ID NO: 2947

SEQ ID NO: 11289 - DNA, 1047 bp, Enterococcus faecalis; identical to SEQ ID NO: 2948
  CDS (1)..(1047)

SEQ ID NO: 11290 - protein, 348 aa, Enterococcus faecalis; identical to SEQ ID NO: 2949

SEQ ID NO: 11291 - DNA, 1072 bp, Erwinia carotovora; identical to SEQ ID NO: 2950
  CDS (1)..(1029)

SEQ ID NO: 11292 - protein, 342 aa, Erwinia carotovora; identical to SEQ ID NO: 2951

SEQ ID NO: 11293 - DNA, 1137 bp, Fusobacterium nucleatum; identical to SEQ ID NO: 2952
  CDS (1)..(1137)

SEQ ID NO: 11294 - protein, 378 aa, Fusobacterium nucleatum; identical to SEQ ID NO: 2953

SEQ ID NO: 11295 - DNA, 1613 bp, Herbaspirillum seropedicae; identical to SEQ ID NO: 2954
  CDS (199)..(1254)

SEQ ID NO: 11296 - protein, 351 aa, Herbaspirillum seropedicae; identical to SEQ ID NO: 2955

SEQ ID NO: 11297 - DNA, 1143 bp, Lactobacillus plantarum; identical to SEQ ID NO: 2956
  CDS (1)..(1143)

SEQ ID NO: 11298 - protein, 380 aa, Lactobacillus plantarum; identical to SEQ ID NO: 2957

SEQ ID NO: 11299 - DNA, 1101 bp, Leptospira interrogans; identical to SEQ ID NO: 2958
  CDS (1)..(1101)

SEQ ID NO: 11300 - protein, 366 aa, Leptospira interrogans; identical to SEQ ID NO: 2959

SEQ ID NO: 11301 - DNA, 1126 bp, Mycoplasma mycoides; identical to SEQ ID NO: 2960
  CDS (79)..(1116)

SEQ ID NO: 11302 - protein, 345 aa, Mycoplasma mycoides; identical to SEQ ID NO: 2961

SEQ ID NO: 11303 - DNA, 1050 bp, Mycobacterium smegmatis; identical to SEQ ID NO: 2962
  CDS (1)..(1050)

SEQ ID NO: 11304 - protein, 349 aa, Mycobacterium smegmatis; identical to SEQ ID NO: 2963

SEQ ID NO: 11305 - DNA, 1044 bp, Oceanobacillus iheyensis; identical to SEQ ID NO: 2964
  CDS (1)..(1044)

SEQ ID NO: 11306 - protein, 347 aa, Oceanobacillus iheyensis; identical to SEQ ID NO: 2965

SEQ ID NO: 11307 - DNA, 1071 bp, Paracoccus denitrificans; identical to SEQ ID NO: 2966
  CDS (1)..(1071)

SEQ ID NO: 11308 - protein, 356 aa, Paracoccus denitrificans; identical to SEQ ID NO: 2967

SEQ ID NO: 11309 - DNA, 1320 bp, Pasteurella haemolytica; identical to SEQ ID NO: 2968
  CDS (157)..(1263)

SEQ ID NO: 11310 - protein, 368 aa, Pasteurella haemolytica; identical to SEQ ID NO: 2969

SEQ ID NO: 11311 - DNA, 1500 bp, Pasteurella multocida; identical to SEQ ID NO: 2970
  CDS (175)..(1239)

SEQ ID NO: 11312 - protein, 354 aa, Pasteurella multocida; identical to SEQ ID NO: 2971

SEQ ID NO: 11313 - DNA, 1023 bp, Porphyromonas gingivalis; identical to SEQ ID NO: 2972
  CDS (1)..(1023)

SEQ ID NO: 11314 - protein, 340 aa, Porphyromonas gingivalis; identical to SEQ ID NO: 2973

SEQ ID NO: 11315 - DNA, 1824 bp, Prevotella ruminicola; identical to SEQ ID NO: 2974
  CDS (501)..(1523)

SEQ ID NO: 11316 - protein, 340 aa, Prevotella ruminicola; identical to SEQ ID NO: 2975

SEQ ID NO: 11317 - DNA, 978 bp, Proteus vulgaris; identical to SEQ ID NO: 2976
  CDS (1)..(978)

SEQ ID NO: 11318 - protein, 325 aa, Proteus vulgaris; identical to SEQ ID NO: 2977

SEQ ID NO: 11319 - DNA, 1047 bp, Pseudomonas oleovorans; identical to SEQ ID NO: 2978
  CDS (1)..(1047)

SEQ ID NO: 11320 - protein, 348 aa, Pseudomonas oleovorans; identical to SEQ ID NO: 2979

SEQ ID NO: 11321 - DNA, 1068 bp, Pseudomonas putida; identical to SEQ ID NO: 2980
  CDS (1)..(1068)

SEQ ID NO: 11322 - protein, 355 aa, Pseudomonas putida; identical to SEQ ID NO: 2981

SEQ ID NO: 11323 - DNA, 1110 bp, Pseudomonas syringae; identical to SEQ ID NO: 2982
  CDS (46)..(1110)

SEQ ID NO: 11324 - protein, 354 aa, Pseudomonas syringae; identical to SEQ ID NO: 2983

SEQ ID NO: 11325 - DNA, 1980 bp, Pseudomonas tolaasii; identical to SEQ ID NO: 2984
  CDS (414)..(1472)

SEQ ID NO: 11326 - protein, 352 aa, Pseudomonas tolaasii; identical to SEQ ID NO: 2985

SEQ ID NO: 11327 - DNA, 1501 bp, Rhizobium etli; identical to SEQ ID NO: 2986
  CDS (242)..(1327)

SEQ ID NO: 11328 - protein, 361 aa, Rhizobium etli; identical to SEQ ID NO: 2987

SEQ ID NO: 11329 - DNA, 1098 bp, Rhizobium loti; identical to SEQ ID NO: 2988
  CDS (1)..(1098)

SEQ ID NO: 11330 - protein, 365 aa, Rhizobium loti; identical to SEQ ID NO: 2989

SEQ ID NO: 11331 - DNA, 1092 bp, Rhodopseudomonas palustris; identical to SEQ ID NO: 2990
  CDS (1)..(1092)

SEQ ID NO: 11332 - protein, 363 aa, Rhodopseudomonas palustris; identical to SEQ ID NO: 2991

SEQ ID NO: 11333 - DNA, 1047 bp, Rhodopseudomonas viridis; identical to SEQ ID NO: 2992
  CDS (1)..(1047)

SEQ ID NO: 11334 - protein, 348 aa, Rhodopseudomonas viridis; identical to SEQ ID NO: 2993

SEQ ID NO: 11335 - DNA, 1074 bp, Shewanella oneidensis; identical to SEQ ID NO: 2994
  CDS (1)..(1074)

SEQ ID NO: 11336 - protein, 357 aa, Shewanella oneidensis; identical to SEQ ID NO: 2995

SEQ ID NO: 11337 - DNA, 1235 bp, Spirulina platensis; identical to SEQ ID NO: 2996
  CDS (54)..(1151)

SEQ ID NO: 11338 - protein, 365 aa, Spirulina platensis; identical to SEQ ID NO: 2997

SEQ ID NO: 11339 - DNA, 1074 bp, Staphylococcus epidermidis; identical to SEQ ID NO: 2998
  CDS (25)..(1074)

SEQ ID NO: 11340 - protein, 349 aa, Staphylococcus epidermidis; identical to SEQ ID NO: 2999

SEQ ID NO: 11341 - DNA, 1140 bp, Streptococcus agalactiae; identical to SEQ ID NO: 3000
  CDS (1)..(1140)

SEQ ID NO: 11342 - protein, 379 aa, Streptococcus agalactiae; identical to SEQ ID NO: 3001

SEQ ID NO: 11343 - DNA, 1119 bp, Streptomyces ambofaciens; identical to SEQ ID NO: 3002
  CDS (1)..(1119)

SEQ ID NO: 11344 - protein, 372 aa, Streptomyces ambofaciens; identical to SEQ ID NO: 3003

SEQ ID NO: 11345 - DNA, 1134 bp, Streptomyces avermitilis; identical to SEQ ID NO: 3004
  CDS (1)..(1134)

SEQ ID NO: 11346 - protein, 377 aa, Streptomyces avermitilis; identical to SEQ ID NO: 3005

SEQ ID NO: 11347 - DNA, 1152 bp, Streptococcus mutans; identical to SEQ ID NO: 3006
  CDS (1)..(1152)

SEQ ID NO: 11348 - protein, 383 aa, Streptococcus mutans; identical to SEQ ID NO: 3007

SEQ ID NO: 11349 - DNA, 1137 bp, Streptococcus pyogenes; identical to SEQ ID NO: 3008
  CDS (1)..(1137)

SEQ ID NO: 11350 - protein, 378 aa, Streptococcus pyogenes; identical to SEQ ID NO: 3009

SEQ ID NO: 11351 - DNA, 1356 bp, Streptococcus parasanguis; identical to SEQ ID NO: 3010
  CDS (118)..(1263)

SEQ ID NO: 11352 - protein, 381 aa, Streptococcus parasanguis; identical to SEQ ID NO: 3011

SEQ ID NO: 11353 - DNA, 1416 bp, Streptomyces rimosus; identical to SEQ ID NO: 3012
  CDS (229)..(1359)

SEQ ID NO: 11354 - protein, 376 aa, Streptomyces rimosus; identical to SEQ ID NO: 3013

SEQ ID NO: 11355 - DNA, 1916 bp, Streptococcus thermophilus; identical to SEQ ID NO: 3014
  CDS (555)..(1694)

SEQ ID NO: 11356 - protein, 379 aa, Streptococcus thermophilus; identical to SEQ ID NO: 3015

SEQ ID NO: 11357 - DNA, 1271 bp, Streptomyces violaceus; identical to SEQ ID NO: 3016
  CDS (75)..(1208)

SEQ ID NO: 11358 - protein, 377 aa, Streptomyces violaceus; identical to SEQ ID NO: 3017

SEQ ID NO: 11359 - DNA, 1068 bp, Synechococcus elongatus; identical to SEQ ID NO: 3018
  CDS (1)..(1068)

SEQ ID NO: 11360 - protein, 355 aa, Synechococcus elongatus; identical to SEQ ID NO: 3019

SEQ ID NO: 11361 - DNA, 1023 bp, Thermus thermophilus; identical to SEQ ID NO: 3020
  CDS (1)..(1023)

SEQ ID NO: 11362 - protein, 340 aa, Thermus thermophilus; identical to SEQ ID NO: 3021

SEQ ID NO: 11363 - DNA, 1405 bp, Thiobacillus ferrooxidans; identical to SEQ ID NO: 3022
  CDS (196)..(1236)

SEQ ID NO: 11364 - protein, 346 aa, Thiobacillus ferrooxidans; identical to SEQ ID NO: 3023

SEQ ID NO: 11365 - DNA, 1314 bp, Tropheryma whipplei; identical to SEQ ID NO: 3024
  CDS (1)..(1314)

SEQ ID NO: 11366 - protein, 437 aa, Tropheryma whipplei; identical to SEQ ID NO: 3025

SEQ ID NO: 11367 - DNA, 1411 bp, Vibrio cholerae; identical to SEQ ID NO: 3026
  CDS (183)..(1247)

SEQ ID NO: 11368 - protein, 354 aa, Vibrio cholerae; identical to SEQ ID NO: 3027

SEQ ID NO: 11369 - DNA, 1044 bp, Vibrio parahaemolyticus; identical to SEQ ID NO: 3028
  CDS (1)..(1044)

SEQ ID NO: 11370 - protein, 347 aa, Vibrio parahaemolyticus; identical to SEQ ID NO: 3029

SEQ ID NO: 11371 - DNA, 996 bp, Wigglesworthia glossinidia brevipalpis; identical to SEQ ID NO: 3030
  CDS (1)..(996)

SEQ ID NO: 11372 - protein, 331 aa, Wigglesworthia glossinidia brevipalpis; identical to SEQ ID NO: 3031

SEQ ID NO: 11373 - DNA, 1035 bp, Xanthomonas axonopodis; identical to SEQ ID NO: 3032
  CDS (1)..(1035)

SEQ ID NO: 11374 - protein, 344 aa, Xanthomonas axonopodis; identical to SEQ ID NO: 3033

SEQ ID NO: 11375 - DNA, 1594 bp, Xenorhabdus nematophilus; identical to SEQ ID NO: 3034
  CDS (142)..(1218)

SEQ ID NO: 11376 - protein, 358 aa, Xenorhabdus nematophilus; identical to SEQ ID NO: 3035

SEQ ID NO: 11377 - DNA, 1044 bp, Xylella fastidiosa; identical to SEQ ID NO: 3036
  CDS (1)..(1044)

SEQ ID NO: 11378 - protein, 347 aa, Xylella fastidiosa; identical to SEQ ID NO: 3037

SEQ ID NO: 11379 - DNA, 1020 bp, Zymomonas mobilis; identical to SEQ ID NO: 3038
  CDS (1)..(1020)

SEQ ID NO: 11380 - protein, 339 aa, Zymomonas mobilis; identical to SEQ ID NO: 3039

SEQ ID NO: 11381 - DNA, 1660 bp, primary endosymbiont of Sitophilus oryzae; identical to SEQ ID NO: 3040
  CDS (11)..(1078)

SEQ ID NO: 11382 - protein, 355 aa, primary endosymbiont of Sitophilus oryzae; identical to SEQ ID NO: 3041

SEQ ID NO: 11383 - DNA, 1110 bp, Azospirillum lipoferum; identical to SEQ ID NO: 3042
  CDS (1)..(1110)

SEQ ID NO: 11384 - protein, 369 aa, Azospirillum lipoferum; identical to SEQ ID NO: 3043

SEQ ID NO: 11385 - DNA, 1017 bp, Geobacter sulfurreducens; identical to SEQ ID NO: 3044
  CDS (1)..(1017)

SEQ ID NO: 11386 - protein, 338 aa, Geobacter sulfurreducens; identical to SEQ ID NO: 3045

SEQ ID NO: 11387 - DNA, 1230 bp, Mycobacterium paratuberculosis; identical to SEQ ID NO: 3046
  CDS (1)..(1230)

SEQ ID NO: 11388 - protein, 409 aa, Mycobacterium paratuberculosis; identical to SEQ ID NO: 3047

SEQ ID NO: 11389 - DNA, 1083 bp, Lactobacillus johnsonii; identical to SEQ ID NO: 3048
  CDS (1)..(1083)

SEQ ID NO: 11390 - protein, 360 aa, Lactobacillus johnsonii; identical to SEQ ID NO: 3049

SEQ ID NO: 11391 - DNA, 1245 bp, Treponema denticola; identical to SEQ ID NO: 3050
  CDS (1)..(1245)

SEQ ID NO: 11392 - protein, 414 aa, Treponema denticola; identical to SEQ ID NO: 3051

SEQ ID NO: 11393 - DNA, 1068 bp, Wolbachia pipientis wMel; identical to SEQ ID NO: 3052
  CDS (1)..(1068)

SEQ ID NO: 11394 - protein, 355 aa, Wolbachia pipientis wMel; identical to SEQ ID NO: 3053

SEQ ID NO: 11395 - DNA, 1074 bp, Desulfovibrio vulgaris; identical to SEQ ID NO: 3054
  CDS (1)..(1074)

SEQ ID NO: 11396 - protein, 357 aa, Desulfovibrio vulgaris; identical to SEQ ID NO: 3055

SEQ ID NO: 11397 - DNA, 1557 bp, Bacillus licheniformis; identical to SEQ ID NO: 3056
  CDS (369)..(1415)

SEQ ID NO: 11398 - protein, 348 aa, Bacillus licheniformis; identical to SEQ ID NO: 3057

SEQ ID NO: 11399 - DNA, 1119 bp, Corynebacterium diphtheriae; identical to SEQ ID NO: 3058
  CDS (1)..(1119)

SEQ ID NO: 11400 - protein, 372 aa, Corynebacterium diphtheriae; identical to SEQ ID NO: 3059

SEQ ID NO: 11401 - DNA, 1038 bp, Mycoplasma mycoides; identical to SEQ ID NO: 3060
  CDS (1)..(1038)

SEQ ID NO: 11402 - protein, 345 aa, Mycoplasma mycoides; identical to SEQ ID NO: 3061

SEQ ID NO: 11403 - DNA, 1134 bp, Bdellovibrio bacteriovorus; identical to SEQ ID NO: 3062
  CDS (1)..(1134)

SEQ ID NO: 11404 - protein, 377 aa, Bdellovibrio bacteriovorus; identical to SEQ ID NO: 3063

SEQ ID NO: 11405 - DNA, 1086 bp, Parachlamydia sp; identical to SEQ ID NO: 3064
  CDS (1)..(1086)

SEQ ID NO: 11406 - protein, 361 aa, Parachlamydia sp; identical to SEQ ID NO: 3065

SEQ ID NO: 11407 - DNA, 1071 bp, Photobacterium profundum; identical to SEQ ID NO: 3066

SEQ ID NO: 11408 - protein, 356 aa, Photobacterium profundum; identical to SEQ ID NO: 3067

SEQ ID NO: 11409 - DNA, 24 bp, Primer
atggctatcgacgaaaacaaacag

SEQ ID NO: 11410 - DNA, 27 bp, Primer
ttaaaaatcttcgttagtttctgctac

SEQ ID NO: 11411 - protein, 57 aa, consensus; identical to SEQ ID NO: 10211
  MISC_FEATURE (1)..(57): consensus for the disclosure of xaa see table XV

SEQ ID NO: 11412 - protein, 28 aa, consensus
  MISC_FEATURE (1)..(28): consensus for the disclosure of xaa see table XV
KWXXXXXXXXXVWXGXXXKXXXXXXXNL

SEQ ID NO: 11413 - protein, 45 aa, consensus; identical to SEQ ID NO: 10213
  MISC_FEATURE (1)..(45): consensus for the disclosure of xaa see table XV

SEQ ID NO: 11414 - protein, 217 aa, consensus; identical to SEQ ID NO: 10214
  MISC_FEATURE (1)..(217): Xaa in all positions is any amino acid.

SEQ ID NO: 11415 - protein, 51 aa, consensus
  MISC_FEATURE (1)..(51): consensus for the disclosure of xaa see table XV
GLXXXXXXXXXXXXXXXXXXXXXXXXXXXXXPXGXEXGXXXXXXXGGXXXR

SEQ ID NO: 11416 - protein, 31 aa, consensus
  MISC_FEATURE (1)..(31): consensus for the disclosure of xaa see table XV
XXXTXXXXXXXXXXXXXXXXXXWXKXXXXXX

SEQ ID NO: 11417 - protein, 57 aa, consensus
  MISC_FEATURE (1)..(57): consensus for the disclosure of xaa see table XV
XXXXDXXXXXXXXXXXXXXXXXXXXXXXXXXXXXXXXXXXXXXXXXXXGXGXNXXXX

SEQ ID NO: 11418 - protein, 27 aa, consensus
  MISC_FEATURE (1)..(27): consensus for the disclosure of xaa see table XV
NXXXXXXXXXXXXXXXXXXXXXDXXXD

SEQ ID NO: 11419 - protein, 638 aa, consensus
  MISC_FEATURE (1)..(638): Xaa in all positions is any amino acid.
GLXXXXXXXXXXXXXXXXXXXXXXXXXVXXXPXGXEXGXXXAXDLGGTNXRVXXVXXXXXXXXXXXXXXXXXXXXXXXXXXXXPXXXXXXXXXXXXXXXXXXXXXXXXXXXLFXXIXXXXXXFXXXXXXXXXXXXXXXXXXXXXXXXXXXXXXXXXGFTFSFPXXQXXXXXXGXLXXWTKGFXXXXXXXXXXXGXXVXXXLXXXXXXXXXXXXXXXXXXXXXXXXXXXXXXXXXXAXXNDTXGTXXXXXXXXXXXXXXXXXXXXXXXXXXXXXXXXXXXXXIXGTGXNXXYXEXXXXXXXXXXXXXXXXXXXXXXXXXXXXXNXEWGXFXXXXXXXXXXXXTXXDXXXDXXSXXXXXXXXXXXXXXXXXXXGXQXXEKXXXGXYXGEXXRXXXXXXXXXXXXXXXXXXXXXXXXXXXXXXXXXXXXXXXXXXXXXXXXXXXXXXXXXXXDXXXXXXXXXXXXXXXXXXXXXXXXXXXXXXXXXXXXXXXXXXXXXXRXAXLXXXXXXXXXXXXXXXXXXXXXXXXXXXXXXXXXXXXXXXXXXXXXXXXXXXXXXXXXXXXXXXXXXXXXXXXXXXXXXXXXXDGXXXXXXXXXXXXXXXXXXXXXXXXXXXXXXXXXXXXXXXXXDGSGXGAAXXXA

SEQ ID NO: 11420 - protein, 25 aa, consensus
  MISC_FEATURE (1)..(25): consensus for the disclosure of xaa see table XV
XXXXXXXXXXXXXXXXXXXXXXXXX

SEQ ID NO: 11421 - protein, 197 aa, consensus
  MISC_FEATURE (1)..(197): Xaa in all positions is any amino acid.
IXXXXXXXXXXXXPXEXXLXXXXXXXRXTXRXAXXXLXXXGXXXXXXGXXXGXXVXXXXXXXXXXXXXXXXXXXXXXXXXXXXXXXXXXXXXXXXXXXXXXXXXXXXXXLXXXXXXXXXXXXXXXRXRXXXXXXXXXXXXXXXXXXXXXXXXXXXXXXXXXXXXXXXXXXXXXXXXXXXXXXXXXXXXXXXXXXXXL

SEQ ID NO: 11422 - protein, 18 aa, consensus
  MISC_FEATURE (1)..(18): consensus for the disclosure of xaa see table XV
XXXXXDXXXXXXXXXXXX

SEQ ID NO: 11423 - protein, 65 aa, consensus
  MISC_FEATURE (1)..(65): consensus for the disclosure of xaa see table XV
XXDXXXXXXXGXXXXXXXXXXXXXXXXXXXXXXXXXXXXXXXXXXXXGXXDXXXKPXXXXEXXXR

SEQ ID NO: 11424 - protein, 33 aa, consensus
  MISC_FEATURE (1)..(33): consensus for the disclosure of xaa see table XV
XXXXXXXXXXRXXXXXXXXXXXXXXXXXXXXGY

SEQ ID NO: 11425 - protein, 258 aa, consensus
  MISC_FEATURE (1)..(258): Xaa in all positions is any amino acid.
LXVXDXXXXXXXXXXXLXXXGXXXXXXXXXXXXXXXXXXXXXXXXXXXXXXXXXXXLDXXXPXXXGXXXXXXXRXXXXXXXXXXXXXXXXXXXXDXXXGLEXGADDYXXKPFXXXELXXRXXXXLRRXXXXXXXXXXXXXXXXXXXXXXXXXXXXXXXXXXXXXXXXXXXXXXXXXXXXXXXLXXXEFXXLXXXXXXXXXXXXRXXLXXXXXXXXXXXXXXXXXXXXXDXXXXRXRXXXXXXXXXXPXXXXTXXGXGY

SEQ ID NO: 11426 - protein, 33 aa, consensus; identical to SEQ ID NO: 4356
  MISC_FEATURE (1)..(33): consensus for the disclosure of xaa see table XV

SEQ ID NO: 11427 - protein, 36 aa, consensus; identical to SEQ ID NO: 4357
  MISC_FEATURE (1)..(36): consensus for the disclosure of xaa see table XV

SEQ ID NO: 11428 - protein, 39 aa, consensus; identical to SEQ ID NO: 4358
  MISC_FEATURE (1)..(39): consensus for the disclosure of xaa see table XV

SEQ ID NO: 11429 - protein, 323 aa, consensus; identical to SEQ ID NO: 5813
  MISC_FEATURE (1)..(323): Xaa in all positions is any amino acid.

SEQ ID NO: 11430 - DNA, 717 bp, Escherichia coli K12; identical to SEQ ID NO: 10741
  CDS (1)..(717)

SEQ ID NO: 11431 - protein, 238 aa, Escherichia coli K12; identical to SEQ ID NO: 10742

SEQ ID NO: 11432 - DNA, 696 bp, Enterococcus faecium; identical to SEQ ID NO: 10743
  CDS (1)..(696)

SEQ ID NO: 11433 - protein, 231 aa, Enterococcus faecium; identical to SEQ ID NO: 10744

SEQ ID NO: 11434 - DNA, 693 bp, Escherichia coli; identical to SEQ ID NO: 10745
  CDS (1)..(693)

SEQ ID NO: 11435 - protein, 230 aa, Escherichia coli; identical to SEQ ID NO: 10746

SEQ ID NO: 11436 - DNA, 699 bp, Bacillus halodurans; identical to SEQ ID NO: 10747
  CDS (1)..(699)

SEQ ID NO: 11437 - protein, 232 aa, Bacillus halodurans; identical to SEQ ID NO: 10748

SEQ ID NO: 11438 - DNA, 699 bp, Sinorhizobium meliloti; identical to SEQ ID NO: 8313
  CDS (1)..(699)

SEQ ID NO: 11439 - protein, 232 aa, Sinorhizobium meliloti; identical to SEQ ID NO: 8314

SEQ ID NO: 11440 - DNA, 699 bp, Salmonella enterica subsp. enterica serovar Typhi; identical to SEQ ID NO: 10751
  CDS (1)..(699)

SEQ ID NO: 11441 - protein, 232 aa, Salmonella enterica subsp. enterica serovar Typhi; identical to SEQ ID NO: 10752

SEQ ID NO: 11442 - DNA, 720 bp, Yersinia pestis; identical to SEQ ID NO: 10753
  CDS (1)..(720)

SEQ ID NO: 11443 - protein, 239 aa, Yersinia pestis; identical to SEQ ID NO: 10754

SEQ ID NO: 11444 - DNA, 717 bp, Nostoc sp. PCC 7120; identical to SEQ ID NO: 10755
  CDS (1)..(717)

SEQ ID NO: 11445 - protein, 238 aa, Nostoc sp. PCC 7120; identical to SEQ ID NO: 10756

SEQ ID NO: 11446 - DNA, 714 bp, Agrobacterium tumefaciens; identical to SEQ ID NO: 10757
  CDS (1)..(714)

SEQ ID NO: 11447 - protein, 237 aa, Agrobacterium tumefaciens; identical to SEQ ID NO: 10758

SEQ ID NO: 11448 - DNA, 720 bp, Brucella melitensis; identical to SEQ ID NO: 10759
  CDS (1)..(720)

SEQ ID NO: 11449 - protein, 239 aa, Brucella melitensis; identical to SEQ ID NO: 10760

SEQ ID NO: 11450 - DNA, 717 bp, Brucella melitensis; identical to SEQ ID NO: 10761
  CDS (1)..(717)

SEQ ID NO: 11451 - protein, 238 aa, Brucella melitensis; identical to SEQ ID NO: 10762

SEQ ID NO: 11452 - DNA, 717 bp, Yersinia pestis; identical to SEQ ID NO: 10763
  CDS (1)..(717)

SEQ ID NO: 11453 - protein, 238 aa, Yersinia pestis; identical to SEQ ID NO: 10764

SEQ ID NO: 11454 - DNA, 729 bp, Nostoc sp. PCC 7120; identical to SEQ ID NO: 8329
  CDS (1)..(729)

SEQ ID NO: 11455 - protein, 242 aa, Nostoc sp. PCC 7120; identical to SEQ ID NO: 8330

SEQ ID NO: 11456 - DNA, 762 bp, Nostoc sp. PCC 7120; identical to SEQ ID NO: 8331
  CDS (1)..(762)

SEQ ID NO: 11457 - protein, 253 aa, Nostoc sp. PCC 7120; identical to SEQ ID NO: 8332

SEQ ID NO: 11458 - DNA, 717 bp, Nostoc sp. PCC 7120; identical to SEQ ID NO: 8333
  CDS (1)..(717)

SEQ ID NO: 11459 - protein, 238 aa, Nostoc sp. PCC 7120; identical to SEQ ID NO: 8334

SEQ ID NO: 11460 - DNA, 738 bp, Yersinia pestis; identical to SEQ ID NO: 10771
  CDS (1)..(738)

SEQ ID NO: 11461 - protein, 245 aa, Yersinia pestis; identical to SEQ ID NO: 10772

SEQ ID NO: 11462 - DNA, 762 bp, Agrobacterium tumefaciens; identical to SEQ ID NO: 10773
  CDS (1)..(762)

SEQ ID NO: 11463 - protein, 253 aa, Agrobacterium tumefaciens; identical to SEQ ID NO: 10774

SEQ ID NO: 11464 - DNA, 726 bp, Bacillus halodurans; identical to SEQ ID NO: 10775
  CDS (1)..(726)

SEQ ID NO: 11465 - protein, 241 aa, Bacillus halodurans; identical to SEQ ID NO: 10776

SEQ ID NO: 11466 - DNA, 765 bp, Caulobacter crescentus; identical to SEQ ID NO: 10777
  CDS (1)..(765)

SEQ ID NO: 11467 - protein, 254 aa, Caulobacter crescentus; identical to SEQ ID NO: 10778

SEQ ID NO: 11468 - DNA, 708 bp, Staphylococcus aureus; identical to SEQ ID NO: 10779
  CDS (1)..(708)

SEQ ID NO: 11469 - protein, 235 aa, Staphylococcus aureus; identical to SEQ ID NO: 8338

SEQ ID NO: 11470 - DNA, 675 bp, Clostridium acetobutylicum; identical to SEQ ID NO: 8339
  CDS (1)..(675)

SEQ ID NO: 11471 - protein, 224 aa, Clostridium acetobutylicum; identical to SEQ ID NO: 8340

SEQ ID NO: 11472 - DNA, 756 bp, Streptococcus pneumoniae; identical to SEQ ID NO: 8341
  CDS (1)..(756)

SEQ ID NO: 11473 - protein, 251 aa, Streptococcus pneumoniae; identical to SEQ ID NO: 8342

SEQ ID NO: 11474 - DNA, 684 bp, Haemophilus influenzae; identical to SEQ ID NO: 10785
  CDS (1)..(684)

SEQ ID NO: 11475 - protein, 227 aa, Haemophilus influenzae; identical to SEQ ID NO: 10786

SEQ ID NO: 11476 - DNA, 1110 bp, Bacillus subtilis; identical to SEQ ID NO: 10787
  CDS (1)..(1110)

SEQ ID NO: 11477 - protein, 369 aa, Bacillus subtilis; identical to SEQ ID NO: 10788

SEQ ID NO: 11478 - DNA, 723 bp, Vibrio cholerae; identical to SEQ ID NO: 10789
  CDS (1)..(723)

SEQ ID NO: 11479 - protein, 240 aa, Vibrio cholerae; identical to SEQ ID NO: 10790

SEQ ID NO: 11480 - DNA, 762 bp, Pseudomonas aeruginosa; identical to SEQ ID NO: 10791
  CDS (19)..(762)

SEQ ID NO: 11481 - protein, 247 aa, Pseudomonas aeruginosa; identical to SEQ ID NO: 10792

SEQ ID NO: 11482 - DNA, 711 bp, Bacillus halodurans; identical to SEQ ID NO: 8345
  CDS (1)..(711)

SEQ ID NO: 11483 - protein, 236 aa, Bacillus halodurans; identical to SEQ ID NO: 8346

SEQ ID NO: 11484 - DNA, 744 bp, Thermotoga maritima; identical to SEQ ID NO: 8347
  CDS (1)..(744)

SEQ ID NO: 11485 - protein, 247 aa, Thermotoga maritima; identical to SEQ ID NO: 8348

SEQ ID NO: 11486 - DNA, 705 bp, Bacillus halodurans; identical to SEQ ID NO: 10797
  CDS (1)..(705)

SEQ ID NO: 11487 - protein, 234 aa, Bacillus halodurans; identical to SEQ ID NO: 10798

SEQ ID NO: 11488 - DNA, 684 bp, Bacillus halodurans; identical to SEQ ID NO: 10799
  CDS (1)..(684)

SEQ ID NO: 11489 - protein, 227 aa, Bacillus halodurans; identical to SEQ ID NO: 10800

SEQ ID NO: 11490 - DNA, 717 bp, Bacillus halodurans; identical to SEQ ID NO: 8349
  CDS (1)..(717)

SEQ ID NO: 11491 - protein, 238 aa, Bacillus halodurans; identical to SEQ ID NO: 8350

SEQ ID NO: 11492 - DNA, 726 bp, Staphylococcus aureus; identical to SEQ ID NO: 8351
  CDS (1)..(726)

SEQ ID NO: 11493 - protein, 241 aa, Staphylococcus aureus; identical to SEQ ID NO: 8352

SEQ ID NO: 11494 - DNA, 738 bp, Sinorhizobium meliloti; identical to SEQ ID NO: 10805
  CDS (1)..(738)

SEQ ID NO: 11495 - protein, 245 aa, Sinorhizobium meliloti; identical to SEQ ID NO: 10806

SEQ ID NO: 11496 - DNA, 729 bp, Pseudomonas aeruginosa; identical to SEQ ID NO: 10807
  CDS (1)..(729)

SEQ ID NO: 11497 - protein, 242 aa, Pseudomonas aeruginosa; identical to SEQ ID NO: 10808

SEQ ID NO: 11498 - DNA, 702 bp, Lactococcus lactis subsp. lactis; identical to SEQ ID NO: 10809
  CDS (1)..(702)

SEQ ID NO: 11499 - protein, 233 aa, Lactococcus lactis subsp. lactis; identical to SEQ ID NO: 10810

SEQ ID NO: 11500 - DNA, 684 bp, Mycobacterium tuberculosis; identical to SEQ ID NO: 10811
  CDS (1)..(684)

SEQ ID NO: 11501 - protein, 227 aa, Mycobacterium tuberculosis; identical to SEQ ID NO: 10812

SEQ ID NO: 11502 - DNA, 741 bp, Pseudomonas aeruginosa; identical to SEQ ID NO: 10813
  CDS (1)..(741)

SEQ ID NO: 11503 - protein, 246 aa, Pseudomonas aeruginosa; identical to SEQ ID NO: 10814

SEQ ID NO: 11504 - DNA, 705 bp, Vibrio cholerae; identical to SEQ ID NO: 10815
  CDS (1)..(705)

SEQ ID NO: 11505 - protein, 234 aa, Vibrio cholerae; identical to SEQ ID NO: 10816

SEQ ID NO: 11506 - DNA, 699 bp, Clostridium acetobutylicum; identical to SEQ ID NO: 8375
  CDS (1)..(699)

SEQ ID NO: 11507 - protein, 232 aa, Clostridium acetobutylicum; identical to SEQ ID NO: 8376

SEQ ID NO: 11508 - DNA, 717 bp, Vibrio cholerae; identical to SEQ ID NO: 10819
  CDS (1)..(717)

SEQ ID NO: 11509 - protein, 238 aa, Vibrio cholerae; identical to SEQ ID NO: 10820

SEQ ID NO: 11510 - DNA, 735 bp, Pseudomonas aeruginosa; identical to SEQ ID NO: 10821
  CDS (1)..(735)

SEQ ID NO: 11511 - protein, 244 aa, Pseudomonas aeruginosa; identical to SEQ ID NO: 10822

SEQ ID NO: 11512 - DNA, 711 bp, Haemophilus influenzae; identical to SEQ ID NO: 10823
  CDS (1)..(711)

SEQ ID NO: 11513 - protein, 236 aa, Haemophilus influenzae; identical to SEQ ID NO: 10824

SEQ ID NO: 11514 - DNA, 726 bp, Agrobacterium rhizogenes; identical to SEQ ID NO: 10825
  CDS (1)..(726)

SEQ ID NO: 11515 - protein, 241 aa, Agrobacterium rhizogenes; identical to SEQ ID NO: 10826

SEQ ID NO: 11516 - DNA, 717 bp, Rhizobium sp; identical to SEQ ID NO: 10827
  CDS (1)..(717)

SEQ ID NO: 11517 - protein, 238 aa, Rhizobium sp; identical to SEQ ID NO: 10828

SEQ ID NO: 11518 - DNA, 774 bp, Synechococcus sp; identical to SEQ ID NO: 8383
  CDS (1)..(774)

SEQ ID NO: 11519 - protein, 257 aa, Synechococcus sp; identical to SEQ ID NO: 8384

SEQ ID NO: 11520 - DNA, 708 bp, Bacillus subtilis; identical to SEQ ID NO: 8385
  CDS (1)..(708)

SEQ ID NO: 11521 - protein, 235 aa, Bacillus subtilis; identical to SEQ ID NO: 8386

SEQ ID NO: 11522 - DNA, 720 bp, Xenorhabdus nematophilus; identical to SEQ ID NO: 10833
  CDS (1)..(720)

SEQ ID NO: 11523 - protein, 239 aa, Xenorhabdus nematophilus; identical to SEQ ID NO: 10834

SEQ ID NO: 11524 - DNA, 738 bp, Synechocystis sp; identical to SEQ ID NO: 8387
  CDS (1)..(738)

SEQ ID NO: 11525 - protein, 245 aa, Synechocystis sp; identical to SEQ ID NO: 8388

SEQ ID NO: 11526 - DNA, 789 bp, Synechocystis sp; identical to SEQ ID NO: 8393
  CDS (1)..(789)

SEQ ID NO: 11527 - protein, 262 aa, Synechocystis sp; identical to SEQ ID NO: 8394

SEQ ID NO: 11528 - DNA, 720 bp, cyanelle Cyanophora paradoxa; identical to SEQ ID NO: 10839
  CDS (1)..(720)

SEQ ID NO: 11529 - protein, 239 aa, cyanelle Cyanophora paradoxa; identical to SEQ ID NO: 10840

SEQ ID NO: 11530 - DNA, 717 bp, Bacillus licheniformis; identical to SEQ ID NO: 8395
  CDS (1)..(717)

SEQ ID NO: 11531 - protein, 238 aa, Bacillus licheniformis; identical to SEQ ID NO: 8396

SEQ ID NO: 11532 - DNA, 1116 bp, synthetic construct; identical to SEQ ID NO: 10843
  CDS (1)..(1116)

SEQ ID NO: 11533 - protein, 371 aa, synthetic construct; identical to SEQ ID NO: 10844

SEQ ID NO: 11534 - DNA, 699 bp, Rhodobacter sphaeroides; identical to SEQ ID NO: 10845
  CDS (1)..(699)

SEQ ID NO: 11535 - protein, 232 aa, Rhodobacter sphaeroides; identical to SEQ ID NO: 10846

SEQ ID NO: 11536 - DNA, 1288 bp, Rhodobacter sphaeroides; identical to SEQ ID NO: 10847
  CDS (60)..(758)

SEQ ID NO: 11537 - protein, 232 aa, Rhodobacter sphaeroides; identical to SEQ ID NO: 10848

SEQ ID NO: 11538 - DNA, 735 bp, Bordetella bronchiseptica; identical to SEQ ID NO: 10849
  CDS (1)..(735)

SEQ ID NO: 11539 - protein, 244 aa, Bordetella bronchiseptica; identical to SEQ ID NO: 10850

SEQ ID NO: 11540 - DNA, 726 bp, Agrobacterium tumefaciens; identical to SEQ ID NO: 10851
  CDS (1)..(726)

SEQ ID NO: 11541 - protein, 241 aa, Agrobacterium tumefaciens; identical to SEQ ID NO: 10852

SEQ ID NO: 11542 - DNA, 804 bp, Agrobacterium tumefaciens; identical to SEQ ID NO: 10853
  CDS (1)..(804)

SEQ ID NO: 11543 - protein, 267 aa, Agrobacterium tumefaciens; identical to SEQ ID NO: 10854

SEQ ID NO: 11544 - DNA, 705 bp, Synechococcus sp; identical to SEQ ID NO: 8407
  CDS (1)..(705)

SEQ ID NO: 11545 - protein, 234 aa, Synechococcus sp; identical to SEQ ID NO: 8408

SEQ ID NO: 11546 - DNA, 732 bp, Vibrio vulnificus; identical to SEQ ID NO: 10857
  CDS (1)..(732)

SEQ ID NO: 11547 - protein, 243 aa, Vibrio vulnificus; identical to SEQ ID NO: 10858

SEQ ID NO: 11548 - DNA, 717 bp, Photorhabdus luminescens; identical to SEQ ID NO: 10859
  CDS (1)..(717)

SEQ ID NO: 11549 - protein, 238 aa, Photorhabdus luminescens; identical to SEQ ID NO: 10860

SEQ ID NO: 11550 - DNA, 720 bp, Photorhabdus luminescens; identical to SEQ ID NO: 10861
  CDS (1)..(720)

SEQ ID NO: 11551 - protein, 239 aa, Photorhabdus luminescens; identical to SEQ ID NO: 10862

SEQ ID NO: 11552 - DNA, 705 bp, Gloeobacter violaceus; identical to SEQ ID NO: 8415
  CDS (1)..(705)

SEQ ID NO: 11553 - protein, 234 aa, Gloeobacter violaceus; identical to SEQ ID NO: 8416

SEQ ID NO: 11554 - DNA, 714 bp, Chromobacterium violaceum; identical to SEQ ID NO: 10865
  CDS (1)..(714)

SEQ ID NO: 11555 - protein, 237 aa, Chromobacterium violaceum; identical to SEQ ID NO: 10866

SEQ ID NO: 11556 - DNA, 708 bp, Synechococcus sp; identical to SEQ ID NO: 8427
  CDS (1)..(708)

SEQ ID NO: 11557 - protein, 235 aa, Synechococcus sp; identical to SEQ ID NO: 8428

SEQ ID NO: 11558 - DNA, 720 bp, Rhodopirellula baltica; identical to SEQ ID NO: 10869
  CDS (1)..(720)

SEQ ID NO: 11559 - protein, 239 aa, Rhodopirellula baltica; identical to SEQ ID NO: 10870

SEQ ID NO: 11560 - DNA, 729 bp, Prochlorococcus marinus subsp; identical to SEQ ID NO: 8429
  CDS (1)..(729)

SEQ ID NO: 11561 - protein, 242 aa, Prochlorococcus marinus subsp; identical to SEQ ID NO: 8430

SEQ ID NO: 11562 - DNA, 738 bp, Prochlorococcus marinus; identical to SEQ ID NO: 10873
  CDS (1)..(738)

SEQ ID NO: 11563 - protein, 245 aa, Prochlorococcus marinus; identical to SEQ ID NO: 10874

SEQ ID NO: 11564 - DNA, 714 bp, Haemophilus ducreyi; identical to SEQ ID NO: 10875
  CDS (1)..(714)

SEQ ID NO: 11565 - protein, 237 aa, Haemophilus ducreyi; identical to SEQ ID NO: 10876

SEQ ID NO: 11566 - DNA, 708 bp, Bacillus cereus; identical to SEQ ID NO: 10877
  CDS (1)..(708)

SEQ ID NO: 11567 - protein, 235 aa, Bacillus cereus; identical to SEQ ID NO: 10878

SEQ ID NO: 11568 - DNA, 690 bp, Bacillus cereus; identical to SEQ ID NO: 8443
  CDS (1)..(690)

SEQ ID NO: 11569 - protein, 229 aa, Bacillus cereus; identical to SEQ ID NO: 8444

SEQ ID NO: 11570 - DNA, 705 bp, Bacillus cereus; identical to SEQ ID NO: 10881
  CDS (1)..(705)

SEQ ID NO: 11571 - protein, 234 aa, Bacillus cereus; identical to SEQ ID NO: 10882

SEQ ID NO: 11572 - DNA, 702 bp, Bacillus cereus; identical to SEQ ID NO: 10883
  CDS (1)..(702)

SEQ ID NO: 11573 - protein, 233 aa, Bacillus cereus; identical to SEQ ID NO: 10884

SEQ ID NO: 11574 - DNA, 690 bp, Bacillus anthracis; identical to SEQ ID NO: 10885
  CDS (1)..(690)

SEQ ID NO: 11575 - protein, 229 aa, Bacillus anthracis; identical to SEQ ID NO: 10886

SEQ ID NO: 11576 - DNA, 714 bp, Bacillus anthracis; identical to SEQ ID NO: 10887
  CDS (1)..(714)

SEQ ID NO: 11577 - protein, 237 aa, Bacillus anthracis; identical to SEQ ID NO: 10888

SEQ ID NO: 11578 - DNA, 678 bp, Bacillus anthracis; identical to SEQ ID NO: 10889
  CDS (1)..(678)

SEQ ID NO: 11579 - protein, 225 aa, Bacillus anthracis; identical to SEQ ID NO: 10890

SEQ ID NO: 11580 - DNA, 750 bp, Streptomyces avermitilis; identical to SEQ ID NO: 8461
  CDS (1)..(750)

SEQ ID NO: 11581 - protein, 249 aa, Streptomyces avermitilis; identical to SEQ ID NO: 8462

SEQ ID NO: 11582 - DNA, 672 bp, Streptomyces avermitilis; identical to SEQ ID NO: 10893
  CDS (1)..(672)

SEQ ID NO: 11583 - protein, 223 aa, Streptomyces avermitilis; identical to SEQ ID NO: 10894

SEQ ID NO: 11584 - DNA, 705 bp, Enterococcus faecalis; identical to SEQ ID NO: 8465
  CDS (1)..(705)

SEQ ID NO: 11585 - protein, 234 aa, Enterococcus faecalis; identical to SEQ ID NO: 8466

SEQ ID NO: 11586 - DNA, 738 bp, Coxiella burnetii; identical to SEQ ID NO: 10897
  CDS (1)..(738)

SEQ ID NO: 11587 - protein, 245 aa, Coxiella burnetii; identical to SEQ ID NO: 10898

SEQ ID NO: 11588 - DNA, 672 bp, Streptomyces lividans; identical to SEQ ID NO: 8589
  CDS (1)..(672)

SEQ ID NO: 11589 - protein, 223 aa, Streptomyces lividans; identical to SEQ ID NO: 10900

SEQ ID NO: 11590 - DNA, 717 bp, Thiocapsa roseopersicina; identical to SEQ ID NO: 10901
  CDS (1)..(717)

SEQ ID NO: 11591 - protein, 238 aa, Thiocapsa roseopersicina; identical to SEQ ID NO: 10902

SEQ ID NO: 11592 - DNA, 720 bp, Yersinia enterocolitica; identical to SEQ ID NO: 10903
  CDS (1)..(720)

SEQ ID NO: 11593 - protein, 239 aa, Yersinia enterocolitica; identical to SEQ ID NO: 10904

SEQ ID NO: 11594 - DNA, 708 bp, Vibrio parahaemolyticus; identical to SEQ ID NO: 10905
  CDS (1)..(708)

SEQ ID NO: 11595 - protein, 235 aa, Vibrio parahaemolyticus; identical to SEQ ID NO: 10906

SEQ ID NO: 11596 - DNA, 717 bp, Vibrio parahaemolyticus; identical to SEQ ID NO: 10907
  CDS (1)..(717)

SEQ ID NO: 11597 - protein, 238 aa, Vibrio parahaemolyticus; identical to SEQ ID NO: 10908

SEQ ID NO: 11598 - DNA, 693 bp, Pseudomonas syringae; identical to SEQ ID NO: 10909
  CDS (1)..(693)

SEQ ID NO: 11599 - protein, 230 aa, Pseudomonas syringae; identical to SEQ ID NO: 10910

SEQ ID NO: 11600 - DNA, 738 bp, Pseudomonas syringae; identical to SEQ ID NO: 10911
  CDS (1)..(738)

SEQ ID NO: 11601 - protein, 245 aa, Pseudomonas syringae; identical to SEQ ID NO: 10912

SEQ ID NO: 11602 - DNA, 717 bp, Pseudomonas putida; identical to SEQ ID NO: 10913
  CDS (1)..(717)

SEQ ID NO: 11603 - protein, 238 aa, Pseudomonas putida; identical to SEQ ID NO: 10914

SEQ ID NO: 11604 - DNA, 741 bp, Pseudomonas putida; identical to SEQ ID NO: 10915
  CDS (1)..(741)

SEQ ID NO: 11605 - protein, 246 aa, Pseudomonas putida; identical to SEQ ID NO: 10916

SEQ ID NO: 11606 - DNA, 726 bp, Pseudomonas putida; identical to SEQ ID NO: 10917
  CDS (1)..(726)

SEQ ID NO: 11607 - protein, 241 aa, Pseudomonas putida; identical to SEQ ID NO: 10918

SEQ ID NO: 11608 - DNA, 720 bp, Pseudomonas putida; identical to SEQ ID NO: 10919
  CDS (1)..(720)

SEQ ID NO: 11609 - protein, 239 aa, Pseudomonas putida; identical to SEQ ID NO: 10920

SEQ ID NO: 11610 - DNA, 708 bp, Lactobacillus plantarum; identical to SEQ ID NO: 8483
  CDS (1)..(708)

SEQ ID NO: 11611 - protein, 235 aa, Lactobacillus plantarum; identical to SEQ ID NO: 8484

SEQ ID NO: 11612 - DNA, 786 bp, Clostridium tetani; identical to SEQ ID NO: 10923
  CDS (1)..(786)

SEQ ID NO: 11613 - protein, 261 aa, Clostridium tetani; identical to SEQ ID NO: 10924

SEQ ID NO: 11614 - DNA, 723 bp, Clostridium tetani; identical to SEQ ID NO: 10925
  CDS (1)..(723)

SEQ ID NO: 11615 - protein, 240 aa, Clostridium tetani; identical to SEQ ID NO: 10926

SEQ ID NO: 11616 - DNA, 699 bp, Clostridium tetani; identical to SEQ ID NO: 8485
  CDS (1)..(699)

SEQ ID NO: 11617 - protein, 232 aa, Clostridium tetani; identical to SEQ ID NO: 8486

SEQ ID NO: 11618 - DNA, 693 bp, Clostridium tetani; identical to SEQ ID NO: 10929
  CDS (1)..(693)

SEQ ID NO: 11619 - protein, 230 aa, Clostridium tetani; identical to SEQ ID NO: 10930

SEQ ID NO: 11620 - DNA, 741 bp, Clostridium tetani; identical to SEQ ID NO: 8489
  CDS (1)..(741)

SEQ ID NO: 11621 - protein, 246 aa, Clostridium tetani; identical to SEQ ID NO: 8490

SEQ ID NO: 11622 - DNA, 771 bp, Bradyrhizobium japonicum; identical to SEQ ID NO: 10933
  CDS (1)..(771)

SEQ ID NO: 11623 - protein, 256 aa, Bradyrhizobium japonicum; identical to SEQ ID NO: 10934

SEQ ID NO: 11624 - DNA, 822 bp, Bradyrhizobium japonicum; identical to SEQ ID NO: 10935
  CDS (1)..(822)

SEQ ID NO: 11625 - protein, 273 aa, Bradyrhizobium japonicum; identical to SEQ ID NO: 10936

SEQ ID NO: 11626 - DNA, 726 bp, Bradyrhizobium japonicum; identical to SEQ ID NO: 10937
  CDS (1)..(726)

SEQ ID NO: 11627 - protein, 241 aa, Bradyrhizobium japonicum; identical to SEQ ID NO: 10938

SEQ ID NO: 11628 - DNA, 816 bp, Bradyrhizobium japonicum; identical to SEQ ID NO: 10939
  CDS (1)..(816)

SEQ ID NO: 11629 - protein, 271 aa, Bradyrhizobium japonicum; identical to SEQ ID NO: 10940

SEQ ID NO: 11630 - DNA, 738 bp, Bradyrhizobium japonicum; identical to SEQ ID NO: 10941
  CDS (1)..(738)

SEQ ID NO: 11631 - protein, 245 aa, Bradyrhizobium japonicum; identical to SEQ ID NO: 10942

SEQ ID NO: 11632 - DNA, 741 bp, Staphylococcus epidermidis; identical to SEQ ID NO: 8495
  CDS (16)..(741)

SEQ ID NO: 11633 - protein, 241 aa, Staphylococcus epidermidis; identical to SEQ ID NO: 8496

SEQ ID NO: 11634 - DNA, 720 bp, Yersinia pestis; identical to SEQ ID NO: 8499
  CDS (1)..(720)

SEQ ID NO: 11635 - protein, 239 aa, Yersinia pestis; identical to SEQ ID NO: 8500

SEQ ID NO: 11636 - DNA, 717 bp, Vibrio vulnificus; identical to SEQ ID NO: 10947
  CDS (1)..(717)

SEQ ID NO: 11637 - protein, 238 aa, Vibrio vulnificus; identical to SEQ ID NO: 10948

SEQ ID NO: 11638 - DNA, 729 bp, Vibrio vulnificus; identical to SEQ ID NO: 10949
  CDS (1)..(729)

SEQ ID NO: 11639 - protein, 242 aa, Vibrio vulnificus; identical to SEQ ID NO: 10950

SEQ ID NO: 11640 - DNA, 711 bp, Streptococcus agalactiae; identical to SEQ ID NO: 10951
  CDS (1)..(711)

SEQ ID NO: 11641 - protein, 236 aa, Streptococcus agalactiae; identical to SEQ ID NO: 8510

SEQ ID NO: 11642 - DNA, 726 bp, Shewanella oneidensis; identical to SEQ ID NO: 10953
  CDS (1)..(726)

SEQ ID NO: 11643 - protein, 241 aa, Shewanella oneidensis; identical to SEQ ID NO: 10954

SEQ ID NO: 11644 - DNA, 717 bp, Shewanella oneidensis; identical to SEQ ID NO: 10955
  CDS (1)..(717)

SEQ ID NO: 11645 - protein, 238 aa, Shewanella oneidensis; identical to SEQ ID NO: 10956

SEQ ID NO: 11646 - DNA, 720 bp, Shewanella oneidensis; identical to SEQ ID NO: 8511
  CDS (1)..(720)

SEQ ID NO: 11647 - protein, 239 aa, Shewanella oneidensis; identical to SEQ ID NO: 8512

SEQ ID NO: 11648 - DNA, 702 bp, Oceanobacillus iheyensis; identical to SEQ ID NO: 8513
  CDS (1)..(702)

SEQ ID NO: 11649 - protein, 233 aa, Oceanobacillus iheyensis; identical to SEQ ID NO: 8514

SEQ ID NO: 11650 - DNA, 684 bp, Oceanobacillus iheyensis; identical to SEQ ID NO: 10961
  CDS (1)..(684)

SEQ ID NO: 11651 - protein, 227 aa, Oceanobacillus iheyensis; identical to SEQ ID NO: 10962

SEQ ID NO: 11652 - DNA, 681 bp, Corynebacterium efficiens; identical to SEQ ID NO: 8521
  CDS (1)..(681)

SEQ ID NO: 11653 - protein, 226 aa, Corynebacterium efficiens; identical to SEQ ID NO: 8522

SEQ ID NO: 11654 - DNA, 699 bp, Corynebacterium efficiens; identical to SEQ ID NO: 8523
  CDS (1)..(699)

SEQ ID NO: 11655 - protein, 232 aa, Corynebacterium efficiens; identical to SEQ ID NO: 8524

SEQ ID NO: 11656 - DNA, 771 bp, Bifidobacterium longum; identical to SEQ ID NO: 10967
  CDS (1)..(771)

SEQ ID NO: 11657 - protein, 256 aa, Bifidobacterium longum; identical to SEQ ID NO: 10968

SEQ ID NO: 11658 - DNA, 726 bp, Rhizobium loti; identical to SEQ ID NO: 10969
  CDS (1)..(726)

SEQ ID NO: 11659 - protein, 241 aa, Rhizobium loti; identical to SEQ ID NO: 10970

SEQ ID NO: 11660 - DNA, 681 bp, Corynebacterium glutamicum; identical to SEQ ID NO: 10971
  CDS (1)..(681)

SEQ ID NO: 11661 - protein, 226 aa, Corynebacterium glutamicum; identical to SEQ ID NO: 8536

SEQ ID NO: 11662 - DNA, 699 bp, Corynebacterium glutamicum; identical to SEQ ID NO: 10973
  CDS (1)..(699)

SEQ ID NO: 11663 - protein, 232 aa, Corynebacterium glutamicum; identical to SEQ ID NO: 10974

SEQ ID NO: 11664 - DNA, 720 bp, Xanthomonas campestris; identical to SEQ ID NO: 10975
  CDS (1)..(720)

SEQ ID NO: 11665 - protein, 239 aa, Xanthomonas campestris; identical to SEQ ID NO: 10976

SEQ ID NO: 11666 - DNA, 720 bp, Xanthomonas axonopodis; identical to SEQ ID NO: 10977
  CDS (1)..(720)

SEQ ID NO: 11667 - protein, 239 aa, Xanthomonas axonopodis; identical to SEQ ID NO: 10978

SEQ ID NO: 11668 - DNA, 696 bp, Thermoanaerobacter tengcongensis; identical to SEQ ID NO: 8545
  CDS (1)..(696)

SEQ ID NO: 11669 - protein, 231 aa, Thermoanaerobacter tengcongensis; identical to SEQ ID NO: 8546

SEQ ID NO: 11670 - DNA, 696 bp, Thermoanaerobacter tengcongensis; identical to SEQ ID NO: 8549
  CDS (1)..(696)

SEQ ID NO: 11671 - protein, 231 aa, Thermoanaerobacter tengcongensis; identical to SEQ ID NO: 8550

SEQ ID NO: 11672 - DNA, 723 bp, Thermoanaerobacter tengcongensis; identical to SEQ ID NO: 8551
  CDS (1)..(723)

SEQ ID NO: 11673 - protein, 240 aa, Thermoanaerobacter tengcongensis; identical to SEQ ID NO: 8552

SEQ ID NO: 11674 - DNA, 678 bp, Thermoanaerobacter tengcongensis; identical to SEQ ID NO: 10985
  CDS (1)..(678)

SEQ ID NO: 11675 - protein, 225 aa, Thermoanaerobacter tengcongensis; identical to SEQ ID NO: 10986

SEQ ID NO: 11676 - DNA, 726 bp, Agrobacterium tumefaciens; identical to SEQ ID NO: 10987
  CDS (1)..(726)

SEQ ID NO: 11677 - protein, 241 aa, Agrobacterium tumefaciens; identical to SEQ ID NO: 10988

SEQ ID NO: 11678 - DNA, 765 bp, Listeria monocytogenes; identical to SEQ ID NO: 8559
  CDS (41)..(754)

SEQ ID NO: 11679 - protein, 237 aa, Listeria monocytogenes; identical to SEQ ID NO: 8560

SEQ ID NO: 11680 - DNA, 687 bp, Clostridium perfringens; identical to SEQ ID NO: 8561
  CDS (1)..(687)

SEQ ID NO: 11681 - protein, 228 aa, Clostridium perfringens; identical to SEQ ID NO: 8562

SEQ ID NO: 11682 - DNA, 696 bp, Clostridium perfringens; identical to SEQ ID NO: 8565
  CDS (1)..(696)

SEQ ID NO: 11683 - protein, 231 aa, Clostridium perfringens; identical to SEQ ID NO: 8566

SEQ ID NO: 11684 - DNA, 705 bp, Clostridium perfringens; identical to SEQ ID NO: 10995
  CDS (1)..(705)

SEQ ID NO: 11685 - protein, 234 aa, Clostridium perfringens; identical to SEQ ID NO: 10996

SEQ ID NO: 11686 - DNA, 660 bp, Ralstonia solanacearum; identical to SEQ ID NO: 8569
  CDS (1)..(660)

SEQ ID NO: 11687 - protein, 219 aa, Ralstonia solanacearum; identical to SEQ ID NO: 8570

SEQ ID NO: 11688 - DNA, 723 bp, Ralstonia solanacearum; identical to SEQ ID NO: 10999
  CDS (1)..(723)

SEQ ID NO: 11689 - protein, 240 aa, Ralstonia solanacearum; identical to SEQ ID NO: 11000

SEQ ID NO: 11690 - DNA, 693 bp, Salmonella typhimurium; identical to SEQ ID NO: 11001
  CDS (1)..(693)

SEQ ID NO: 11691 - protein, 230 aa, Salmonella typhimurium; identical to SEQ ID NO: 11002

SEQ ID NO: 11692 - DNA, 690 bp, Enterococcus faecalis; identical to SEQ ID NO: 11003
  CDS (1)..(690)

SEQ ID NO: 11693 - protein, 229 aa, Enterococcus faecalis; identical to SEQ ID NO: 11004

SEQ ID NO: 11694 - DNA, 708 bp, Streptococcus mutans; identical to SEQ ID NO: 11005
  CDS (1)..(708)

SEQ ID NO: 11695 - protein, 235 aa, Streptococcus mutans; identical to SEQ ID NO: 11006

SEQ ID NO: 11696 - DNA, 702 bp, Rhizobium loti; identical to SEQ ID NO: 11007
  CDS (1)..(702)

SEQ ID NO: 11697 - protein, 233 aa, Rhizobium loti; identical to SEQ ID NO: 11008

SEQ ID NO: 11698 - DNA, 726 bp, Rhizobium loti; identical to SEQ ID NO: 11009
  CDS (1)..(726)

SEQ ID NO: 11699 - protein, 241 aa, Rhizobium loti; identical to SEQ ID NO: 11010

SEQ ID NO: 11700 - DNA, 717 bp, Rhizobium loti; identical to SEQ ID NO: 11011
  CDS (1)..(717)

SEQ ID NO: 11701 - protein, 238 aa, Rhizobium loti; identical to SEQ ID NO: 11012

SEQ ID NO: 11702 - DNA, 768 bp, Rhizobium loti; identical to SEQ ID NO: 11013
  CDS (1)..(768)

SEQ ID NO: 11703 - protein, 255 aa, Rhizobium loti; identical to SEQ ID NO: 11014

SEQ ID NO: 11704 - DNA, 711 bp, Streptococcus pyogenes; identical to SEQ ID NO: 11015
  CDS (1)..(711)

SEQ ID NO: 11705 - protein, 236 aa, Streptococcus pyogenes; identical to SEQ ID NO: 11016

SEQ ID NO: 11706 - DNA, 708 bp, Streptococcus thermophilus; identical to SEQ ID NO: 8581
  CDS (1)..(708)

SEQ ID NO: 11707 - protein, 235 aa, Streptococcus thermophilus; identical to SEQ ID NO: 8582

SEQ ID NO: 11708 - DNA, 732 bp, Pasteurella multocida; identical to SEQ ID NO: 11019
  CDS (1)..(732)

SEQ ID NO: 11709 - protein, 243 aa, Pasteurella multocida; identical to SEQ ID NO: 11020

SEQ ID NO: 11710 - DNA, 711 bp, Pasteurella multocida; identical to SEQ ID NO: 11021
  CDS (1)..(711)

SEQ ID NO: 11711 - protein, 236 aa, Pasteurella multocida; identical to SEQ ID NO: 11022

SEQ ID NO: 11712 - DNA, 771 bp, Streptomyces coelicolor; identical to SEQ ID NO: 8591
  CDS (1)..(771)

SEQ ID NO: 11713 - protein, 256 aa, Streptomyces coelicolor; identical to SEQ ID NO: 8592

SEQ ID NO: 11714 - DNA, 723 bp, Bacillus sp; identical to SEQ ID NO: 11025
  CDS (1)..(723)

SEQ ID NO: 11715 - protein, 240 aa, Bacillus sp; identical to SEQ ID NO: 11026

SEQ ID NO: 11716 - DNA, 954 bp, Rhizobium etli; identical to SEQ ID NO: 11027
  CDS (1)..(954)

SEQ ID NO: 11717 - protein, 317 aa, Rhizobium etli; identical to SEQ ID NO: 11028

SEQ ID NO: 11718 - DNA, 726 bp, Zymomonas mobilis; identical to SEQ ID NO: 11029
  CDS (1)..(726)

SEQ ID NO: 11719 - protein, 241 aa, Zymomonas mobilis; identical to SEQ ID NO: 11030

SEQ ID NO: 11720 - DNA, 705 bp, Rhodobacter capsulatus; identical to SEQ ID NO: 11031
  CDS (1)..(705)

SEQ ID NO: 11721 - protein, 234 aa, Rhodobacter capsulatus; identical to SEQ ID NO: 11032

SEQ ID NO: 11722 - DNA, 714 bp, Lactobacillus sakei; identical to SEQ ID NO: 8597
  CDS (1)..(714)

SEQ ID NO: 11723 - protein, 237 aa, Lactobacillus sakei; identical to SEQ ID NO: 8598

SEQ ID NO: 11724 - DNA, 714 bp, Lactobacillus sakei; identical to SEQ ID NO: 11035
  CDS (1)..(714)

SEQ ID NO: 11725 - protein, 237 aa, Lactobacillus sakei; identical to SEQ ID NO: 11036

SEQ ID NO: 11726 - DNA, 687 bp, Mycobacterium smegmatis; identical to SEQ ID NO: 8601
  CDS (1)..(687)

SEQ ID NO: 11727 - protein, 228 aa, Mycobacterium smegmatis; identical to SEQ ID NO: 8602

SEQ ID NO: 11728 - DNA, 750 bp, Cyanidium caldarium; identical to SEQ ID NO: 11039
  CDS (1)..(750)

SEQ ID NO: 11729 - protein, 249 aa, Cyanidium caldarium; identical to SEQ ID NO: 11040

SEQ ID NO: 11730 - DNA, 765 bp, Guillardia theta; identical to SEQ ID NO: 8603
  CDS (1)..(765)

SEQ ID NO: 11731 - protein, 254 aa, Guillardia theta; identical to SEQ ID NO: 8604

SEQ ID NO: 11732 - DNA, 708 bp, Lactobacillus johnsonii; identical to SEQ ID NO: 8615
  CDS (1)..(708)

SEQ ID NO: 11733 - protein, 235 aa, Lactobacillus johnsonii; identical to SEQ ID NO: 8616

SEQ ID NO: 11734 - DNA, 705 bp, Bacillus cereus; identical to SEQ ID NO: 11045
  CDS (1)..(705)

SEQ ID NO: 11735 - protein, 234 aa, Bacillus cereus; identical to SEQ ID NO: 11046

SEQ ID NO: 11736 - DNA, 753 bp, Bacillus cereus; identical to SEQ ID NO: 11047
  CDS (1)..(753)

SEQ ID NO: 11737 - protein, 250 aa, Bacillus cereus; identical to SEQ ID NO: 11048

SEQ ID NO: 11738 - DNA, 690 bp, Desulfovibrio vulgaris; identical to SEQ ID NO: 8629
  CDS (1)..(690)

SEQ ID NO: 11739 - protein, 229 aa, Desulfovibrio vulgaris; identical to SEQ ID NO: 8630

SEQ ID NO: 11740 - DNA, 723 bp, Rhodopseudomonas palustris; identical to SEQ ID NO: 11051
  CDS (1)..(723)

SEQ ID NO: 11741 - protein, 240 aa, Rhodopseudomonas palustris; identical to SEQ ID NO: 11052

SEQ ID NO: 11742 - DNA, 741 bp, Rhodopseudomonas palustris; identical to SEQ ID NO: 11053
  CDS (1)..(741)

SEQ ID NO: 11743 - protein, 246 aa, Rhodopseudomonas palustris; identical to SEQ ID NO: 11054

SEQ ID NO: 11744 - DNA, 681 bp, Corynebacterium diphtheriae; identical to SEQ ID NO: 8637
  CDS (1)..(681)

SEQ ID NO: 11745 - protein, 226 aa, Corynebacterium diphtheriae; identical to SEQ ID NO: 8638

SEQ ID NO: 11746 - DNA, 699 bp, Corynebacterium diphtheriae; identical to SEQ ID NO: 8639
  CDS (1)..(699)

SEQ ID NO: 11747 - protein, 232 aa, Corynebacterium diphtheriae; identical to SEQ ID NO: 8640

SEQ ID NO: 11748 - DNA, 720 bp, Photobacterium profundum; identical to SEQ ID NO: 11059
  CDS (1)..(720)

SEQ ID NO: 11749 - protein, 239 aa, Photobacterium profundum; identical to SEQ ID NO: 11060

SEQ ID NO: 11750 - DNA, 720 bp, Photobacterium profundum; identical to SEQ ID NO: 11061
  CDS (1)..(720)

SEQ ID NO: 11751 - protein, 239 aa, Photobacterium profundum; identical to SEQ ID NO: 11062

SEQ ID NO: 11752 - DNA, 714 bp, Photobacterium profundum; identical to SEQ ID NO: 11063
  CDS (1)..(714)

SEQ ID NO: 11753 - protein, 237 aa, Photobacterium profundum; identical to SEQ ID NO: 11064

SEQ ID NO: 11754 - DNA, 786 bp, Photobacterium profundum; identical to SEQ ID NO: 11065
  CDS (1)..(786)

SEQ ID NO: 11755 - protein, 261 aa, Photobacterium profundum; identical to SEQ ID NO: 11066

SEQ ID NO: 11756 - DNA, 702 bp, Photobacterium profundum; identical to SEQ ID NO: 11067
  CDS (1)..(702)

SEQ ID NO: 11757 - protein, 233 aa, Photobacterium profundum; identical to SEQ ID NO: 11068

SEQ ID NO: 11758 - DNA, 726 bp, Photobacterium profundum; identical to SEQ ID NO: 11069
  CDS (1)..(726)

SEQ ID NO: 11759 - protein, 241 aa, Photobacterium profundum; identical to SEQ ID NO: 11070

SEQ ID NO: 11760 - DNA, 21 bp, Primer
atgcagaccccgcacattctt

SEQ ID NO: 11761 - DNA, 24 bp, Primer
ttaatcttccagatcaccgcagaa

SEQ ID NO: 11762 - DNA, 1062 bp, Escherichia coli K12; identical to SEQ ID NO: 2732
  CDS (1)..(1062)

SEQ ID NO: 11763 - protein, 353 aa, Escherichia coli K12; identical to SEQ ID NO: 2733

SEQ ID NO: 11764 - DNA, 1444 bp, Pseudomonas fluorescens; identical to SEQ ID NO: 2734
  CDS (156)..(1214)

SEQ ID NO: 11765 - protein, 352 aa, Pseudomonas fluorescens; identical to SEQ ID NO: 2735

SEQ ID NO: 11766 - DNA, 1484 bp, Haemophilus influenzae; identical to SEQ ID NO: 2736
  CDS (278)..(1342)

SEQ ID NO: 11767 - protein, 354 aa, Haemophilus influenzae; identical to SEQ ID NO: 2737

SEQ ID NO: 11768 - DNA, 1131 bp, Thermus aquaticus; identical to SEQ ID NO: 2738
  CDS (62)..(1084)

SEQ ID NO: 11769 - protein, 340 aa, Thermus aquaticus; identical to SEQ ID NO: 2739

SEQ ID NO: 11770 - DNA, 1196 bp, Aquifex pyrophilus; identical to SEQ ID NO: 2740
  CDS (51)..(1097)

SEQ ID NO: 11771 - protein, 348 aa, Aquifex pyrophilus; identical to SEQ ID NO: 2741

SEQ ID NO: 11772 - DNA, 1023 bp, Rickettsia prowazekii; identical to SEQ ID NO: 2742
  CDS (1)..(1023)

SEQ ID NO: 11773 - protein, 340 aa, Rickettsia prowazekii; identical to SEQ ID NO: 2743

SEQ ID NO: 11774 - DNA, 1329 bp, Myxococcus xanthus; identical to SEQ ID NO: 2744
  CDS (201)..(1229)

SEQ ID NO: 11775 - protein, 342 aa, Myxococcus xanthus; identical to SEQ ID NO: 2745

SEQ ID NO: 11776 - DNA, 1394 bp, Legionella pneumophila; identical to SEQ ID NO: 2746
  CDS (166)..(1212)

SEQ ID NO: 11777 - protein, 348 aa, Legionella pneumophila; identical to SEQ ID NO: 2747

SEQ ID NO: 11778 - DNA, 1224 bp, Treponema pallidum subsp. pallidum (syphilis spirochete); identical to SEQ ID NO: 2748
  CDS (1)..(1224): k means g or t/u

SEQ ID NO: 11779 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 11780 - DNA, 1050 bp, Clostridium acetobutylicum; identical to SEQ ID NO: 2750
  CDS (1)..(1050)

SEQ ID NO: 11781 - protein, 349 aa, Clostridium acetobutylicum; identical to SEQ ID NO: 2751

SEQ ID NO: 11782 - DNA, 1047 bp, Listeria innocua; identical to SEQ ID NO: 2752
  CDS (1)..(1047)

SEQ ID NO: 11783 - protein, 348 aa, Listeria innocua; identical to SEQ ID NO: 2753

SEQ ID NO: 11784 - DNA, 1137 bp, Brucella melitensis; identical to SEQ ID NO: 2754
  CDS (1)..(1137)

SEQ ID NO: 11785 - protein, 378 aa, Brucella melitensis; identical to SEQ ID NO: 2755

SEQ ID NO: 11786 - DNA, 1062 bp, Salmonella enterica subsp. enterica serovar Typhi; identical to SEQ ID NO: 2756
  CDS (1)..(1062)

SEQ ID NO: 11787 - protein, 353 aa, Salmonella enterica subsp. enterica serovar Typhi; identical to SEQ ID NO: 2757

SEQ ID NO: 11788 - DNA, 1074 bp, Nostoc sp. PCC 7120; identical to SEQ ID NO: 2758
  CDS (1)..(1074)

SEQ ID NO: 11789 - protein, 357 aa, Nostoc sp. PCC 7120; identical to SEQ ID NO: 2759

SEQ ID NO: 11790 - DNA, 1044 bp, Xylella fastidiosa; identical to SEQ ID NO: 2760
  CDS (1)..(1044)

SEQ ID NO: 11791 - protein, 347 aa, Xylella fastidiosa; identical to SEQ ID NO: 2761

SEQ ID NO: 11792 - DNA, 1164 bp, Lactococcus lactis subsp. lactis; identical to SEQ ID NO: 2762
  CDS (1)..(1164)

SEQ ID NO: 11793 - protein, 387 aa, Lactococcus lactis subsp. lactis; identical to SEQ ID NO: 2763

SEQ ID NO: 11794 - DNA, 2025 bp, Borrelia burgdorferi (Lyme disease spirochete); identical to SEQ ID NO: 2764
  CDS (25)..(1122)

SEQ ID NO: 11795 - protein, 365 aa, Borrelia burgdorferi (Lyme disease spirochete); identical to SEQ ID NO: 2765

SEQ ID NO: 11796 - DNA, 1728 bp, Deinococcus radiodurans; identical to SEQ ID NO: 2766
  CDS (399)..(1490)

SEQ ID NO: 11797 - protein, 363 aa, Deinococcus radiodurans; identical to SEQ ID NO: 2767

SEQ ID NO: 11798 - DNA, 1071 bp, Caulobacter crescentus; identical to SEQ ID NO: 2768
  CDS (1)..(1071)

SEQ ID NO: 11799 - protein, 356 aa, Caulobacter crescentus; identical to SEQ ID NO: 2769

SEQ ID NO: 11800 - DNA, 1199 bp, Thermotoga maritima; identical to SEQ ID NO: 2770
  CDS (67)..(1137)

SEQ ID NO: 11801 - protein, 356 aa, Thermotoga maritima; identical to SEQ ID NO: 2771

SEQ ID NO: 11802 - DNA, 1662 bp, Arabidopsis thaliana (mouse-ear cress); identical to SEQ ID NO: 2772
  CDS (368)..(1498)

SEQ ID NO: 11803 - protein, 376 aa, Arabidopsis thaliana (mouse-ear cress); identical to SEQ ID NO: 2773

SEQ ID NO: 11804 - DNA, 1038 bp, Aquifex aeolicus; identical to SEQ ID NO: 2774
  CDS (1)..(1038)

SEQ ID NO: 11805 - protein, 345 aa, Aquifex aeolicus; identical to SEQ ID NO: 2775

SEQ ID NO: 11806 - DNA, 1062 bp, Chlamydophila pneumoniae, Chlamydia pneumoniae; identical to SEQ ID NO: 2776
  CDS (1)..(1062)

SEQ ID NO: 11807 - protein, 353 aa, Chlamydophila pneumoniae, Chlamydia pneumoniae; identical to SEQ ID NO: 2777

SEQ ID NO: 11808 - DNA, 1047 bp, Neisseria meningitidis; identical to SEQ ID NO: 2778
  CDS (1)..(1047)

SEQ ID NO: 11809 - protein, 348 aa, Neisseria meningitidis; identical to SEQ ID NO: 2779

SEQ ID NO: 11810 - DNA, 1032 bp, Campylobacter jejuni; identical to SEQ ID NO: 2780
  CDS (1)..(1032)

SEQ ID NO: 11811 - protein, 343 aa, Campylobacter jejuni; identical to SEQ ID NO: 2781

SEQ ID NO: 11812 - DNA, 1065 bp, Chlamydia muridarum, Chlamydia trachomatis MoPn; identical to SEQ ID NO: 2782
  CDS (1)..(1065)

SEQ ID NO: 11813 - protein, 354 aa, Chlamydia muridarum, Chlamydia trachomatis MoPn; identical to SEQ ID NO: 2783

SEQ ID NO: 11814 - DNA, 1050 bp, Bacillus halodurans; identical to SEQ ID NO: 2784
  CDS (1)..(1050)

SEQ ID NO: 11815 - protein, 349 aa, Bacillus halodurans; identical to SEQ ID NO: 2785

SEQ ID NO: 11816 - DNA, 1229 bp, Streptococcus pneumoniae; identical to SEQ ID NO: 2786
  CDS (26)..(1192)

SEQ ID NO: 11817 - protein, 388 aa, Streptococcus pneumoniae; identical to SEQ ID NO: 2787

SEQ ID NO: 11818 - DNA, 1251 bp, Agrobacterium tumefaciens; identical to SEQ ID NO: 2788
  CDS (1)..(1251)

SEQ ID NO: 11819 - protein, 416 aa, Agrobacterium tumefaciens; identical to SEQ ID NO: 2789

SEQ ID NO: 11820 - DNA, 1044 bp, Staphylococcus aureus; identical to SEQ ID NO: 2790
  CDS (1)..(1044)

SEQ ID NO: 11821 - protein, 347 aa, Staphylococcus aureus; identical to SEQ ID NO: 2791

SEQ ID NO: 11822 - DNA, 1506 bp, Acinetobacter calcoaceticus; identical to SEQ ID NO: 2792
  CDS (403)..(1452)

SEQ ID NO: 11823 - protein, 349 aa, Acinetobacter calcoaceticus; identical to SEQ ID NO: 2793

SEQ ID NO: 11824 - DNA, 1479 bp, Brucella abortus; identical to SEQ ID NO: 2794
  CDS (316)..(1398)

SEQ ID NO: 11825 - protein, 360 aa, Brucella abortus; identical to SEQ ID NO: 2795

SEQ ID NO: 11826 - DNA, 981 bp, Streptococcus pyogenes; identical to SEQ ID NO: 2796
  CDS (1)..(981)

SEQ ID NO: 11827 - protein, 326 aa, Streptococcus pyogenes; identical to SEQ ID NO: 2797

SEQ ID NO: 11828 - DNA, 1349 bp, Leptospira biflexa; identical to SEQ ID NO: 2798
  CDS (107)..(1270)

SEQ ID NO: 11829 - protein, 387 aa, Leptospira biflexa; identical to SEQ ID NO: 2799

SEQ ID NO: 11830 - DNA, 1762 bp, Xanthomonas campestris pv. campestris; identical to SEQ ID NO: 2800
  CDS (159)..(1190)

SEQ ID NO: 11831 - protein, 343 aa, Xanthomonas campestris pv. campestris; identical to SEQ ID NO: 2801

SEQ ID NO: 11832 - DNA, 1212 bp, Aeromonas salmonicida; identical to SEQ ID NO: 2802
  CDS (151)..(1212)

SEQ ID NO: 11833 - protein, 353 aa, Aeromonas salmonicida; identical to SEQ ID NO: 2803

SEQ ID NO: 11834 - DNA, 1433 bp, Azotobacter vinelandii; identical to SEQ ID NO: 2804
  CDS (311)..(1360)

SEQ ID NO: 11835 - protein, 349 aa, Azotobacter vinelandii; identical to SEQ ID NO: 2805

SEQ ID NO: 11836 - DNA, 1108 bp, Acetobacter polyoxogenes; identical to SEQ ID NO: 2806
  CDS (35)..(1081)

SEQ ID NO: 11837 - protein, 348 aa, Acetobacter polyoxogenes; identical to SEQ ID NO: 2807

SEQ ID NO: 11838 - DNA, 1230 bp, Neisseria gonorrhoeae; identical to SEQ ID NO: 2808
  CDS (133)..(1179)

SEQ ID NO: 11839 - protein, 348 aa, Neisseria gonorrhoeae; identical to SEQ ID NO: 2809

SEQ ID NO: 11840 - DNA, 1649 bp, Bacteroides fragilis; identical to SEQ ID NO: 2810
  CDS (351)..(1307)

SEQ ID NO: 11841 - protein, 318 aa, Bacteroides fragilis; identical to SEQ ID NO: 2811

SEQ ID NO: 11842 - DNA, 1349 bp, Methylobacillus sp; identical to SEQ ID NO: 2812
  CDS (293)..(1327)

SEQ ID NO: 11843 - protein, 344 aa, Methylobacillus sp; identical to SEQ ID NO: 2813

SEQ ID NO: 11844 - DNA, 1320 bp, Vibrio anguillarum; identical to SEQ ID NO: 2814
  CDS (166)..(1212)

SEQ ID NO: 11845 - protein, 348 aa, Vibrio anguillarum; identical to SEQ ID NO: 2815

SEQ ID NO: 11846 - DNA, 1394 bp, Anabaena variabilis; identical to SEQ ID NO: 2816
  CDS (125)..(1201)

SEQ ID NO: 11847 - protein, 358 aa, Anabaena variabilis; identical to SEQ ID NO: 2817

SEQ ID NO: 11848 - DNA, 1334 bp, Bacillus subtilis; identical to SEQ ID NO: 2818
  CDS (215)..(1258)

SEQ ID NO: 11849 - protein, 347 aa, Bacillus subtilis; identical to SEQ ID NO: 2819

SEQ ID NO: 11850 - DNA, 1348 bp, Proteus mirabilis; identical to SEQ ID NO: 2820
  CDS (151)..(1218)

SEQ ID NO: 11851 - protein, 355 aa, Proteus mirabilis; identical to SEQ ID NO: 2821

SEQ ID NO: 11852 - DNA, 1384 bp, Pseudomonas aeruginosa; identical to SEQ ID NO: 2822
  CDS (145)..(1185)

SEQ ID NO: 11853 - protein, 346 aa, Pseudomonas aeruginosa; identical to SEQ ID NO: 2823

SEQ ID NO: 11854 - DNA, 1352 bp, Pseudomonas cepacia; identical to SEQ ID NO: 2824
  CDS (223)..(1266)

SEQ ID NO: 11855 - protein, 347 aa, Pseudomonas cepacia; identical to SEQ ID NO: 2825

SEQ ID NO: 11856 - DNA, 1047 bp, Synechococcus sp; identical to SEQ ID NO: 2826
  CDS (1)..(1047)

SEQ ID NO: 11857 - protein, 348 aa, Synechococcus sp; identical to SEQ ID NO: 2827

SEQ ID NO: 11858 - DNA, 1190 bp, Aquaspirillum magnetotacticum; identical to SEQ ID NO: 2828
  CDS (112)..(1146)

SEQ ID NO: 11859 - protein, 344 aa, Aquaspirillum magnetotacticum; identical to SEQ ID NO: 2829

SEQ ID NO: 11860 - DNA, 1841 bp, Rhizobium leguminosarum bv. viciae; identical to SEQ ID NO: 2830
  CDS (32)..(1087)

SEQ ID NO: 11861 - protein, 351 aa, Rhizobium leguminosarum bv. viciae; identical to SEQ ID NO: 2831

SEQ ID NO: 11862 - DNA, 1047 bp, Rhizobium meliloti; identical to SEQ ID NO: 2832
  CDS (1)..(1047)

SEQ ID NO: 11863 - protein, 348 aa, Rhizobium meliloti; identical to SEQ ID NO: 2833

SEQ ID NO: 11864 - DNA, 2762 bp, Mycobacterium tuberculosis; identical to SEQ ID NO: 2834
  CDS (311)..(2683)

SEQ ID NO: 11865 - protein, 790 aa, Mycobacterium tuberculosis; identical to SEQ ID NO: 2835

SEQ ID NO: 11866 - DNA, 1249 bp, Methylomonas clara; identical to SEQ ID NO: 2836
  CDS (123)..(1151)

SEQ ID NO: 11867 - protein, 342 aa, Methylomonas clara; identical to SEQ ID NO: 2837

SEQ ID NO: 11868 - DNA, 1065 bp, Enterobacter agglomerans; identical to SEQ ID NO: 2838
  CDS (1)..(1065)

SEQ ID NO: 11869 - protein, 354 aa, Enterobacter agglomerans; identical to SEQ ID NO: 2839

SEQ ID NO: 11870 - DNA, 1125 bp, Streptomyces lividans; identical to SEQ ID NO: 2840
  CDS (1)..(1125)

SEQ ID NO: 11871 - protein, 374 aa, Streptomyces lividans; identical to SEQ ID NO: 2841

SEQ ID NO: 11872 - DNA, 1347 bp, Rhodobacter sphaeroides; identical to SEQ ID NO: 2842
  CDS (220)..(1251)

SEQ ID NO: 11873 - protein, 343 aa, Rhodobacter sphaeroides; identical to SEQ ID NO: 2843

SEQ ID NO: 11874 - DNA, 1065 bp, Vibrio cholerae; identical to SEQ ID NO: 2844
  CDS (1)..(1065)

SEQ ID NO: 11875 - protein, 354 aa, Vibrio cholerae; identical to SEQ ID NO: 2845

SEQ ID NO: 11876 - DNA, 1068 bp, Rhodobacter capsulatus; identical to SEQ ID NO: 2846
  CDS (1)..(1068)

SEQ ID NO: 11877 - protein, 355 aa, Rhodobacter capsulatus; identical to SEQ ID NO: 2847

SEQ ID NO: 11878 - DNA, 1533 bp, Helicobacter pylori; identical to SEQ ID NO: 2848
  CDS (275)..(1318)

SEQ ID NO: 11879 - protein, 347 aa, Helicobacter pylori; identical to SEQ ID NO: 2849

SEQ ID NO: 11880 - DNA, 1065 bp, Synechocystis sp; identical to SEQ ID NO: 2850
  CDS (1)..(1065)

SEQ ID NO: 11881 - protein, 354 aa, Synechocystis sp; identical to SEQ ID NO: 2851

SEQ ID NO: 11882 - DNA, 1351 bp, Arabidopsis thaliana (mouse-ear cress); identical to SEQ ID NO: 2852
  CDS (1)..(1320)

SEQ ID NO: 11883 - protein, 439 aa, Arabidopsis thaliana (mouse-ear cress); identical to SEQ ID NO: 2853

SEQ ID NO: 11884 - DNA, 1392 bp, Pseudomonas putida; identical to SEQ ID NO: 2854
  CDS (111)..(1178)

SEQ ID NO: 11885 - protein, 355 aa, Pseudomonas putida; identical to SEQ ID NO: 2855

SEQ ID NO: 11886 - DNA, 1053 bp, Mycobacterium tuberculosis; identical to SEQ ID NO: 2856
  CDS (1)..(1053)

SEQ ID NO: 11887 - protein, 350 aa, Mycobacterium tuberculosis; identical to SEQ ID NO: 2857

SEQ ID NO: 11888 - DNA, 1053 bp, Wolinella succinogenes; identical to SEQ ID NO: 2858
  CDS (1)..(1053)

SEQ ID NO: 11889 - protein, 350 aa, Wolinella succinogenes; identical to SEQ ID NO: 2859

SEQ ID NO: 11890 - DNA, 1110 bp, Vibrio vulnificus; identical to SEQ ID NO: 2860
  CDS (1)..(1110)

SEQ ID NO: 11891 - protein, 369 aa, Vibrio vulnificus; identical to SEQ ID NO: 2861

SEQ ID NO: 11892 - DNA, 1068 bp, Photorhabdus luminescens; identical to SEQ ID NO: 2862
  CDS (1)..(1068)

SEQ ID NO: 11893 - protein, 355 aa, Photorhabdus luminescens; identical to SEQ ID NO: 2863

SEQ ID NO: 11894 - DNA, 1110 bp, Gloeobacter violaceus; identical to SEQ ID NO: 2864
  CDS (1)..(1110)

SEQ ID NO: 11895 - protein, 369 aa, Gloeobacter violaceus; identical to SEQ ID NO: 2865

SEQ ID NO: 11896 - DNA, 1053 bp, Chromobacterium violaceum; identical to SEQ ID NO: 2866
  CDS (1)..(1053)

SEQ ID NO: 11897 - protein, 350 aa, Chromobacterium violaceum; identical to SEQ ID NO: 2867

SEQ ID NO: 11898 - DNA, 1128 bp, Synechococcus sp; identical to SEQ ID NO: 2868
  CDS (1)..(1128)

SEQ ID NO: 11899 - protein, 375 aa, Synechococcus sp; identical to SEQ ID NO: 2869

SEQ ID NO: 11900 - DNA, 1128 bp, Rhodopirellula baltica; identical to SEQ ID NO: 2870
  CDS (1)..(1128)

SEQ ID NO: 11901 - protein, 375 aa, Rhodopirellula baltica; identical to SEQ ID NO: 2871

SEQ ID NO: 11902 - DNA, 1113 bp, Prochlorococcus marinus subsp; identical to SEQ ID NO: 2872
  CDS (1)..(1113)

SEQ ID NO: 11903 - protein, 370 aa, Prochlorococcus marinus subsp; identical to SEQ ID NO: 2873

SEQ ID NO: 11904 - DNA, 1140 bp, Prochlorococcus marinus; identical to SEQ ID NO: 2874
  CDS (1)..(1140)

SEQ ID NO: 11905 - protein, 379 aa, Prochlorococcus marinus; identical to SEQ ID NO: 2875

SEQ ID NO: 11906 - DNA, 1140 bp, Prochlorococcus marinus; identical to SEQ ID NO: 2876
  CDS (1)..(1140)

SEQ ID NO: 11907 - protein, 379 aa, Prochlorococcus marinus; identical to SEQ ID NO: 2877

SEQ ID NO: 11908 - DNA, 1038 bp, Helicobacter hepaticus; identical to SEQ ID NO: 2878
  CDS (1)..(1038)

SEQ ID NO: 11909 - protein, 345 aa, Helicobacter hepaticus; identical to SEQ ID NO: 2879

SEQ ID NO: 11910 - DNA, 1119 bp, Haemophilus ducreyi; identical to SEQ ID NO: 2880
  CDS (1)..(1119)

SEQ ID NO: 11911 - protein, 372 aa, Haemophilus ducreyi; identical to SEQ ID NO: 2881

SEQ ID NO: 11912 - DNA, 1048 bp, Campylobacter lari; identical to SEQ ID NO: 2882
  CDS (9)..(1043)

SEQ ID NO: 11913 - protein, 344 aa, Campylobacter lari; identical to SEQ ID NO: 2883

SEQ ID NO: 11914 - DNA, 1077 bp, Burkholderia fungorum; identical to SEQ ID NO: 2884
  CDS (1)..(1077)

SEQ ID NO: 11915 - protein, 358 aa, Burkholderia fungorum; identical to SEQ ID NO: 2885

SEQ ID NO: 11916 - DNA, 963 bp, Mycobacteriophage CJW1; identical to SEQ ID NO: 2886
  CDS (1)..(963)

SEQ ID NO: 11917 - protein, 320 aa, Mycobacteriophage CJW1; identical to SEQ ID NO: 2887

SEQ ID NO: 11918 - DNA, 1563 bp, Zymomonas mobilis; identical to SEQ ID NO: 2888
  CDS (231)..(1250)

SEQ ID NO: 11919 - protein, 339 aa, Zymomonas mobilis; identical to SEQ ID NO: 2889

SEQ ID NO: 11920 - DNA, 1038 bp, Bacillus megaterium; identical to SEQ ID NO: 2890
  CDS (1)..(1038)

SEQ ID NO: 11921 - protein, 345 aa, Bacillus megaterium; identical to SEQ ID NO: 2891

SEQ ID NO: 11922 - DNA, 1038 bp, Bacillus megaterium; identical to SEQ ID NO: 2892
  CDS (1)..(1038)

SEQ ID NO: 11923 - protein, 345 aa, Bacillus megaterium; identical to SEQ ID NO: 2893

SEQ ID NO: 11924 - DNA, 1044 bp, Bacillus amyloliquefaciens; identical to SEQ ID NO: 2894
  CDS (1)..(1044)

SEQ ID NO: 11925 - protein, 347 aa, Bacillus amyloliquefaciens; identical to SEQ ID NO: 2895

SEQ ID NO: 11926 - DNA, 1047 bp, Listeria monocytogenes; identical to SEQ ID NO: 2896
  CDS (1)..(1047): m means a or c

SEQ ID NO: 11927 - protein, 348 aa, Listeria monocytogenes; identical to SEQ ID NO: 2897
  misc_feature (228)..(228): Xaa can be Pro or Gln

SEQ ID NO: 11928 - DNA, 1035 bp, Oryza sativa; identical to SEQ ID NO: 2898
  CDS (1)..(1035)

SEQ ID NO: 11929 - protein, 344 aa, Oryza sativa; identical to SEQ ID NO: 2899

SEQ ID NO: 11930 - DNA, 1035 bp, Campylobacter lari; identical to SEQ ID NO: 2900
  CDS (1)..(1035)

SEQ ID NO: 11931 - protein, 344 aa, Campylobacter lari; identical to SEQ ID NO: 2901

SEQ ID NO: 11932 - DNA, 2035 bp, Borrelia hermsii; identical to SEQ ID NO: 2902
  CDS (256)..(1326)

SEQ ID NO: 11933 - protein, 356 aa, Borrelia hermsii; identical to SEQ ID NO: 2903

SEQ ID NO: 11934 - DNA, 1487 bp, Chlamydomonas reinhardtii; identical to SEQ ID NO: 2904
  CDS (121)..(1365)

SEQ ID NO: 11935 - protein, 414 aa, Chlamydomonas reinhardtii; identical to SEQ ID NO: 2905

SEQ ID NO: 11936 - DNA, 1669 bp, Streptococcus suis; identical to SEQ ID NO: 2906
  CDS (469)..(1500)

SEQ ID NO: 11937 - protein, 343 aa, Streptococcus suis; identical to SEQ ID NO: 2907

SEQ ID NO: 11938 - DNA, 1439 bp, Peanut witches; identical to SEQ ID NO: 2908
  CDS (218)..(1228)

SEQ ID NO: 11939 - protein, 336 aa, Peanut witches; identical to SEQ ID NO: 2909

SEQ ID NO: 11940 - DNA, 1377 bp, Myxococcus xanthus; identical to SEQ ID NO: 2910
  CDS (201)..(1277)

SEQ ID NO: 11941 - protein, 358 aa, Myxococcus xanthus; identical to SEQ ID NO: 2911

SEQ ID NO: 11942 - DNA, 1404 bp, Acidiphilium facilis; identical to SEQ ID NO: 2912
  CDS (187)..(1251)

SEQ ID NO: 11943 - protein, 354 aa, Acidiphilium facilis; identical to SEQ ID NO: 2913

SEQ ID NO: 11944 - DNA, 1059 bp, Actinobacillus actinomycetemcomitans; identical to SEQ ID NO: 2914
  CDS (1)..(1059)

SEQ ID NO: 11945 - protein, 352 aa, Actinobacillus actinomycetemcomitans; identical to SEQ ID NO: 2915

SEQ ID NO: 11946 - DNA, 1565 bp, Alcaligenes eutrophus; identical to SEQ ID NO: 2916
  CDS (194)..(1255)

SEQ ID NO: 11947 - protein, 353 aa, Alcaligenes eutrophus; identical to SEQ ID NO: 2917

SEQ ID NO: 11948 - DNA, 1047 bp, Amycolatopsis mediterranei; identical to SEQ ID NO: 2918
  CDS (1)..(1047)

SEQ ID NO: 11949 - protein, 348 aa, Amycolatopsis mediterranei; identical to SEQ ID NO: 2919

SEQ ID NO: 11950 - DNA, 1035 bp, Bacteroides thetaiotaomicron; identical to SEQ ID NO: 2920
  CDS (1)..(1035)

SEQ ID NO: 11951 - protein, 344 aa, Bacteroides thetaiotaomicron; identical to SEQ ID NO: 2921

SEQ ID NO: 11952 - DNA, 1194 bp, Bifidobacterium longum; identical to SEQ ID NO: 2922
  CDS (1)..(1194)

SEQ ID NO: 11953 - protein, 397 aa, Bifidobacterium longum; identical to SEQ ID NO: 2923

SEQ ID NO: 11954 - DNA, 1062 bp, Bordetella pertussis; identical to SEQ ID NO: 2924
  CDS (1)..(1062)

SEQ ID NO: 11955 - protein, 353 aa, Bordetella pertussis; identical to SEQ ID NO: 2925

SEQ ID NO: 11956 - DNA, 1089 bp, Bradyrhizobium japonicum; identical to SEQ ID NO: 2926
  CDS (1)..(1089)

SEQ ID NO: 11957 - protein, 362 aa, Bradyrhizobium japonicum; identical to SEQ ID NO: 2927

SEQ ID NO: 11958 - DNA, 2058 bp, Campylobacter fetus; identical to SEQ ID NO: 2928
  CDS (401)..(1438)

SEQ ID NO: 11959 - protein, 345 aa, Campylobacter fetus; identical to SEQ ID NO: 2929

SEQ ID NO: 11960 - DNA, 1458 bp, Chloroflexus aurantiacus; identical to SEQ ID NO: 2930
  CDS (116)..(1171)

SEQ ID NO: 11961 - protein, 351 aa, Chloroflexus aurantiacus; identical to SEQ ID NO: 2931

SEQ ID NO: 11962 - DNA, 1053 bp, Chlamydophila caviae; identical to SEQ ID NO: 2932
  CDS (1)..(1053)

SEQ ID NO: 11963 - protein, 350 aa, Chlamydophila caviae; identical to SEQ ID NO: 2933

SEQ ID NO: 11964 - DNA, 1087 bp, Chromatium vinosum; identical to SEQ ID NO: 2934
  CDS (1)..(1044)

SEQ ID NO: 11965 - protein, 347 aa, Chromatium vinosum; identical to SEQ ID NO: 2935

SEQ ID NO: 11966 - DNA, 1346 bp, Clostridium perfringens; identical to SEQ ID NO: 2936
  CDS (172)..(1230)

SEQ ID NO: 11967 - protein, 352 aa, Clostridium perfringens; identical to SEQ ID NO: 2937

SEQ ID NO: 11968 - DNA, 1053 bp, Clostridium tetani; identical to SEQ ID NO: 2938
  CDS (1)..(1053)

SEQ ID NO: 11969 - protein, 350 aa, Clostridium tetani; identical to SEQ ID NO: 2939

SEQ ID NO: 11970 - DNA, 1161 bp, Corynebacterium efficiens; identical to SEQ ID NO: 2940
  CDS (1)..(1161)

SEQ ID NO: 11971 - protein, 386 aa, Corynebacterium efficiens; identical to SEQ ID NO: 2941

SEQ ID NO: 11972 - DNA, 1402 bp, Corynebacterium glutamicum; identical to SEQ ID NO: 2942
  CDS (133)..(1263)

SEQ ID NO: 11973 - protein, 376 aa, Corynebacterium glutamicum; identical to SEQ ID NO: 2943

SEQ ID NO: 11974 - DNA, 1409 bp, Corynebacterium pseudotuberculosis; identical to SEQ ID NO: 2944
  CDS (223)..(1332)

SEQ ID NO: 11975 - protein, 369 aa, Corynebacterium pseudotuberculosis; identical to SEQ ID NO: 2945

SEQ ID NO: 11976 - DNA, 1032 bp, Coxiella burnetii; identical to SEQ ID NO: 2946
  CDS (1)..(1032)

SEQ ID NO: 11977 - protein, 343 aa, Coxiella burnetii; identical to SEQ ID NO: 2947

SEQ ID NO: 11978 - DNA, 1047 bp, Enterococcus faecalis; identical to SEQ ID NO: 2948
  CDS (1)..(1047)

SEQ ID NO: 11979 - protein, 348 aa, Enterococcus faecalis; identical to SEQ ID NO: 2949

SEQ ID NO: 11980 - DNA, 1072 bp, Erwinia carotovora; identical to SEQ ID NO: 2950
  CDS (1)..(1029)

SEQ ID NO: 11981 - protein, 342 aa, Erwinia carotovora; identical to SEQ ID NO: 2951

SEQ ID NO: 11982 - DNA, 1137 bp, Fusobacterium nucleatum; identical to SEQ ID NO: 2952
  CDS (1)..(1137)

SEQ ID NO: 11983 - protein, 378 aa, Fusobacterium nucleatum; identical to SEQ ID NO: 2953

SEQ ID NO: 11984 - DNA, 1613 bp, Herbaspirillum seropedicae; identical to SEQ ID NO: 2954
  CDS (199)..(1254)

SEQ ID NO: 11985 - protein, 351 aa, Herbaspirillum seropedicae; identical to SEQ ID NO: 2955

SEQ ID NO: 11986 - DNA, 1143 bp, Lactobacillus plantarum; identical to SEQ ID NO: 2956
  CDS (1)..(1143)

SEQ ID NO: 11987 - protein, 380 aa, Lactobacillus plantarum; identical to SEQ ID NO: 2957

SEQ ID NO: 11988 - DNA, 1101 bp, Leptospira interrogans; identical to SEQ ID NO: 2958
  CDS (1)..(1101)

SEQ ID NO: 11989 - protein, 366 aa, Leptospira interrogans; identical to SEQ ID NO: 2959

SEQ ID NO: 11990 - DNA, 1126 bp, Mycoplasma mycoides; identical to SEQ ID NO: 2960
  CDS (79)..(1116)

SEQ ID NO: 11991 - protein, 345 aa, Mycoplasma mycoides; identical to SEQ ID NO: 2961

SEQ ID NO: 11992 - DNA, 1050 bp, Mycobacterium smegmatis; identical to SEQ ID NO: 2962
  CDS (1)..(1050)

SEQ ID NO: 11993 - protein, 349 aa, Mycobacterium smegmatis; identical to SEQ ID NO: 2963

SEQ ID NO: 11994 - DNA, 1044 bp, Oceanobacillus iheyensis; identical to SEQ ID NO: 2964
  CDS (1)..(1044)

SEQ ID NO: 11995 - protein, 347 aa, Oceanobacillus iheyensis; identical to SEQ ID NO: 2965

SEQ ID NO: 11996 - DNA, 1071 bp, Paracoccus denitrificans; identical to SEQ ID NO: 2966
  CDS (1)..(1071)

SEQ ID NO: 11997 - protein, 356 aa, Paracoccus denitrificans; identical to SEQ ID NO: 2967

SEQ ID NO: 11998 - DNA, 1320 bp, Pasteurella haemolytica; identical to SEQ ID NO: 2968
  CDS (157)..(1263)

SEQ ID NO: 11999 - protein, 368 aa, Pasteurella haemolytica; identical to SEQ ID NO: 2969

SEQ ID NO: 12000 - DNA, 1500 bp, Pasteurella multocida; identical to SEQ ID NO: 2970
  CDS (175)..(1239)

SEQ ID NO: 12001 - protein, 354 aa, Pasteurella multocida; identical to SEQ ID NO: 2971

SEQ ID NO: 12002 - DNA, 1023 bp, Porphyromonas gingivalis; identical to SEQ ID NO: 2972
  CDS (1)..(1023)

SEQ ID NO: 12003 - protein, 340 aa, Porphyromonas gingivalis; identical to SEQ ID NO: 2973

SEQ ID NO: 12004 - DNA, 1824 bp, Prevotella ruminicola; identical to SEQ ID NO: 2974
  CDS (501)..(1523)

SEQ ID NO: 12005 - protein, 340 aa, Prevotella ruminicola; identical to SEQ ID NO: 2975

SEQ ID NO: 12006 - DNA, 978 bp, Proteus vulgaris; identical to SEQ ID NO: 2976
  CDS (1)..(978)

SEQ ID NO: 12007 - protein, 325 aa, Proteus vulgaris; identical to SEQ ID NO: 2977

SEQ ID NO: 12008 - DNA, 1047 bp, Pseudomonas oleovorans; identical to SEQ ID NO: 2978
  CDS (1)..(1047)

SEQ ID NO: 12009 - protein, 348 aa, Pseudomonas oleovorans; identical to SEQ ID NO: 2979

SEQ ID NO: 12010 - DNA, 1068 bp, Pseudomonas putida; identical to SEQ ID NO: 2980
  CDS (1)..(1068)

SEQ ID NO: 12011 - protein, 355 aa, Pseudomonas putida; identical to SEQ ID NO: 2981

SEQ ID NO: 12012 - DNA, 1110 bp, Pseudomonas syringae; identical to SEQ ID NO: 2982
  CDS (46)..(1110)

SEQ ID NO: 12013 - protein, 354 aa, Pseudomonas syringae; identical to SEQ ID NO: 2983

SEQ ID NO: 12014 - DNA, 1980 bp, Pseudomonas tolaasii; identical to SEQ ID NO: 2984
  CDS (414)..(1472)

SEQ ID NO: 12015 - protein, 352 aa, Pseudomonas tolaasii; identical to SEQ ID NO: 2985

SEQ ID NO: 12016 - DNA, 1501 bp, Rhizobium etli; identical to SEQ ID NO: 2986
  CDS (242)..(1327)

SEQ ID NO: 12017 - protein, 361 aa, Rhizobium etli; identical to SEQ ID NO: 2987

SEQ ID NO: 12018 - DNA, 1098 bp, Rhizobium loti; identical to SEQ ID NO: 2988
  CDS (1)..(1098)

SEQ ID NO: 12019 - protein, 365 aa, Rhizobium loti; identical to SEQ ID NO: 2989

SEQ ID NO: 12020 - DNA, 1092 bp, Rhodopseudomonas palustris; identical to SEQ ID NO: 2990
  CDS (1)..(1092)

SEQ ID NO: 12021 - protein, 363 aa, Rhodopseudomonas palustris; identical to SEQ ID NO: 2991

SEQ ID NO: 12022 - DNA, 1047 bp, Rhodopseudomonas viridis; identical to SEQ ID NO: 2992
  CDS (1)..(1047)

SEQ ID NO: 12023 - protein, 348 aa, Rhodopseudomonas viridis; identical to SEQ ID NO: 2993

SEQ ID NO: 12024 - DNA, 1074 bp, Shewanella oneidensis; identical to SEQ ID NO: 2994
  CDS (1)..(1074)

SEQ ID NO: 12025 - protein, 357 aa, Shewanella oneidensis; identical to SEQ ID NO: 2995

SEQ ID NO: 12026 - DNA, 1235 bp, Spirulina platensis; identical to SEQ ID NO: 2996
  CDS (54)..(1151)

SEQ ID NO: 12027 - protein, 365 aa, Spirulina platensis; identical to SEQ ID NO: 2997

SEQ ID NO: 12028 - DNA, 1074 bp, Staphylococcus epidermidis; identical to SEQ ID NO: 2998
  CDS (25)..(1074)

SEQ ID NO: 12029 - protein, 349 aa, Staphylococcus epidermidis; identical to SEQ ID NO: 2999

SEQ ID NO: 12030 - DNA, 1140 bp, Streptococcus agalactiae; identical to SEQ ID NO: 3000
  CDS (1)..(1140)

SEQ ID NO: 12031 - protein, 379 aa, Streptococcus agalactiae; identical to SEQ ID NO: 3001

SEQ ID NO: 12032 - DNA, 1119 bp, Streptomyces ambofaciens; identical to SEQ ID NO: 3002
  CDS (1)..(1119)

SEQ ID NO: 12033 - protein, 372 aa, Streptomyces ambofaciens; identical to SEQ ID NO: 3003

SEQ ID NO: 12034 - DNA, 1134 bp, Streptomyces avermitilis; identical to SEQ ID NO: 3004
  CDS (1)..(1134)

SEQ ID NO: 12035 - protein, 377 aa, Streptomyces avermitilis; identical to SEQ ID NO: 3005

SEQ ID NO: 12036 - DNA, 1152 bp, Streptococcus mutans; identical to SEQ ID NO: 3006
  CDS (1)..(1152)

SEQ ID NO: 12037 - protein, 383 aa, Streptococcus mutans; identical to SEQ ID NO: 3007

SEQ ID NO: 12038 - DNA, 1137 bp, Streptococcus pyogenes; identical to SEQ ID NO: 3008
  CDS (1)..(1137)

SEQ ID NO: 12039 - protein, 378 aa, Streptococcus pyogenes; identical to SEQ ID NO: 3009

SEQ ID NO: 12040 - DNA, 1356 bp, Streptococcus parasanguis; identical to SEQ ID NO: 3010
  CDS (118)..(1263)

SEQ ID NO: 12041 - protein, 381 aa, Streptococcus parasanguis; identical to SEQ ID NO: 3011

SEQ ID NO: 12042 - DNA, 1416 bp, Streptomyces rimosus; identical to SEQ ID NO: 3012
  CDS (229)..(1359)

SEQ ID NO: 12043 - protein, 376 aa, Streptomyces rimosus; identical to SEQ ID NO: 3013

SEQ ID NO: 12044 - DNA, 1916 bp, Streptococcus thermophilus; identical to SEQ ID NO: 3014
  CDS (555)..(1694)

SEQ ID NO: 12045 - protein, 379 aa, Streptococcus thermophilus; identical to SEQ ID NO: 3015

SEQ ID NO: 12046 - DNA, 1271 bp, Streptomyces violaceus; identical to SEQ ID NO: 3016
  CDS (75)..(1208)

SEQ ID NO: 12047 - protein, 377 aa, Streptomyces violaceus; identical to SEQ ID NO: 3017

SEQ ID NO: 12048 - DNA, 1068 bp, Synechococcus elongatus; identical to SEQ ID NO: 3018
  CDS (1)..(1068)

SEQ ID NO: 12049 - protein, 355 aa, Synechococcus elongatus; identical to SEQ ID NO: 3019

SEQ ID NO: 12050 - DNA, 1023 bp, Thermus thermophilus; identical to SEQ ID NO: 3020
  CDS (1)..(1023)

SEQ ID NO: 12051 - protein, 340 aa, Thermus thermophilus; identical to SEQ ID NO: 3021

SEQ ID NO: 12052 - DNA, 1405 bp, Thiobacillus ferrooxidans; identical to SEQ ID NO: 3022
  CDS (196)..(1236)

SEQ ID NO: 12053 - protein, 346 aa, Thiobacillus ferrooxidans; identical to SEQ ID NO: 3023

SEQ ID NO: 12054 - DNA, 1314 bp, Tropheryma whipplei; identical to SEQ ID NO: 3024
  CDS (1)..(1314)

SEQ ID NO: 12055 - protein, 437 aa, Tropheryma whipplei; identical to SEQ ID NO: 3025

SEQ ID NO: 12056 - DNA, 1411 bp, Vibrio cholerae; identical to SEQ ID NO: 3026
  CDS (183)..(1247)

SEQ ID NO: 12057 - protein, 354 aa, Vibrio cholerae; identical to SEQ ID NO: 3027

SEQ ID NO: 12058 - DNA, 1044 bp, Vibrio parahaemolyticus; identical to SEQ ID NO: 3028
  CDS (1)..(1044)

SEQ ID NO: 12059 - protein, 347 aa, Vibrio parahaemolyticus; identical to SEQ ID NO: 3029

SEQ ID NO: 12060 - DNA, 996 bp, Wigglesworthia glossinidia brevipalpis; identical to SEQ ID NO: 3030
  CDS (1)..(996)

SEQ ID NO: 12061 - protein, 331 aa, Wigglesworthia glossinidia brevipalpis; identical to SEQ ID NO: 3031

SEQ ID NO: 12062 - DNA, 1035 bp, Xanthomonas axonopodis; identical to SEQ ID NO: 3032
  CDS (1)..(1035)

SEQ ID NO: 12063 - protein, 344 aa, Xanthomonas axonopodis; identical to SEQ ID NO: 3033

SEQ ID NO: 12064 - DNA, 1594 bp, Xenorhabdus nematophilus; identical to SEQ ID NO: 3034
  CDS (142)..(1218)

SEQ ID NO: 12065 - protein, 358 aa, Xenorhabdus nematophilus; identical to SEQ ID NO: 3035

SEQ ID NO: 12066 - DNA, 1044 bp, Xylella fastidiosa; identical to SEQ ID NO: 3036
  CDS (1)..(1044)

SEQ ID NO: 12067 - protein, 347 aa, Xylella fastidiosa; identical to SEQ ID NO: 3037

SEQ ID NO: 12068 - DNA, 1020 bp, Zymomonas mobilis; identical to SEQ ID NO: 3038
  CDS (1)..(1020)

SEQ ID NO: 12069 - protein, 339 aa, Zymomonas mobilis; identical to SEQ ID NO: 3039

SEQ ID NO: 12070 - DNA, 1660 bp, primary endosymbiont of Sitophilus oryzae; identical to SEQ ID NO: 3040
  CDS (11)..(1078)

SEQ ID NO: 12071 - protein, 355 aa, primary endosymbiont of Sitophilus oryzae; identical to SEQ ID NO: 3041

SEQ ID NO: 12072 - DNA, 1110 bp, Azospirillum lipoferum; identical to SEQ ID NO: 3042
  CDS (1)..(1110)

SEQ ID NO: 12073 - protein, 369 aa, Azospirillum lipoferum; identical to SEQ ID NO: 3043

SEQ ID NO: 12074 - DNA, 1017 bp, Geobacter sulfurreducens; identical to SEQ ID NO: 3044
  CDS (1)..(1017)

SEQ ID NO: 12075 - protein, 338 aa, Geobacter sulfurreducens; identical to SEQ ID NO: 3045

SEQ ID NO: 12076 - DNA, 1230 bp, Mycobacterium paratuberculosis; identical to SEQ ID NO: 3046
  CDS (1)..(1230)

SEQ ID NO: 12077 - protein, 409 aa, Mycobacterium paratuberculosis; identical to SEQ ID NO: 3047

SEQ ID NO: 12078 - DNA, 1083 bp, Lactobacillus johnsonii; identical to SEQ ID NO: 3048
  CDS (1)..(1083)

SEQ ID NO: 12079 - protein, 360 aa, Lactobacillus johnsonii; identical to SEQ ID NO: 3049

SEQ ID NO: 12080 - DNA, 1245 bp, Treponema denticola; identical to SEQ ID NO: 3050
  CDS (1)..(1245)

SEQ ID NO: 12081 - protein, 414 aa, Treponema denticola; identical to SEQ ID NO: 3051

SEQ ID NO: 12082 - DNA, 1068 bp, Wolbachia pipientis wMel; identical to SEQ ID NO: 3052
  CDS (1)..(1068)

SEQ ID NO: 12083 - protein, 355 aa, Wolbachia pipientis wMel; identical to SEQ ID NO: 3053

SEQ ID NO: 12084 - DNA, 1074 bp, Desulfovibrio vulgaris; identical to SEQ ID NO: 3054
  CDS (1)..(1074)

SEQ ID NO: 12085 - protein, 357 aa, Desulfovibrio vulgaris; identical to SEQ ID NO: 3055

SEQ ID NO: 12086 - DNA, 1557 bp, Bacillus licheniformis; identical to SEQ ID NO: 3056
  CDS (369)..(1415)

SEQ ID NO: 12087 - protein, 348 aa, Bacillus licheniformis; identical to SEQ ID NO: 3057

SEQ ID NO: 12088 - DNA, 1119 bp, Corynebacterium diphtheriae; identical to SEQ ID NO: 3058
  CDS (1)..(1119)

SEQ ID NO: 12089 - protein, 372 aa, Corynebacterium diphtheriae; identical to SEQ ID NO: 3059

SEQ ID NO: 12090 - DNA, 1038 bp, Mycoplasma mycoides; identical to SEQ ID NO: 3060
  CDS (1)..(1038)

SEQ ID NO: 12091 - protein, 345 aa, Mycoplasma mycoides; identical to SEQ ID NO: 3061

SEQ ID NO: 12092 - DNA, 1134 bp, Bdellovibrio bacteriovorus; identical to SEQ ID NO: 3062
  CDS (1)..(1134)

SEQ ID NO: 12093 - protein, 377 aa, Bdellovibrio bacteriovorus; identical to SEQ ID NO: 3063

SEQ ID NO: 12094 - DNA, 1086 bp, Parachlamydia sp; identical to SEQ ID NO: 3064
  CDS (1)..(1086)

SEQ ID NO: 12095 - protein, 361 aa, Parachlamydia sp; identical to SEQ ID NO: 3065

SEQ ID NO: 12096 - DNA, 1071 bp, Photobacterium profundum; identical to SEQ ID NO: 3066

SEQ ID NO: 12097 - protein, 356 aa, Photobacterium profundum; identical to SEQ ID NO: 3067

SEQ ID NO: 12098 - DNA, 24 bp, Primer
atggctatcgacgaaaacaaacag

SEQ ID NO: 12099 - DNA, 27 bp, Primer
ttaaaaatcttcgttagtttctgctac

SEQ ID NO: 12100 - DNA, 1062 bp, Saccharomyces cerevisiae
  CDS (1)..(1062)
atggtcgatacgcataaactagcagacgacgttcttcagctattggataaccgtatcgaagataattatagggtttgtgttatcctagtcggttctccaggctccggtaagtctactattgcggaagaactttgtcaaattataaatgaaaaatatcacacatttttgtcagagcatccaaatgttattgaggttaatgataggttgaaacctatggttaacctagtagactctttaaagacgctccagcccaataaagtagctgaaatgattgaaaatcaggggctgtttaaagatcatgttgaggatgttaattttcaaccagtcaagtactcagcccttacatcaaataatgaagaatgtaccgcagtagttgccagaggtggtactgcgaatgccataagaatcgcagcagttgataatccagtcaatgttaacaagttggcccaggatagtatcaatatagcgcaaatagtcccaatggatggttttcacttatctcgcagatgtctagacctattcaaagacccacaaactgcccataaaagaagaggttcgccctcaacgtttgacagtaacaatttcttacaattgtgtaaaattctagccaagacgtccctatgtaaggtctcctcacatcataaattttactccacttcaagcgtttttgagaagttatccaaaacttttagccaaacaattcctgatatctttgttccaggatttaaccatgcactaaaagacccaactccagatcagtactgtatttccaaatttacaaggatagttatacttgaagggttatacctactgtatgaccaagaaaactggaagaaaatttacaaaacattagctgatacgggagcacttcttgtttataagattgacatagactatgaggccaccgaagaaagggtggccaaaaggcatttgcaatcagggttagtcacgactattgcagaaggacgagagaagtttcgcagcaatgatttgttgaatggcagggatatagataatcatttaattaaggtagataatatcgtccatatccgcaacgactag

SEQ ID NO: 12101 - protein, 353 aa, Saccharomyces cerevisiae
MVDTHKLADDVLQLLDNRIEDNYRVCVILVGSPGSGKSTIAEELCQIINEKYHTFLSEHPNVIEVNDRLKPMVNLVDSLKTLQPNKVAEMIENQGLFKDHVEDVNFQPVKYSALTSNNEECTAVVARGGTANAIRIAAVDNPVNVNKLAQDSINIAQIVPMDGFHLSRRCLDLFKDPQTAHKRRGSPSTFDSNNFLQLCKILAKTSLCKVSSHHKFYSTSSVFEKLSKTFSQTIPDIFVPGFNHALKDPTPDQYCISKFTRIVILEGLYLLYDQENWKKIYKTLADTGALLVYKIDIDYEATEERVAKRHLQSGLVTTIAEGREKFRSNDLLNGRDIDNHLIKVDNIVHIRND

SEQ ID NO: 12102 - DNA, 813 bp, Arabidopsis thaliana (mouse-ear cress)
  CDS (1)..(813)
atggaggtttcttctttctccactgtacccagatactgtaactcacgctcctttgttccaggggattcaaagttcacttatgggaccaatctcttgttcctcttcatttcagcattcgaaaacgaaagaacacccctcgttatttgtcagaagaaagatgtcactgttgttgatggaagttgtatggatgagatctatgataagttggcggaacgtcttgtccctacagcagcggcaatgtttagccccaatcttaaacgtttggtcggtttggctggtcctcctggtgccgggaaaagtacagtagcaaatgaagttgtgcgtcgtgtaaataagctatggcctcagaaagctgcttcttttgatgctgaggttaatccaccggatgttgctatagtacttcccatggatggtttccatttgtatcgttcgcaactcgatgctatggaggatcccaaagaagcccatgcgagaagaggggtttatgtgccatcatttgatcatggagttggggatccagttgaagatgatatctttgttagcctccagcataaagtggtaattgtagaaggaaactacatcttgttagaagaagggtcttggaaagacatctcagatatgtttgatgagaaatggttcatcgatgtgaatctcgatacagcaatgcaacgtgttgaaaaccggcatatctcaactggtaaacccccagatgttgctaaatggcgggtggattataatgaccgacccaacgcagagctgataataaagtcaaagacaaacgctgatctactgatcagatctatgaacatttga

SEQ ID NO: 12103 - protein, 270 aa, Arabidopsis thaliana (mouse-ear cress)
MEVSSFSTVPRYCNSRSFVPGDSKFTYGTNLLFLFISAFENERTPLVICQKKDVTVVDGSCMDEIYDKLAERLVPTAAAMFSPNLKRLVGLAGPPGAGKSTVANEVVRRVNKLWPQKAASFDAEVNPPDVAIVLPMDGFHLYRSQLDAMEDPKEAHARRGVYVPSFDHGVGDPVEDDIFVSLQHKVVIVEGNYILLEEGSWKDISDMFDEKWFIDVNLDTAMQRVENRHISTGKPPDVAKWRVDYNDRPNAELIIKSKTNADLLIRSMNI

SEQ ID NO: 12104 - DNA, 642 bp, Brucella melitensis
  CDS (1)..(642)
atgaggcctatcgagcgcgaagccctgccttcggaaattcttgcgcggttggcgaaaaccgaagggcgtctgatcgtggccattgccggcccgccgggcgcgggcaaatccaccctgtccgattatctgctccacgccatcaacaagggcggcaatgcgccatccatcatcgtgcccatggacgggtttcacatcgacgatgtgattcttgaacagcgcggattgctggatcgcaagggatcgccgcccacttttgattgcgcaggtttttcttcccttctccagcgcctgaaaggggcggaagaagagatttttatcccggttttcgaccgctcgctggagttttcgcgcgctgccgcatccgtggttgggcctgagcatcgcatcctgctggtcgaaggcaattacctgctgcttgaccgggagccgtggtcaaggcttgctccctttttcgacatgacggtctatctggatgtgccctttgccgtgctggagcgccgcctgacagaccgctggctcggtttcggcttcgatgtggaaacggcccgaaaccgcgccctctccaatgacattcccaacgccgaactcgtggctgcacagtcacgcaaggccggttttgtcgttagtttcgacgcgcgataa

SEQ ID NO: 12105 - protein, 213 aa, Brucella melitensis
MRPIEREALPSEILARLAKTEGRLIVAIAGPPGAGKSTLSDYLLHAINKGGNAPSIIVPMDGFHIDDVILEQRGLLDRKGSPPTFDCAGFSSLLQRLKGAEEEIFIPVFDRSLEFSRAAASVVGPEHRILLVEGNYLLLDREPWSRLAPFFDMTVYLDVPFAVLERRLTDRWLGFGFDVETARNRALSNDIPNAELVAAQSRKAGFVVSFDAR

SEQ ID NO: 12106 - DNA, 708 bp, Schizosaccharomyces pombe
  CDS (1)..(708)
atggctttacaagtagatgccccagatgtatcgtcttatgacgaactttacaaccgtgcagttgaattgttgaagcaccagcaacgagttctaatcggtttggctggaggtcctggttcaggcaagtcaacattatgtgctattctcgcaaaggcatggaatgaaagatttggatcggagatcgtaaaaataattccaatggatggctttcattattcgttggaagagcttgatcgattcgacaacccagaaaaggcccgggctcttcgtggagcagaatggacgtttgatgcagacttattctactccttagttcggcttatgaaaaagatcactgacagagagctctatgccccttcatttgatcatgcaattggtgaccctgtagtcgacgatatttgcgttgagcccaaaaatcgaattttaatttttgaaggtaattaccttttgctcaacaaacctccatggtcagacgcatgcaaattatatgacattaaggcatacctccctgtagagcactcagtggcccgtgctcgtgttgcgcatcgtcacttggtttcaggattatgcgcaacagaagaagaggcaattgagaggaccgacagaaatgatatgattaatctcacttttgtcgagaagaacatggttaccccagatattgtattacagcagctacgtttgaaaaccgttaaaacatctagtttgtaa

SEQ ID NO: 12107 - protein, 235 aa, Schizosaccharomyces pombe
MALQVDAPDVSSYDELYNRAVELLKHQQRVLIGLAGGPGSGKSTLCAILAKAWNERFGSEIVKIIPMDGFHYSLEELDRFDNPEKARALRGAEWTFDADLFYSLVRLMKKITDRELYAPSFDHAIGDPVVDDICVEPKNRILIFEGNYLLLNKPPWSDACKLYDIKAYLPVEHSVARARVAHRHLVSGLCATEEEAIERTDRNDMINLTFVEKNMVTPDIVLQQLRLKTVKTSSL

SEQ ID NO: 12108 - DNA, 738 bp, Streptomyces avermitilis
  CDS (1)..(738)
atgacgatcaccgacaagaaccgcctcaccggggaagccgacccgcgccgtacgtcgctctacgggcctccgtccatggacgccctcaccgagcgggccctgcacctggcccgggccgggcgggcactgctcggcatcgtcggagaaccgggcgccggcaagtccacgttcgccgagcagctgcgggcgcggctggagaaagagcggccgggactggccgtgaccgtgtccatggacggattccacctcgcccagaaggtcatcgaggcccgggggcaggcggccgacaagggcacgatcgacaccttcgacgccgacggcttcgtcgccctcctgcgccgtacgcgtgccgagaccggagacaccgaaaacaccgaaagcaccgtctggtggccggagttcgaccgcgacctcgaggaccccgtggccgggtcgatcgaggtcgcgccgcaccaccggctggtcatcgtcgacggcaacttcctgctgtccgcgcaggagccctggcggcaggtgaagggcctgctggacgagacctggttcctggacgccctcccggagccgaggcgcgagcggctcacccgccgctacatcagctacggcttcaccccggaggccgcgcgcgcgaagaccctgggagtcgacgaggacaccagtgccctcatccgcagcaccgtctcacgggccgatctcgtcatcggcgaggccagggagagcggcggggtcagcgactgctga

SEQ ID NO: 12109 - protein, 245 aa, Streptomyces avermitilis
MTITDKNRLTGEADPRRTSLYGPPSMDALTERALHLARAGRALLGIVGEPGAGKSTFAEQLRARLEKERPGLAVTVSMDGFHLAQKVIEARGQAADKGTIDTFDADGFVALLRRTRAETGDTENTESTVWWPEFDRDLEDPVAGSIEVAPHHRLVIVDGNFLLSAQEPWRQVKGLLDETWFLDALPEPRRERLTRRYISYGFTPEAARAKTLGVDEDTSALIRSTVSRADLVIGEARESGGVSDC

SEQ ID NO: 12110 - DNA, 735 bp, Neurospora crassa
  CDS (1)..(735)
atggaggaacaaatggatcgcctggtcgagagggcatgggacaagtttctcgacacacccacggatcagagactcttgattgccatagcaggtatccccggctccggaaaaacaaccctctcccaaattctcgctcgccgcctaaatatcctgcacgccaccgaatatccccttgcttccatgtctccagacttcgccactgccctccccatggacggcttccacctcacgcgcgcccaactgtccgccatgcccgacccggaactcgcacacgcccgacgcggcgcggaatttacttttgatggacaggggttttatgagctggtgaaggaactacgaaagccagtggtgacaacggcaaccagaacaacggtgtgggcgcctagtttcgatcatgcgttgaaggatccggtggagaaagggatcgaggtgggaccggagatgagggtggtggtttttgaagggaattacctcctactagaccaaaaaccctggtctgatgctgccaaattgatggacctcaagttcttcgtcagagtgccgttccccgtggccaggaaacggttggtcaagagacatttggctgctgggatcgcggccacagaggaggaggcggataagagggcggtggagaatgatttggtcaatggggctctaattgaggagttattgagggaggatgaggtggacgaggttgtggagagcttggaggatgggaagtgggtgcacacttag

SEQ ID NO: 12111 - protein, 244 aa, Neurospora crassa
MEEQMDRLVERAWDKFLDTPTDQRLLIAIAGIPGSGKTTLSQILARRLNILHATEYPLASMSPDFATALPMDGFHLTRAQLSAMPDPELAHARRGAEFTFDGQGFYELVKELRKPVVTTATRTTVWAPSFDHALKDPVEKGIEVGPEMRVVVFEGNYLLLDQKPWSDAAKLMDLKFFVRVPFPVARKRLVKRHLAAGIAATEEEADKRAVENDLVNGALIEELLREDEVDEVVESLEDGKWVHT

SEQ ID NO: 12112 - DNA, 735 bp, Vibrio parahaemolyticus
  CDS (1)..(735)
atgaaagtgaatttaaacgtcagtggcttcgaaaccgaagcaacctttcccgatgccgacgtaaaacgaatccatcagcctcttatcgaaaaatttactcgcctctatcatgagaagcaggaacgcatagtggtgttcttgtgtgctcctccgggcagtggcaagtcgacactcgctgcattctgggaatacctgtcggaacaagatgaaagccaagagcctttacaagtgctgccgtttgatggtttccattatccaaatgagatcctcgacaacaatacgattgaacgagatggcgagctcgtgtctctgcgcagtattaagggggcccatcaaacatttaatctgacggagcttatcgacaagctcaaacagctcaaagtgaaagatccgaaatggccatactacgaccgcaatttgcatgatccagtcgacgacgccattttagtgaatcgcaatgttgttgtggttgaggggaattggttgctgcttaatgaaccggtgtggaatgaactgcatcgtttggcagattttaccgtcttcgtcgatacacagcctgagtttctgcaagaacgcttagtaaaccgtaagattcgtggtggcaccgcaccagaagccgcattagcgttttatttaaactcagatgccgtaaatgtagataaggttttaaatcattcaattccagcggatctcacgctgtttctcaatcaaaacggttcgttcgaaattcgataa

SEQ ID NO: 12113 - protein, 244 aa, Vibrio parahaemolyticus
MKVNLNVSGFETEATFPDADVKRIHQPLIEKFTRLYHEKQERIVVFLCAPPGSGKSTLAAFWEYLSEQDESQEPLQVLPFDGFHYPNEILDNNTIERDGELVSLRSIKGAHQTFNLTELIDKLKQLKVKDPKWPYYDRNLHDPVDDAILVNRNVVVVEGNWLLLNEPVWNELHRLADFTVFVDTQPEFLQERLVNRKIRGGTAPEAALAFYLNSDAVNVDKVLNHSIPADLTLFLNQNGSFEIR

SEQ ID NO: 12114 - DNA, 699 bp, Brucella suis
  CDS (1)..(699)
atgcctctgataaagggacaggacgaatcacggaaaccggacatgacgcccttcgacatgaggcctatcgagcgcgaagccctgccttcggaaattcttgcgcggttggcgaaaaccgaagggcgtctgatcgtggccattgccggcccgccgggcgcgggcaaatccaccctgtccgattatctgctccacgccatcaacaagggcggcaatgcgccatccatcatcgtgcccatggacgggtttcacatcgacgatgtgattcttgaacagcgcggattgctggatcgcaagggatcgccgcccacttttgattgcgcaggtttttcttcccttctccagcgcctgaaaggggcggaagaagagatttttatcccggttttcgaccgctcgctggagttttcgcgcgctgccgcatccgtggttgggcctgagcatcgcatcctgctggtcgaaggcaattacctgctgcttgaccgggagccgtggtcaaggcttgctccctttttcgacatgacggtctatctggatgtgccctttgccgtgctggagcgccgcctgacagaccgctggctcggtttcggcttcgatgcggaaacggcccgaaaccgcgccctctccaatgacattcccaacgccgaactcgtggctgcacagtcacgcaaggccggttttgtcgttactttcgacgcgcgataa

SEQ ID NO: 12115 - protein, 232 aa, Brucella suis
MPLIKGQDESRKPDMTPFDMRPIEREALPSEILARLAKTEGRLIVAIAGPPGAGKSTLSDYLLHAINKGGNAPSIIVPMDGFHIDDVILEQRGLLDRKGSPPTFDCAGFSSLLQRLKGAEEEIFIPVFDRSLEFSRAAASVVGPEHRILLVEGNYLLLDREPWSRLAPFFDMTVYLDVPFAVLERRLTDRWLGFGFDAETARNRALSNDIPNAELVAAQSRKAGFVVTFDAR

SEQ ID NO: 12116 - DNA, 621 bp, Rhizobium meliloti
  CDS (1)..(621)
atgagcgtcaaatcccttgcggatgaaatcctgaagcggacggtcaattccggccgcttcatcgtcgccatcgccggtccgcccggcgccggtaagtccacgctttccgaaacgcttgcggaggcgatcacgcaggcgggcgaaaaggcggcggtgttgcccatggacgggtttcacatggacaatgccgttctcgaggaaaaagggctgcttgcccgcaagggggcacccgagaccttcgacgtccgatcctttctcgcaacgcttgccgccgtccgcgccgatgacggcgaggttctcgtcccggtcttcgaccgctcccgggaactggcgattgcctcggcgaggatcatcgcgcccgagacgcgtatcgtgcttgccgagggcaactacctgctgctcgacgaagcgccctggaacggcctcgacggcgctttcgattattcgatcttcatcgatccgggtctggaggtgctcgagcggcggctcctgcagcgctggtacgaccacggctatgacgaagacgcggcgcgcagcaaggcctatggcaacgacatacccaatgcccgccgggtcgtcgacagccgcaggccggcggatgtcgtgatcagggacttttag

SEQ ID NO: 12117 - protein, 206 aa, Rhizobium meliloti
MSVKSLADEILKRTVNSGRFIVAIAGPPGAGKSTLSETLAEAITQAGEKAAVLPMDGFHMDNAVLEEKGLLARKGAPETFDVRSFLATLAAVRADDGEVLVPVFDRSRELAIASARIIAPETRIVLAEGNYLLLDEAPWNGLDGAFDYSIFIDPGLEVLERRLLQRWYDHGYDEDAARSKAYGNDIPNARRVVDSRRPADVVIRDF

SEQ ID NO: 12118 - DNA, 1005 bp, Ashbya gossypii
  CDS (1)..(1005)
atggactacgaagacttaaagaagcgagtgtgggatctccttgctcagaatatcgagagcaactatcgggtggctgtagtggtggtggggcatcctgggtccggcaagtctacgatggcgcagaggcttaagcgggacctgaaccaggaattccagagtcacctgaaggcacgaaggggtggattgaggatttccgcgggcattgctgcggaaagcctggacgagactgtgccggttgcgtcaggcgccctggtcgaggaggcgcgacgggggttcttcgcgcacgtggaggacccggggttcaagccacacaagttctacgatggggatgggaccgcagttatcttcgggcgcggcgggctccccaattcggtgcgcatcgcgagcgaagccctggatccagcgtcatcggtcaatatagctgaggtggtgcccatggacgggttccatctgtcgcgggcgcacctggaccacttcgcggatgctgctgcggcgcacaaacggcgcggggcaccctggacgtttgacagtaataactatctgcagctctgtaagctcctggcggccacgtgcaagtggaagccggcgaagagaccgaagggcgaaacgctcatggaaacaatatgcgatacctttgcacagtgccctgtgatatcctatccgggctttgaccacgcggcgaaggatcccgtacgcgatcagcacgtcctaacgggcttcacccgggtgctgatctttgatgggctgtatctgctctacgaccaagaaaactgggcgcatatatatcactcgctggcgagcaccggcgcggtgctggtcgtcaacgtcactgccagcgaagagacccgcgagacccgcgttgcgactagacactttgccgcaggactggttgggtccattgaggagggcgtccgcaagttccgcgagaacgacttactcaacgccaagctcatcgaagaacacacgctggggggcgtgccaaccttgattctttcgaacgactaa

SEQ ID NO: 12119 - protein, 334 aa, Ashbya gossypii
MDYEDLKKRVWDLLAQNIESNYRVAVVVVGHPGSGKSTMAQRLKRDLNQEFQSHLKARRGGLRISAGIAAESLDETVPVASGALVEEARRGFFAHVEDPGFKPHKFYDGDGTAVIFGRGGLPNSVRIASEALDPASSVNIAEVVPMDGFHLSRAHLDHFADAAAAHKRRGAPWTFDSNNYLQLCKLLAATCKWKPAKRPKGETLMETICDTFAQCPVISYPGFDHAAKDPVRDQHVLTGFTRVLIFDGLYLLYDQENWAHIYHSLASTGAVLVVNVTASEETRETRVATRHFAAGLVGSIEEGVRKFRENDLLNAKLIEEHTLGGVPTLILSND

SEQ ID NO: 12120 - DNA, 24 bp, Primer
atggtcgatacgcataaactagca

SEQ ID NO: 12121 - DNA, 23 bp, Primer
ctagtcgttgcggatatggacga

SEQ ID NO: 12122 - protein, 18 aa, consensus
  MISC_FEATURE (1)..(18): consensus for the disclosure of xaa see table XV
XXXXXDXXXXXXXXXXXX

SEQ ID NO: 12123 - protein, 65 aa, consensus; identical to SEQ ID NO: 11423
  MISC_FEATURE (1)..(65): consensus for the disclosure of xaa see table XV

SEQ ID NO: 12124 - protein, 33 aa, consensus; identical to SEQ ID NO: 11424
  MISC_FEATURE (1)..(33): consensus for the disclosure of xaa see table XV

SEQ ID NO: 12125 - protein, 258 aa, consensus; identical to SEQ ID NO: 11425
  MISC_FEATURE (1)..(258): Xaa in all positions is any amino acid.

SEQ ID NO: 12126 - protein, 33 aa, consensus; identical to SEQ ID NO: 4356
  MISC_FEATURE (1)..(33): consensus for the disclosure of xaa see table XV

SEQ ID NO: 12127 - protein, 36 aa, consensus; identical to SEQ ID NO: 4357
  MISC_FEATURE (1)..(36): consensus for the disclosure of xaa see table XV

SEQ ID NO: 12128 - protein, 39 aa, consensus; identical to SEQ ID NO: 4358
  MISC_FEATURE (1)..(39): consensus for the disclosure of xaa see table XV

SEQ ID NO: 12129 - protein, 323 aa, consensus; identical to SEQ ID NO: 5813
  MISC_FEATURE (1)..(323): Xaa in all positions is any amino acid.

SEQ ID NO: 12130 - protein, 21 aa, consensus
  MISC_FEATURE (1)..(21): consensus for the disclosure of xaa see table XV
XXXXXXXXXPGXGKXTXXXXX

SEQ ID NO: 12131 - protein, 17 aa, consensus
  MISC_FEATURE (1)..(17): consensus for the disclosure of xaa see table XV
XXXXXXDGFHXXXXXXX

SEQ ID NO: 12132 - protein, 18 aa, consensus
  MISC_FEATURE (1)..(18): consensus for the disclosure of xaa see table XV
XGXXXTFXXXXXXXXXXX

SEQ ID NO: 12133 - protein, 94 aa, consensus
  MISC_FEATURE (1)..(94): consensus for the disclosure of xaa see table XV
PXXXXXXXXXXXXXXXXXXXXXXXXXXGXXXLXXXXXWXXXXXXXXXXXXXXXXXXXXXXXXXXXRXXXRXXXXGXXXXXXXXXXXXXXXDXXX

SEQ ID NO: 12134 - protein, 312 aa, consensus
  MISC_FEATURE (1)..(312): Xaa in all positions is any amino acid.
RXXXXXXGXPGXGKSTXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPMDXXXXXLXXXXXXXXXXXXXXXXXXGXXXTFDXXXXXXXXXXXXXXXXXXXXXXXXXXXXXXXXXXXXXXXXXXXXXXXXPXFDXXXXXXXXXXXXXXXXXRXXXXEGNYLLXXXXXWXXXXXXXDXXXXXXXXXXXXXXXXXXXRXXXRXXXXGXXXXXXXAXXXXXXNDXXN

SEQ ID NO: 12135 - DNA, 1612 bp, Saccharomyces cerevisiae; identical to SEQ ID NO: 1
  CDS (167)..(1330)

SEQ ID NO: 12136 - protein, 387 aa, Saccharomyces cerevisiae; identical to SEQ ID NO: 2

SEQ ID NO: 12137 - DNA, 25 bp, Primer
atggaacagaacaggttcaagaaag

SEQ ID NO: 12138 - DNA, 27 bp, Primer
ttacagtttttgtttagtcgttttaac

SEQ ID NO: 12139 - DNA, 264 bp, Saccharomyces cerevisiae; identical to SEQ ID NO: 172
  CDS (1)..(264)

SEQ ID NO: 12140 - protein, 87 aa, Saccharomyces cerevisiae; identical to SEQ ID NO: 173

SEQ ID NO: 12141 - DNA, 258 bp, Pectinaria gouldii; identical to SEQ ID NO: 1023
  CDS (1)..(258)

SEQ ID NO: 12142 - protein, 85 aa, Pectinaria gouldii; identical to SEQ ID NO: 217

SEQ ID NO: 12143 - DNA, 264 bp, Schizosaccharomyces pombe; identical to SEQ ID NO: 178
  CDS (1)..(264)

SEQ ID NO: 12144 - protein, 87 aa, Schizosaccharomyces pombe; identical to SEQ ID NO: 179

SEQ ID NO: 12145 - DNA, 249 bp, Guillardia theta nucleomorph; identical to SEQ ID NO: 1027
  CDS (1)..(249)

SEQ ID NO: 12146 - protein, 82 aa, Guillardia theta nucleomorph; identical to SEQ ID NO: 189

SEQ ID NO: 12147 - DNA, 252 bp, Drosophila melanogaster; identical to SEQ ID NO: 194
  CDS (1)..(252)

SEQ ID NO: 12148 - protein, 83 aa, Drosophila melanogaster [sequence omitted]

SEQ ID NO: 12149 - DNA, 246 bp, Anopheles gambiae; identical to SEQ ID NO: 1031
  CDS (1)..(243)

SEQ ID NO: 12150 - protein, 80 aa, Anopheles gambiae; identical to SEQ ID NO: 207

SEQ ID NO: 12151 - DNA, 270 bp, Giardia lamblia; identical to SEQ ID NO: 204
  CDS (1)..(270)

SEQ ID NO: 12152 - protein, 89 aa, Giardia lamblia; identical to SEQ ID NO: 205

SEQ ID NO: 12153 - DNA, 249 bp, Oryza sativa; identical to SEQ ID NO: 1035
  CDS (1)..(249)

SEQ ID NO: 12154 - protein, 82 aa, Oryza sativa; identical to SEQ ID NO: 1036

SEQ ID NO: 12155 - DNA, 246 bp, Danio rerio; identical to SEQ ID NO: 214
  CDS (1)..(246)

SEQ ID NO: 12156 - protein, 81 aa, Danio rerio; identical to SEQ ID NO: 215

SEQ ID NO: 12157 - DNA, 258 bp, Branchiostoma belcheri tsingtaunese; identical to SEQ ID NO: 1039
  CDS (1)..(258)

SEQ ID NO: 12158 - protein, 85 aa, Branchiostoma belcheri tsingtaunese; identical to SEQ ID NO: 203

SEQ ID NO: 12159 - DNA, 252 bp, Ceratitis capitata; identical to SEQ ID NO: 200
  CDS (1)..(252)

SEQ ID NO: 12160 - protein, 83 aa, Ceratitis capitata; identical to SEQ ID NO: 201

SEQ ID NO: 12161 - DNA, 249 bp, Plasmodium falciparum; identical to SEQ ID NO: 198
  CDS (1)..(249)

SEQ ID NO: 12162 - protein, 82 aa, Plasmodium falciparum; identical to SEQ ID NO: 199

SEQ ID NO: 12163 - DNA, 249 bp, Arabidopsis thaliana; identical to SEQ ID NO: 208
  CDS (1)..(249)

SEQ ID NO: 12164 - protein, 82 aa, Arabidopsis thaliana; identical to SEQ ID NO: 209

SEQ ID NO: 12165 - DNA, 252 bp, Ictalurus punctatus; identical to SEQ ID NO: 212
  CDS (1)..(252)

SEQ ID NO: 12166 - protein, 83 aa, Ictalurus punctatus; identical to SEQ ID NO: 213

SEQ ID NO: 12167 - DNA, 252 bp, Spodoptera frugiperda; identical to SEQ ID NO: 1049
  CDS (1)..(252)

SEQ ID NO: 12168 - protein, 83 aa, Spodoptera frugiperda; identical to SEQ ID NO: 197

SEQ ID NO: 12169 - DNA, 273 bp, Homo sapiens; identical to SEQ ID NO: 1051
  CDS (1)..(273)

SEQ ID NO: 12170 - protein, 90 aa, Homo sapiens; identical to SEQ ID NO: 193

SEQ ID NO: 12171 - DNA, 201 bp, Homo sapiens; identical to SEQ ID NO: 1053
  CDS (1)..(201)

SEQ ID NO: 12172 - protein, 66 aa, Homo sapiens; identical to SEQ ID NO: 191

SEQ ID NO: 12173 - DNA, 252 bp, Rattus norvegicus; identical to SEQ ID NO: 1055
  CDS (1)..(252)

SEQ ID NO: 12174 - protein, 83 aa, Rattus norvegicus; identical to SEQ ID NO: 177

SEQ ID NO: 12175 - DNA, 267 bp, Caenorhabditis elegans; identical to SEQ ID NO: 1057
  CDS (1)..(267)

SEQ ID NO: 12176 - protein, 88 aa, Caenorhabditis elegans; identical to SEQ ID NO: 219

SEQ ID NO: 12177 - DNA, 264 bp, Candida albicans; identical to SEQ ID NO: 220
  CDS (1)..(264)

SEQ ID NO: 12178 - protein, 87 aa, Candida albicans; identical to SEQ ID NO: 221

SEQ ID NO: 12179 - DNA, 332 bp, Cyanophora paradoxa; identical to SEQ ID NO: 1061
  CDS (1)..(249)

SEQ ID NO: 12180 - protein, 82 aa, Cyanophora paradoxa; identical to SEQ ID NO: 223

SEQ ID NO: 12181 - DNA, 252 bp, Mus musculus; identical to SEQ ID NO: 1063
  CDS (1)..(252)

SEQ ID NO: 12182 - protein, 83 aa, Mus musculus; identical to SEQ ID NO: 225

SEQ ID NO: 12183 - DNA, 264 bp, Neurospora crassa; identical to SEQ ID NO: 226
  CDS (1)..(264)

SEQ ID NO: 12184 - protein, 87 aa, Neurospora crassa; identical to SEQ ID NO: 227

SEQ ID NO: 12185 - DNA, 252 bp, Homo sapiens; identical to SEQ ID NO: 1067
  CDS (1)..(252)

SEQ ID NO: 12186 - protein, 83 aa, Homo sapiens; identical to SEQ ID NO: 181

SEQ ID NO: 12187 - DNA, 294 bp, Homo sapiens; identical to SEQ ID NO: 182
  CDS (1)..(294)

SEQ ID NO: 12188 - protein, 97 aa, Homo sapiens; identical to SEQ ID NO: 183

SEQ ID NO: 12189 - DNA, 246 bp, Zea mays; identical to SEQ ID NO: 184
  CDS (1)..(246)

SEQ ID NO: 12190 - protein, 81 aa, Zea mays; identical to SEQ ID NO: 185

SEQ ID NO: 12191 - DNA, 264 bp, Schizosaccharomyces pombe; identical to SEQ ID NO: 178
  CDS (1)..(264)

SEQ ID NO: 12192 - protein, 87 aa, Schizosaccharomyces pombe; identical to SEQ ID NO: 179

SEQ ID NO: 12193 - DNA, 25 bp, Primer
atggaaaacgataagggccaattag

SEQ ID NO: 12194 - DNA, 24 bp, Primer
ttaacgtgagtaagaccagacgtt

SEQ ID NO: 12195 - DNA, 1980 bp, Saccharomyces cerevisiae; identical to SEQ ID NO: 13
  CDS (1)..(1980)

SEQ ID NO: 12196 - protein, 659 aa, Saccharomyces cerevisiae; identical to SEQ ID NO: 14

SEQ ID NO: 12197 - DNA, 26 bp, Primer
atggatagtacgaatttgaacaaacg

SEQ ID NO: 12198 - DNA, 26 bp, Primer
ttagagtatttccagatctgaatctg

SEQ ID NO: 12199 - DNA, 1350 bp, Escherichia coli K12; identical to SEQ ID NO: 4558
  CDS (1)..(1350)

SEQ ID NO: 12200 - protein, 449 aa, Escherichia coli K12; identical to SEQ ID NO: 4559

SEQ ID NO: 12201 - DNA, 7367 bp, Gallus gallus (chicken); identical to SEQ ID NO: 4560
  CDS (154)..(7128)

SEQ ID NO: 12202 - protein, 2324 aa, Gallus gallus (chicken); identical to SEQ ID NO: 4561

SEQ ID NO: 12203 - DNA, 7038 bp, Rattus norvegicus (Norway rat); identical to SEQ ID NO: 4562
  CDS (1)..(7038)

SEQ ID NO: 12204 - protein, 2345 aa, Rattus norvegicus (Norway rat); identical to SEQ ID NO: 4563

SEQ ID NO: 12205 - DNA, 6270 bp, Cyclotella cryptica; identical to SEQ ID NO: 4564
  CDS (1)..(6270)

SEQ ID NO: 12206 - protein, 2089 aa, Cyclotella cryptica; identical to SEQ ID NO: 4565

SEQ ID NO: 12207 - DNA, 7360 bp, Triticum aestivum (common wheat); identical to SEQ ID NO: 4566
  CDS (159)..(6932)

SEQ ID NO: 12208 - protein, 2257 aa, Triticum aestivum (common wheat); identical to SEQ ID NO: 4567

SEQ ID NO: 12209 - DNA, 1476 bp, Methanobacterium thermoautotrophicum; identical to SEQ ID NO: 4568
  CDS (1)..(1476)

SEQ ID NO: 12210 - protein, 491 aa, Methanobacterium thermoautotrophicum; identical to SEQ ID NO: 4569

SEQ ID NO: 12211 - DNA, 1353 bp, Bacillus subtilis; identical to SEQ ID NO: 4570
  CDS (1)..(1353)

SEQ ID NO: 12212 - protein, 450 aa, Bacillus subtilis; identical to SEQ ID NO: 4571

SEQ ID NO: 12213 - DNA, 1419 bp, Aquifex aeolicus; identical to SEQ ID NO: 4572
  CDS (1)..(1419)

SEQ ID NO: 12214 - protein, 472 aa, Aquifex aeolicus; identical to SEQ ID NO: 4573

SEQ ID NO: 12215 - DNA, 1377 bp, Pseudomonas aeruginosa; identical to SEQ ID NO: 4574
  CDS (1)..(1377)

SEQ ID NO: 12216 - protein, 458 aa, Pseudomonas aeruginosa; identical to SEQ ID NO: 4575

SEQ ID NO: 12217 - DNA, 3453 bp, Bacillus halodurans; identical to SEQ ID NO: 4576
  CDS (1)..(3453)

SEQ ID NO: 12218 - protein, 1150 aa, Bacillus halodurans; identical to SEQ ID NO: 4577

SEQ ID NO: 12219 - DNA, 1347 bp, Agrobacterium tumefaciens; identical to SEQ ID NO: 4578
  CDS (1)..(1347)

SEQ ID NO: 12220 - protein, 448 aa, Agrobacterium tumefaciens; identical to SEQ ID NO: 4579

SEQ ID NO: 12221 - DNA, 1731 bp, Agrobacterium tumefaciens; identical to SEQ ID NO: 4580
  CDS (1)..(1731)

SEQ ID NO: 12222 - protein, 576 aa, Agrobacterium tumefaciens; identical to SEQ ID NO: 4581

SEQ ID NO: 12223 - DNA, 1350 bp, Yersinia pestis; identical to SEQ ID NO: 4582
  CDS (1)..(1350)

SEQ ID NO: 12224 - protein, 449 aa, Yersinia pestis; identical to SEQ ID NO: 4583

SEQ ID NO: 12225 - DNA, 1365 bp, Listeria monocytogenes; identical to SEQ ID NO: 4584
  CDS (1)..(1365)

SEQ ID NO: 12226 - protein, 454 aa, Listeria monocytogenes; identical to SEQ ID NO: 4585

SEQ ID NO: 12227 - DNA, 3525 bp, Agrobacterium tumefaciens; identical to SEQ ID NO: 4586
  CDS (1)..(3525)

SEQ ID NO: 12228 - protein, 1174 aa, Agrobacterium tumefaciens; identical to SEQ ID NO: 4587

SEQ ID NO: 12229 - DNA, 1992 bp, Agrobacterium tumefaciens; identical to SEQ ID NO: 4588
  CDS (1)..(1992)

SEQ ID NO: 12230 - protein, 663 aa, Agrobacterium tumefaciens; identical to SEQ ID NO: 4589

SEQ ID NO: 12231 - DNA, 2037 bp, Brucella melitensis; identical to SEQ ID NO: 4590
  CDS (1)..(2037)

SEQ ID NO: 12232 - protein, 678 aa, Brucella melitensis; identical to SEQ ID NO: 4591

SEQ ID NO: 12233 - DNA, 1344 bp, Nostoc sp. PCC 7120; identical to SEQ ID NO: 4592
  CDS (1)..(1344)

SEQ ID NO: 12234 - protein, 447 aa, Nostoc sp. PCC 7120; identical to SEQ ID NO: 4593

SEQ ID NO: 12235 - DNA, 1350 bp, Salmonella enterica subsp. enterica serovar Typhi; identical to SEQ ID NO: 4594
  CDS (1)..(1350)

SEQ ID NO: 12236 - protein, 449 aa, Salmonella enterica subsp. enterica serovar Typhi; identical to SEQ ID NO: 4595

SEQ ID NO: 12237 - DNA, 1350 bp, Pseudomonas aeruginosa; identical to SEQ ID NO: 4596
  CDS (1)..(1350)

SEQ ID NO: 12238 - protein, 449 aa, Pseudomonas aeruginosa; identical to SEQ ID NO: 4597

SEQ ID NO: 12239 - DNA, 1965 bp, Mycobacterium tuberculosis; identical to SEQ ID NO: 4598
  CDS (1)..(1965)

SEQ ID NO: 12240 - protein, 654 aa, Mycobacterium tuberculosis; identical to SEQ ID NO: 4599

SEQ ID NO: 12241 - DNA, 1338 bp, Deinococcus radiodurans; identical to SEQ ID NO: 4600
  CDS (1)..(1338)

SEQ ID NO: 12242 - protein, 445 aa, Deinococcus radiodurans; identical to SEQ ID NO: 4601

SEQ ID NO: 12243 - DNA, 1446 bp, Campylobacter jejuni; identical to SEQ ID NO: 4602
  CDS (1)..(1446)

SEQ ID NO: 12244 - protein, 481 aa, Campylobacter jejuni; identical to SEQ ID NO: 4603

SEQ ID NO: 12245 - DNA, 3288 bp, Pseudomonas aeruginosa; identical to SEQ ID NO: 4604
  CDS (1)..(3288)

SEQ ID NO: 12246 - protein, 1095 aa, Pseudomonas aeruginosa; identical to SEQ ID NO: 4605

SEQ ID NO: 12247 - DNA, 1368 bp, Lactococcus lactis subsp. lactis; identical to SEQ ID NO: 4606
  CDS (1)..(1368)

SEQ ID NO: 12248 - protein, 455 aa, Lactococcus lactis subsp. lactis; identical to SEQ ID NO: 4607

SEQ ID NO: 12249 - DNA, 2010 bp, Caulobacter crescentus; identical to SEQ ID NO: 4608
  CDS (1)..(2010)

SEQ ID NO: 12250 - protein, 669 aa, Caulobacter crescentus; identical to SEQ ID NO: 4609

SEQ ID NO: 12251 - DNA, 1344 bp, Clostridium acetobutylicum; identical to SEQ ID NO: 4610
  CDS (1)..(1344)

SEQ ID NO: 12252 - protein, 447 aa, Clostridium acetobutylicum; identical to SEQ ID NO: 4611

SEQ ID NO: 12253 - DNA, 1335 bp, Aquifex aeolicus; identical to SEQ ID NO: 4612
  CDS (1)..(1335)

SEQ ID NO: 12254 - protein, 444 aa, Aquifex aeolicus; identical to SEQ ID NO: 4613

SEQ ID NO: 12255 - DNA, 2004 bp, Mycobacterium tuberculosis; identical to SEQ ID NO: 4614
  CDS (1)..(2004)

SEQ ID NO: 12256 - protein, 667 aa, Mycobacterium tuberculosis; identical to SEQ ID NO: 4615

SEQ ID NO: 12257 - DNA, 1998 bp, Rickettsia prowazekii; identical to SEQ ID NO: 4616
  CDS (1)..(1998)

SEQ ID NO: 12258 - protein, 665 aa, Rickettsia prowazekii; identical to SEQ ID NO: 4617

SEQ ID NO: 12259 - DNA, 3276 bp, Deinococcus radiodurans; identical to SEQ ID NO: 4618
  CDS (1)..(3276)

SEQ ID NO: 12260 - protein, 1091 aa, Deinococcus radiodurans; identical to SEQ ID NO: 4619

SEQ ID NO: 12261 - DNA, 1368 bp, Streptococcus pneumoniae; identical to SEQ ID NO: 4620
  CDS (1)..(1368)

SEQ ID NO: 12262 - protein, 455 aa, Streptococcus pneumoniae; identical to SEQ ID NO: 4621

SEQ ID NO: 12263 - DNA, 1506 bp, Methanococcus jannaschii; identical to SEQ ID NO: 4622
  CDS (1)..(1506)

SEQ ID NO: 12264 - protein, 501 aa, Methanococcus jannaschii; identical to SEQ ID NO: 4623

SEQ ID NO: 12265 - DNA, 1521 bp, Archaeoglobus fulgidus; identical to SEQ ID NO: 4624
  CDS (1)..(1521)

SEQ ID NO: 12266 - protein, 506 aa, Archaeoglobus fulgidus; identical to SEQ ID NO: 4625

SEQ ID NO: 12267 - DNA, 3384 bp, Mycobacterium tuberculosis; identical to SEQ ID NO: 4626
  CDS (1)..(3384)

SEQ ID NO: 12268 - protein, 1127 aa, Mycobacterium tuberculosis; identical to SEQ ID NO: 4627

SEQ ID NO: 12269 - DNA, 1374 bp, Chlamydia muridarum, Chlamydia trachomatis MoPn; identical to SEQ ID NO: 4628
  CDS (1)..(1374)

SEQ ID NO: 12270 - protein, 457 aa, Chlamydia muridarum, Chlamydia trachomatis MoPn; identical to SEQ ID NO: 4629

SEQ ID NO: 12271 - DNA, 1359 bp, Bacillus halodurans; identical to SEQ ID NO: 4630
  CDS (1)..(1359)

SEQ ID NO: 12272 - protein, 452 aa, Bacillus halodurans; identical to SEQ ID NO: 4631

SEQ ID NO: 12273 - DNA, 6774 bp, Arabidopsis thaliana (mouse-ear cress); identical to SEQ ID NO: 4632
  CDS (1)..(6774)

SEQ ID NO: 12274 - protein, 2257 aa, Arabidopsis thaliana (mouse-ear cress); identical to SEQ ID NO: 4633

SEQ ID NO: 12275 - DNA, 3237 bp, Caulobacter crescentus; identical to SEQ ID NO: 4634
  CDS (1)..(3237)

SEQ ID NO: 12276 - protein, 1078 aa, Caulobacter crescentus; identical to SEQ ID NO: 4635

SEQ ID NO: 12277 - DNA, 3435 bp, Clostridium acetobutylicum; identical to SEQ ID NO: 4636
  CDS (1)..(3435)

SEQ ID NO: 12278 - protein, 1144 aa, Clostridium acetobutylicum; identical to SEQ ID NO: 4637

SEQ ID NO: 12279 - DNA, 1335 bp, Bacillus subtilis; identical to SEQ ID NO: 4638
  CDS (1)..(1335)

SEQ ID NO: 12280 - protein, 444 aa, Bacillus subtilis; identical to SEQ ID NO: 4639

SEQ ID NO: 12281 - DNA, 1365 bp, Chlamydophila pneumoniae, Chlamydia pneumoniae; identical to SEQ ID NO: 4640
  CDS (1)..(1365)

SEQ ID NO: 12282 - protein, 454 aa, Chlamydophila pneumoniae, Chlamydia pneumoniae; identical to SEQ ID NO: 4641

SEQ ID NO: 12283 - DNA, 1410 bp, Xylella fastidiosa; identical to SEQ ID NO: 4642
  CDS (1)..(1410)

SEQ ID NO: 12284 - protein, 469 aa, Xylella fastidiosa; identical to SEQ ID NO: 4643

SEQ ID NO: 12285 - DNA, 7080 bp, Arabidopsis thaliana (mouse-ear cress); identical to SEQ ID NO: 4644
  CDS (1)..(7080)

SEQ ID NO: 12286 - protein, 2359 aa, Arabidopsis thaliana (mouse-ear cress); identical to SEQ ID NO: 4645

SEQ ID NO: 12287 - DNA, 3414 bp, Lactococcus lactis subsp. lactis; identical to SEQ ID NO: 4646
  CDS (1)..(3414)

SEQ ID NO: 12288 - protein, 1137 aa, Lactococcus lactis subsp. lactis; identical to SEQ ID NO: 4647

SEQ ID NO: 12289 - DNA, 1533 bp, Sulfolobus solfataricus; identical to SEQ ID NO: 4648
  CDS (1)..(1533)

SEQ ID NO: 12290 - protein, 510 aa, Sulfolobus solfataricus; identical to SEQ ID NO: 4649

SEQ ID NO: 12291 - DNA, 1347 bp, Haemophilus influenzae; identical to SEQ ID NO: 4650
  CDS (1)..(1347)

SEQ ID NO: 12292 - protein, 448 aa, Haemophilus influenzae; identical to SEQ ID NO: 4651

SEQ ID NO: 12293 - DNA, 3462 bp, Bacillus subtilis; identical to SEQ ID NO: 4652
  CDS (16)..(3462)

SEQ ID NO: 12294 - protein, 1148 aa, Bacillus subtilis; identical to SEQ ID NO: 4653

SEQ ID NO: 12295 - DNA, 1803 bp, Mycobacterium tuberculosis; identical to SEQ ID NO: 4654
  CDS (1)..(1803)

SEQ ID NO: 12296 - protein, 600 aa, Mycobacterium tuberculosis; identical to SEQ ID NO: 4655

SEQ ID NO: 12297 - DNA, 1344 bp, Vibrio cholerae; identical to SEQ ID NO: 4656
  CDS (1)..(1344)

SEQ ID NO: 12298 - protein, 447 aa, Vibrio cholerae; identical to SEQ ID NO: 4657

SEQ ID NO: 12299 - DNA, 1356 bp, Staphylococcus aureus; identical to SEQ ID NO: 4658
  CDS (1)..(1356)

SEQ ID NO: 12300 - protein, 451 aa, Staphylococcus aureus; identical to SEQ ID NO: 4659

SEQ ID NO: 12301 - DNA, 2004 bp, Agrobacterium tumefaciens; identical to SEQ ID NO: 4660
  CDS (1)..(2004)

SEQ ID NO: 12302 - protein, 667 aa, Agrobacterium tumefaciens; identical to SEQ ID NO: 4661

SEQ ID NO: 12303 - DNA, 1434 bp, Aquifex aeolicus; identical to SEQ ID NO: 4662
  CDS (1)..(1434)

SEQ ID NO: 12304 - protein, 477 aa, Aquifex aeolicus; identical to SEQ ID NO: 4663

SEQ ID NO: 12305 - DNA, 1368 bp, Helicobacter pylori; identical to SEQ ID NO: 4664
  CDS (1)..(1368)

SEQ ID NO: 12306 - protein, 455 aa, Helicobacter pylori; identical to SEQ ID NO: 4665

SEQ ID NO: 12307 - DNA, 1332 bp, Campylobacter jejuni; identical to SEQ ID NO: 4666
  CDS (1)..(1332)

SEQ ID NO: 12308 - protein, 443 aa, Campylobacter jejuni; identical to SEQ ID NO: 4667

SEQ ID NO: 12309 - DNA, 1833 bp, Halobacterium sp. NRC-1; identical to SEQ ID NO: 4668
  CDS (1)..(1833)

SEQ ID NO: 12310 - protein, 610 aa, Halobacterium sp. NRC-1; identical to SEQ ID NO: 4669

SEQ ID NO: 12311 - DNA, 1797 bp, Mycobacterium leprae; identical to SEQ ID NO: 4670
  CDS (1)..(1797)

SEQ ID NO: 12312 - protein, 598 aa, Mycobacterium leprae; identical to SEQ ID NO: 4671

SEQ ID NO: 12313 - DNA, 1347 bp, Caulobacter crescentus; identical to SEQ ID NO: 4672
  CDS (1)..(1347)

SEQ ID NO: 12314 - protein, 448 aa, Caulobacter crescentus; identical to SEQ ID NO: 4673

SEQ ID NO: 12315 - DNA, 1965 bp, Caulobacter crescentus; identical to SEQ ID NO: 4674
  CDS (1)..(1965)

SEQ ID NO: 12316 - protein, 654 aa, Caulobacter crescentus; identical to SEQ ID NO: 4675

SEQ ID NO: 12317 - DNA, 1989 bp, Sinorhizobium meliloti; identical to SEQ ID NO: 4676
  CDS (1)..(1989)

SEQ ID NO: 12318 - protein, 662 aa, Sinorhizobium meliloti; identical to SEQ ID NO: 4677

SEQ ID NO: 12319 - DNA, 1374 bp, Chlamydia trachomatis; identical to SEQ ID NO: 4678
  CDS (1)..(1374)

SEQ ID NO: 12320 - protein, 457 aa, Chlamydia trachomatis; identical to SEQ ID NO: 4679

SEQ ID NO: 12321 - DNA, 1362 bp, Neisseria meningitidis; identical to SEQ ID NO: 4680
  CDS (1)..(1362)

SEQ ID NO: 12322 - protein, 453 aa, Neisseria meningitidis; identical to SEQ ID NO: 4681

SEQ ID NO: 12323 - DNA, 3624 bp, Caulobacter crescentus; identical to SEQ ID NO: 4682
  CDS (1)..(3624)

SEQ ID NO: 12324 - protein, 1207 aa, Caulobacter crescentus; identical to SEQ ID NO: 4683

SEQ ID NO: 12325 - DNA, 2013 bp, Sinorhizobium meliloti; identical to SEQ ID NO: 4684
  CDS (1)..(2013)

SEQ ID NO: 12326 - protein, 670 aa, Sinorhizobium meliloti; identical to SEQ ID NO: 4685

SEQ ID NO: 12327 - DNA, 7041 bp, Homo sapiens (man); identical to SEQ ID NO: 4686
  CDS (1)..(7041)

SEQ ID NO: 12328 - protein, 2346 aa, Homo sapiens (man); identical to SEQ ID NO: 4687

SEQ ID NO: 12329 - DNA, 4201 bp, Saccharomyces cerevisiae; identical to SEQ ID NO: 4688
  CDS (430)..(3966)

SEQ ID NO: 12330 - protein, 1178 aa, Saccharomyces cerevisiae; identical to SEQ ID NO: 4689

SEQ ID NO: 12331 - DNA, 7020 bp, Homo sapiens (man); identical to SEQ ID NO: 4690
  CDS (1)..(7020)

SEQ ID NO: 12332 - protein, 2339 aa, Homo sapiens (man) [sequence omitted]

SEQ ID NO: 12333 - DNA, 6042 bp, Saccharomyces cerevisiae; identical to SEQ ID NO: 4692
  CDS (373)..(5880)

SEQ ID NO: 12334 - protein, 1835 aa, Saccharomyces cerevisiae; identical to SEQ ID NO: 4693

SEQ ID NO: 12335 - DNA, 4315 bp, Saccharomyces cerevisiae; identical to SEQ ID NO: 4694
  CDS (676)..(4218)

SEQ ID NO: 12336 - protein, 1180 aa, Saccharomyces cerevisiae; identical to SEQ ID NO: 4695

SEQ ID NO: 12337 - DNA, 6558 bp, Ustilago maydis (corn smut); identical to SEQ ID NO: 4696
  CDS (1)..(6558)

SEQ ID NO: 12338 - protein, 2185 aa, Ustilago maydis (corn smut); identical to SEQ ID NO: 4697

SEQ ID NO: 12339 - DNA, 8521 bp, Saccharomyces cerevisiae; identical to SEQ ID NO: 4698
  CDS (1539)..(8240)

SEQ ID NO: 12340 - protein, 2233 aa, Saccharomyces cerevisiae; identical to SEQ ID NO: 4699

SEQ ID NO: 12341 - DNA, 1794 bp, Saccharopolyspora erythraea; identical to SEQ ID NO: 4700
  CDS (1)..(1794)

SEQ ID NO: 12342 - protein, 597 aa, Saccharopolyspora erythraea; identical to SEQ ID NO: 4701

SEQ ID NO: 12343 - DNA, 1347 bp, Synechocystis sp; identical to SEQ ID NO: 4702
  CDS (1)..(1347)

SEQ ID NO: 12344 - protein, 448 aa, Synechocystis sp; identical to SEQ ID NO: 4703

SEQ ID NO: 12345 - DNA, 1970 bp, Arabidopsis thaliana (mouse-ear cress); identical to SEQ ID NO: 4704
  CDS (140)..(1753)

SEQ ID NO: 12346 - protein, 537 aa, Arabidopsis thaliana (mouse-ear cress); identical to SEQ ID NO: 4705

SEQ ID NO: 12347 - DNA, 1921 bp, Nicotiana tabacum (common tobacco); identical to SEQ ID NO: 4706
  CDS (85)..(1695)

SEQ ID NO: 12348 - protein, 536 aa, Nicotiana tabacum (common tobacco); identical to SEQ ID NO: 4707

SEQ ID NO: 12349 - DNA, 1998 bp, Leishmania major; identical to SEQ ID NO: 4708
  CDS (1)..(1998)

SEQ ID NO: 12350 - protein, 665 aa, Leishmania major; identical to SEQ ID NO: 4709

SEQ ID NO: 12351 - DNA, 6993 bp, Triticum aestivum (common wheat); identical to SEQ ID NO: 4710
  CDS (39)..(6974)

SEQ ID NO: 12352 - protein, 2311 aa, Triticum aestivum (common wheat); identical to SEQ ID NO: 4711

SEQ ID NO: 12353 - DNA, 6786 bp, Glycine max (soybean); identical to SEQ ID NO: 4712
  CDS (1)..(6786)

SEQ ID NO: 12354 - protein, 2261 aa, Glycine max (soybean); identical to SEQ ID NO: 4713

SEQ ID NO: 12355 - DNA, 2030 bp, Glycine max (soybean); identical to SEQ ID NO: 4714
  CDS (90)..(1709)

SEQ ID NO: 12356 - protein, 539 aa, Glycine max (soybean); identical to SEQ ID NO: 4715

SEQ ID NO: 12357 - DNA, 6915 bp, Brassica napus (rape); identical to SEQ ID NO: 4716
  CDS (1)..(6915)

SEQ ID NO: 12358 - protein, 2304 aa, Brassica napus (rape); identical to SEQ ID NO: 4717

SEQ ID NO: 12359 - DNA, 7175 bp, Medicago sativa (alfalfa); identical to SEQ ID NO: 4718
  CDS (70)..(6843)

SEQ ID NO: 12360 - protein, 2257 aa, Medicago sativa (alfalfa); identical to SEQ ID NO: 4719

SEQ ID NO: 12361 - DNA, 2175 bp, Caenorhabditis elegans; identical to SEQ ID NO: 4720
  CDS (1)..(2175)

SEQ ID NO: 12362 - protein, 724 aa, Caenorhabditis elegans; identical to SEQ ID NO: 4721

SEQ ID NO: 12363 - DNA, 3864 bp, Caenorhabditis elegans; identical to SEQ ID NO: 4722
  CDS (36)..(3563)

SEQ ID NO: 12364 - protein, 1175 aa, Caenorhabditis elegans; identical to SEQ ID NO: 4723

SEQ ID NO: 12365 - DNA, 4974 bp, Caenorhabditis elegans; identical to SEQ ID NO: 4724
  CDS (1)..(4974)

SEQ ID NO: 12366 - protein, 1657 aa, Caenorhabditis elegans; identical to SEQ ID NO: 4725

SEQ ID NO: 12367 - DNA, 6867 bp, Emericella nidulans, Aspergillus nidulans; identical to SEQ ID NO: 4726
  CDS (1)..(6867)

SEQ ID NO: 12368 - protein, 2288 aa, Emericella nidulans, Aspergillus nidulans; identical to SEQ ID NO: 4727

SEQ ID NO: 12369 - DNA, 6165 bp, Caenorhabditis elegans; identical to SEQ ID NO: 4728
  CDS (1)..(6165)

SEQ ID NO: 12370 - protein, 2054 aa, Caenorhabditis elegans; identical to SEQ ID NO: 4729

SEQ ID NO: 12371 - DNA, 6843 bp, Schizosaccharomyces pombe; identical to SEQ ID NO: 4730
  CDS (1)..(6843)

SEQ ID NO: 12372 - protein, 2280 aa, Schizosaccharomyces pombe; identical to SEQ ID NO: 4731

SEQ ID NO: 12373 - DNA, 1773 bp, Streptomyces coelicolor; identical to SEQ ID NO: 4732
  CDS (1)..(1773)

SEQ ID NO: 12374 - protein, 590 aa, Streptomyces coelicolor; identical to SEQ ID NO: 4733

SEQ ID NO: 12375 - DNA, 1773 bp, Streptomyces coelicolor; identical to SEQ ID NO: 4734
  CDS (1)..(1773)

SEQ ID NO: 12376 - protein, 590 aa, Streptomyces coelicolor; identical to SEQ ID NO: 4735

SEQ ID NO: 12377 - DNA, 3933 bp, Aedes aegypti (yellow fever mosquito); identical to SEQ ID NO: 4736
  CDS (69)..(3656)

SEQ ID NO: 12378 - protein, 1195 aa, Aedes aegypti (yellow fever mosquito); identical to SEQ ID NO: 4737

SEQ ID NO: 12379 - DNA, 1542 bp, Sulfolobus metallicus; identical to SEQ ID NO: 4738
  CDS (1)..(1542)

SEQ ID NO: 12380 - protein, 513 aa, Sulfolobus metallicus; identical to SEQ ID NO: 4739

SEQ ID NO: 12381 - DNA, 1335 bp, Bacillus subtilis; identical to SEQ ID NO: 4740
  CDS (1)..(1335)

SEQ ID NO: 12382 - protein, 444 aa, Bacillus subtilis; identical to SEQ ID NO: 4741

SEQ ID NO: 12383 - DNA, 6822 bp, Brassica napus; identical to SEQ ID NO: 4742
  CDS (1)..(6822)

SEQ ID NO: 12384 - protein, 2273 aa, Brassica napus; identical to SEQ ID NO: 4743

SEQ ID NO: 12385 - DNA, 1599 bp, Corynebacterium glutamicum; identical to SEQ ID NO: 4744
  CDS (1)..(1599)

SEQ ID NO: 12386 - protein, 532 aa, Corynebacterium glutamicum; identical to SEQ ID NO: 4745

SEQ ID NO: 12387 - DNA, 3728 bp, Corynebacterium glutamicum; identical to SEQ ID NO: 4746
  CDS (165)..(3587)

SEQ ID NO: 12388 - protein, 1140 aa, Corynebacterium glutamicum; identical to SEQ ID NO: 4747

SEQ ID NO: 12389 - DNA, 7371 bp, Rattus norvegicus; identical to SEQ ID NO: 4748
  CDS (1)..(7371)

SEQ ID NO: 12390 - protein, 2456 aa, Rattus norvegicus; identical to SEQ ID NO: 4749

SEQ ID NO: 12391 - DNA, 3916 bp, Aspergillus terreus; identical to SEQ ID NO: 4750
  CDS (139)..(3720)

SEQ ID NO: 12392 - protein, 1193 aa, Aspergillus terreus; identical to SEQ ID NO: 4751

SEQ ID NO: 12393 - DNA, 3195 bp, Corynebacterium glutamicum; identical to SEQ ID NO: 4752
  CDS (872)..(2647)

SEQ ID NO: 12394 - protein, 591 aa, Corynebacterium glutamicum; identical to SEQ ID NO: 4753

SEQ ID NO: 12395 - DNA, 3558 bp, Schizosaccharomyces pombe; identical to SEQ ID NO: 4754
  CDS (1)..(3558)

SEQ ID NO: 12396 - protein, 1185 aa, Schizosaccharomyces pombe; identical to SEQ ID NO: 4755

SEQ ID NO: 12397 - DNA, 1620 bp, Arabidopsis thaliana; identical to SEQ ID NO: 4756
  CDS (1)..(1620): n means a or g or c or t/u

SEQ ID NO: 12398 - protein, 539 aa, Arabidopsis thaliana; identical to SEQ ID NO: 4757
  misc_feature (351)..(351): Xaa can be Asp or Glu

SEQ ID NO: 12399 - DNA, 3727 bp, Bacillus stearothermophilus; identical to SEQ ID NO: 4758
  CDS (92)..(3535)

SEQ ID NO: 12400 - protein, 1147 aa, Bacillus stearothermophilus; identical to SEQ ID NO: 4759

SEQ ID NO: 12401 - DNA, 6765 bp, Arabidopsis thaliana; identical to SEQ ID NO: 4760
  CDS (1)..(6765)

SEQ ID NO: 12402 - protein, 2254 aa, Arabidopsis thaliana; identical to SEQ ID NO: 4761

SEQ ID NO: 12403 - DNA, 6783 bp, Triticum aestivum; identical to SEQ ID NO: 4762
  CDS (1)..(6783): y means t/u or c

SEQ ID NO: 12404 - protein, 2260 aa, Triticum aestivum; identical to SEQ ID NO: 4763
  misc_feature (1980)..(1980): Xaa can be Pro or Ser

SEQ ID NO: 12405 - DNA, 3375 bp, Mycobacterium tuberculosis; identical to SEQ ID NO: 4764
  CDS (1)..(3375)

SEQ ID NO: 12406 - protein, 1124 aa, Mycobacterium tuberculosis; identical to SEQ ID NO: 4765

SEQ ID NO: 12407 - DNA, 1362 bp, Synechococcus sp; identical to SEQ ID NO: 4766
  CDS (1)..(1362)

SEQ ID NO: 12408 - protein, 453 aa, Synechococcus sp; identical to SEQ ID NO: 4767

SEQ ID NO: 12409 - DNA, 3800 bp, Rhizobium etli; identical to SEQ ID NO: 4768
  CDS (150)..(3614)

SEQ ID NO: 12410 - protein, 1154 aa, Rhizobium etli; identical to SEQ ID NO: 4769

SEQ ID NO: 12411 - DNA, 1422 bp, Wolinella succinogenes; identical to SEQ ID NO: 4770
  CDS (1)..(1422)

SEQ ID NO: 12412 - protein, 473 aa, Wolinella succinogenes; identical to SEQ ID NO: 4771

SEQ ID NO: 12413 - DNA, 3603 bp, Wolinella succinogenes; identical to SEQ ID NO: 4772
  CDS (1)..(3603)

SEQ ID NO: 12414 - protein, 1200 aa, Wolinella succinogenes; identical to SEQ ID NO: 4773

SEQ ID NO: 12415 - DNA, 1347 bp, Wolinella succinogenes; identical to SEQ ID NO: 4774
  CDS (1)..(1347)

SEQ ID NO: 12416 - protein, 448 aa, Wolinella succinogenes; identical to SEQ ID NO: 4775

SEQ ID NO: 12417 - DNA, 1956 bp, Chromobacterium violaceum; identical to SEQ ID NO: 4776
  CDS (1)..(1956)

SEQ ID NO: 12418 - protein, 651 aa, Chromobacterium violaceum; identical to SEQ ID NO: 4777

SEQ ID NO: 12419 - DNA, 1779 bp, Photorhabdus luminescens; identical to SEQ ID NO: 4778
  CDS (1)..(1779)

SEQ ID NO: 12420 - protein, 592 aa, Photorhabdus luminescens; identical to SEQ ID NO: 4779

SEQ ID NO: 12421 - DNA, 1350 bp, Photorhabdus luminescens; identical to SEQ ID NO: 4780
  CDS (1)..(1350)

SEQ ID NO: 12422 - protein, 449 aa, Photorhabdus luminescens; identical to SEQ ID NO: 4781

SEQ ID NO: 12423 - DNA, 1350 bp, Gloeobacter violaceus; identical to SEQ ID NO: 4782
  CDS (1)..(1350)

SEQ ID NO: 12424 - protein, 449 aa, Gloeobacter violaceus; identical to SEQ ID NO: 4783

SEQ ID NO: 12425 - DNA, 3609 bp, Gloeobacter violaceus; identical to SEQ ID NO: 4784
  CDS (1)..(3609)

SEQ ID NO: 12426 - protein, 1202 aa, Gloeobacter violaceus; identical to SEQ ID NO: 4785

SEQ ID NO: 12427 - DNA, 1491 bp, Chromobacterium violaceum; identical to SEQ ID NO: 4786
  CDS (1)..(1491)

SEQ ID NO: 12428 - protein, 496 aa, Chromobacterium violaceum; identical to SEQ ID NO: 4787

SEQ ID NO: 12429 - DNA, 1965 bp, Chromobacterium violaceum; identical to SEQ ID NO: 4788
  CDS (1)..(1965)

SEQ ID NO: 12430 - protein, 654 aa, Chromobacterium violaceum; identical to SEQ ID NO: 4789

SEQ ID NO: 12431 - DNA, 1998 bp, Rickettsia sibirica; identical to SEQ ID NO: 4790
  CDS (1)..(1998)

SEQ ID NO: 12432 - protein, 665 aa, Rickettsia sibirica; identical to SEQ ID NO: 4791

SEQ ID NO: 12433 - DNA, 1164 bp, Anopheles gambiae str; identical to SEQ ID NO: 4792
  CDS (1)..(1164)

SEQ ID NO: 12434 - protein, 387 aa, Anopheles gambiae str; identical to SEQ ID NO: 4793

SEQ ID NO: 12435 - DNA, 8736 bp, Plasmodium yoelii yoelii; identical to SEQ ID NO: 4794
  CDS (1)..(8736): m means a or c

SEQ ID NO: 12436 - protein, 2911 aa, Plasmodium yoelii yoelii; identical to SEQ ID NO: 4795
  misc_feature (1554)..(1554): Xaa can be Asp or Glu

SEQ ID NO: 12437 - DNA, 6828 bp, Neurospora crassa; identical to SEQ ID NO: 4796
  CDS (1)..(6828)

SEQ ID NO: 12438 - protein, 2275 aa, Neurospora crassa; identical to SEQ ID NO: 4797

SEQ ID NO: 12439 - DNA, 2232 bp, Neurospora crassa; identical to SEQ ID NO: 4798
  CDS (1)..(2232)

SEQ ID NO: 12440 - protein, 743 aa, Neurospora crassa; identical to SEQ ID NO: 4799

SEQ ID NO: 12441 - DNA, 1347 bp, Synechococcus sp; identical to SEQ ID NO: 4800
  CDS (1)..(1347)

SEQ ID NO: 12442 - protein, 448 aa, Synechococcus sp; identical to SEQ ID NO: 4801

SEQ ID NO: 12443 - DNA, 3501 bp, Rhodopirellula baltica; identical to SEQ ID NO: 4802
  CDS (1)..(3501)

SEQ ID NO: 12444 - protein, 1166 aa, Rhodopirellula baltica; identical to SEQ ID NO: 4803

SEQ ID NO: 12445 - DNA, 1353 bp, Rhodopirellula baltica; identical to SEQ ID NO: 4804
  CDS (1)..(1353)

SEQ ID NO: 12446 - protein, 450 aa, Rhodopirellula baltica; identical to SEQ ID NO: 4805

SEQ ID NO: 12447 - DNA, 1350 bp, Prochlorococcus marinus subsp; identical to SEQ ID NO: 4806
  CDS (1)..(1350)

SEQ ID NO: 12448 - protein, 449 aa, Prochlorococcus marinus subsp; identical to SEQ ID NO: 4807

SEQ ID NO: 12449 - DNA, 1347 bp, Prochlorococcus marinus; identical to SEQ ID NO: 4808
  CDS (1)..(1347)

SEQ ID NO: 12450 - protein, 448 aa, Prochlorococcus marinus; identical to SEQ ID NO: 4809

SEQ ID NO: 12451 - DNA, 1350 bp, Prochlorococcus marinus; identical to SEQ ID NO: 4810
  CDS (1)..(1350)

SEQ ID NO: 12452 - protein, 449 aa, Prochlorococcus marinus; identical to SEQ ID NO: 4811

SEQ ID NO: 12453 - DNA, 1425 bp, Helicobacter hepaticus; identical to SEQ ID NO: 4812
  CDS (1)..(1425)

SEQ ID NO: 12454 - protein, 474 aa, Helicobacter hepaticus; identical to SEQ ID NO: 4813

SEQ ID NO: 12455 - DNA, 1353 bp, Candidatus Blochmannia floridanus; identical to SEQ ID NO: 4814
  CDS (1)..(1353)

SEQ ID NO: 12456 - protein, 450 aa, Candidatus Blochmannia floridanus; identical to SEQ ID NO: 4815

SEQ ID NO: 12457 - DNA, 2022 bp, Bordetella parapertussis; identical to SEQ ID NO: 4816
  CDS (1)..(2022)

SEQ ID NO: 12458 - protein, 673 aa, Bordetella parapertussis; identical to SEQ ID NO: 4817

SEQ ID NO: 12459 - DNA, 1371 bp, Bordetella parapertussis; identical to SEQ ID NO: 4818
  CDS (1)..(1371)

SEQ ID NO: 12460 - protein, 456 aa, Bordetella parapertussis; identical to SEQ ID NO: 4819

SEQ ID NO: 12461 - DNA, 1365 bp, Bordetella bronchiseptica; identical to SEQ ID NO: 4820
  CDS (1)..(1365)

SEQ ID NO: 12462 - protein, 454 aa, Bordetella bronchiseptica; identical to SEQ ID NO: 4821

SEQ ID NO: 12463 - DNA, 1347 bp, Bordetella bronchiseptica; identical to SEQ ID NO: 4822
  CDS (1)..(1347)

SEQ ID NO: 12464 - protein, 448 aa, Bordetella bronchiseptica; identical to SEQ ID NO: 4823

SEQ ID NO: 12465 - DNA, 1365 bp, Bordetella bronchiseptica; identical to SEQ ID NO: 4824
  CDS (1)..(1365)

SEQ ID NO: 12466 - protein, 454 aa, Bordetella bronchiseptica; identical to SEQ ID NO: 4825

SEQ ID NO: 12467 - DNA, 3504 bp, Bordetella bronchiseptica; identical to SEQ ID NO: 4826
  CDS (1)..(3504)

SEQ ID NO: 12468 - protein, 1167 aa, Bordetella bronchiseptica; identical to SEQ ID NO: 4827

SEQ ID NO: 12469 - DNA, 7327 bp, Zea mays; identical to SEQ ID NO: 4828
  CDS (8)..(6985)

SEQ ID NO: 12470 - protein, 2325 aa, Zea mays; identical to SEQ ID NO: 4829

SEQ ID NO: 12471 - DNA, 7324 bp, Zea mays; identical to SEQ ID NO: 4830
  CDS (8)..(6982)

SEQ ID NO: 12472 - protein, 2324 aa, Zea mays; identical to SEQ ID NO: 4831

SEQ ID NO: 12473 - DNA, 3537 bp, Sus scrofa; identical to SEQ ID NO: 4832
  CDS (1)..(3537)

SEQ ID NO: 12474 - protein, 1178 aa, Sus scrofa; identical to SEQ ID NO: 4833

SEQ ID NO: 12475 - DNA, 7041 bp, Homo sapiens; identical to SEQ ID NO: 4834
  CDS (1)..(7041)

SEQ ID NO: 12476 - protein, 2346 aa, Homo sapiens [sequence omitted]

SEQ ID NO: 12477 - DNA, 2467 bp, Mus musculus; identical to SEQ ID NO: 4836
  CDS (6)..(2180)

SEQ ID NO: 12478 - protein, 724 aa, Mus musculus; identical to SEQ ID NO: 4837

SEQ ID NO: 12479 - DNA, 1323 bp, Bacillus cereus; identical to SEQ ID NO: 4838
  CDS (1)..(1323)

SEQ ID NO: 12480 - protein, 440 aa, Bacillus cereus; identical to SEQ ID NO: 4839

SEQ ID NO: 12481 - DNA, 3447 bp, Bacillus cereus; identical to SEQ ID NO: 4840
  CDS (1)..(3447)

SEQ ID NO: 12482 - protein, 1148 aa, Bacillus cereus; identical to SEQ ID NO: 4841

SEQ ID NO: 12483 - DNA, 1353 bp, Bacillus anthracis; identical to SEQ ID NO: 4842
  CDS (1)..(1353)

SEQ ID NO: 12484 - protein, 450 aa, Bacillus anthracis; identical to SEQ ID NO: 4843

SEQ ID NO: 12485 - DNA, 3447 bp, Bacillus anthracis; identical to SEQ ID NO: 4844
  CDS (1)..(3447)

SEQ ID NO: 12486 - protein, 1148 aa, Bacillus anthracis; identical to SEQ ID NO: 4845

SEQ ID NO: 12487 - DNA, 3636 bp, Nitrosomonas europaea; identical to SEQ ID NO: 4846
  CDS (1)..(3636)

SEQ ID NO: 12488 - protein, 1211 aa, Nitrosomonas europaea; identical to SEQ ID NO: 4847

SEQ ID NO: 12489 - DNA, 1356 bp, Chlamydophila caviae; identical to SEQ ID NO: 4848
  CDS (1)..(1356)

SEQ ID NO: 12490 - protein, 451 aa, Chlamydophila caviae; identical to SEQ ID NO: 4849

SEQ ID NO: 12491 - DNA, 3516 bp, Streptomyces avermitilis; identical to SEQ ID NO: 4850
  CDS (1)..(3516)

SEQ ID NO: 12492 - protein, 1171 aa, Streptomyces avermitilis; identical to SEQ ID NO: 4851

SEQ ID NO: 12493 - DNA, 2103 bp, Streptomyces avermitilis; identical to SEQ ID NO: 4852
  CDS (1)..(2103)

SEQ ID NO: 12494 - protein, 700 aa, Streptomyces avermitilis; identical to SEQ ID NO: 4853

SEQ ID NO: 12495 - DNA, 1851 bp, Streptomyces avermitilis; identical to SEQ ID NO: 4854
  CDS (1)..(1851)

SEQ ID NO: 12496 - protein, 616 aa, Streptomyces avermitilis; identical to SEQ ID NO: 4855

SEQ ID NO: 12497 - DNA, 1773 bp, Streptomyces avermitilis; identical to SEQ ID NO: 4856
  CDS (1)..(1773)

SEQ ID NO: 12498 - protein, 590 aa, Streptomyces avermitilis; identical to SEQ ID NO: 4857

SEQ ID NO: 12499 - DNA, 1359 bp, Nitrosomonas europaea; identical to SEQ ID NO: 4858
  CDS (1)..(1359)

SEQ ID NO: 12500 - protein, 452 aa, Nitrosomonas europaea; identical to SEQ ID NO: 4859

SEQ ID NO: 12501 - DNA, 1371 bp, Enterococcus faecalis; identical to SEQ ID NO: 4860
  CDS (1)..(1371)

SEQ ID NO: 12502 - protein, 456 aa, Enterococcus faecalis; identical to SEQ ID NO: 4861

SEQ ID NO: 12503 - DNA, 3492 bp, Enterococcus faecalis; identical to SEQ ID NO: 4862
  CDS (64)..(3492)

SEQ ID NO: 12504 - protein, 1142 aa, Enterococcus faecalis; identical to SEQ ID NO: 4863

SEQ ID NO: 12505 - DNA, 1347 bp, Coxiella burnetii; identical to SEQ ID NO: 4864
  CDS (1)..(1347)

SEQ ID NO: 12506 - protein, 448 aa, Coxiella burnetii; identical to SEQ ID NO: 4865

SEQ ID NO: 12507 - DNA, 1986 bp, Coxiella burnetii; identical to SEQ ID NO: 4866
  CDS (1)..(1986)

SEQ ID NO: 12508 - protein, 661 aa, Coxiella burnetii; identical to SEQ ID NO: 4867

SEQ ID NO: 12509 - DNA, 3396 bp, Tropheryma whipplei; identical to SEQ ID NO: 4868
  CDS (1)..(3396)

SEQ ID NO: 12510 - protein, 1131 aa, Tropheryma whipplei; identical to SEQ ID NO: 4869

SEQ ID NO: 12511 - DNA, 1776 bp, Tropheryma whipplei; identical to SEQ ID NO: 4870
  CDS (1)..(1776)

SEQ ID NO: 12512 - protein, 591 aa, Tropheryma whipplei; identical to SEQ ID NO: 4871

SEQ ID NO: 12513 - DNA, 2004 bp, Methylobacterium extorquens; identical to SEQ ID NO: 4872
  CDS (1)..(2004)

SEQ ID NO: 12514 - protein, 667 aa, Methylobacterium extorquens; identical to SEQ ID NO: 4873

SEQ ID NO: 12515 - DNA, 7446 bp, Setaria italica; identical to SEQ ID NO: 4874
  CDS (59)..(7024)

SEQ ID NO: 12516 - protein, 2321 aa, Setaria italica; identical to SEQ ID NO: 4875

SEQ ID NO: 12517 - DNA, 3994 bp, Bos taurus; identical to SEQ ID NO: 4876
  CDS (69)..(3605)

SEQ ID NO: 12518 - protein, 1178 aa, Bos taurus; identical to SEQ ID NO: 4877

SEQ ID NO: 12519 - DNA, 1530 bp, Acidianus brierleyi; identical to SEQ ID NO: 4878
  CDS (1)..(1530)

SEQ ID NO: 12520 - protein, 509 aa, Acidianus brierleyi; identical to SEQ ID NO: 4879

SEQ ID NO: 12521 - DNA, 1368 bp, Xylella fastidiosa; identical to SEQ ID NO: 4880
  CDS (1)..(1368)

SEQ ID NO: 12522 - protein, 455 aa, Xylella fastidiosa; identical to SEQ ID NO: 4881

SEQ ID NO: 12523 - DNA, 2115 bp, Vibrio parahaemolyticus; identical to SEQ ID NO: 4882
  CDS (1)..(2115)

SEQ ID NO: 12524 - protein, 704 aa, Vibrio parahaemolyticus; identical to SEQ ID NO: 4883

SEQ ID NO: 12525 - DNA, 1344 bp, Vibrio parahaemolyticus; identical to SEQ ID NO: 4884
  CDS (1)..(1344)

SEQ ID NO: 12526 - protein, 447 aa, Vibrio parahaemolyticus; identical to SEQ ID NO: 4885

SEQ ID NO: 12527 - DNA, 1416 bp, Pseudomonas syringae; identical to SEQ ID NO: 4886
  CDS (1)..(1416)

SEQ ID NO: 12528 - protein, 471 aa, Pseudomonas syringae; identical to SEQ ID NO: 4887

SEQ ID NO: 12529 - DNA, 1740 bp, Pseudomonas syringae; identical to SEQ ID NO: 4888
  CDS (1)..(1740)

SEQ ID NO: 12530 - protein, 579 aa, Pseudomonas syringae; identical to SEQ ID NO: 4889

SEQ ID NO: 12531 - DNA, 1344 bp, Pseudomonas syringae; identical to SEQ ID NO: 4890
  CDS (1)..(1344)

SEQ ID NO: 12532 - protein, 447 aa, Pseudomonas syringae; identical to SEQ ID NO: 4891

SEQ ID NO: 12533 - DNA, 3681 bp, Pseudomonas syringae; identical to SEQ ID NO: 4892
  CDS (1)..(3681)

SEQ ID NO: 12534 - protein, 1226 aa, Pseudomonas syringae; identical to SEQ ID NO: 4893

SEQ ID NO: 12535 - DNA, 1353 bp, Pseudomonas syringae; identical to SEQ ID NO: 4894
  CDS (1)..(1353)

SEQ ID NO: 12536 - protein, 450 aa, Pseudomonas syringae; identical to SEQ ID NO: 4895

SEQ ID NO: 12537 - DNA, 1950 bp, Pseudomonas syringae; identical to SEQ ID NO: 4896
  CDS (1)..(1950)

SEQ ID NO: 12538 - protein, 649 aa, Pseudomonas syringae; identical to SEQ ID NO: 4897

SEQ ID NO: 12539 - DNA, 1416 bp, Pseudomonas putida; identical to SEQ ID NO: 4898
  CDS (1)..(1416)

SEQ ID NO: 12540 - protein, 471 aa, Pseudomonas putida; identical to SEQ ID NO: 4899

SEQ ID NO: 12541 - DNA, 1953 bp, Pseudomonas putida; identical to SEQ ID NO: 4900
  CDS (1)..(1953)

SEQ ID NO: 12542 - protein, 650 aa, Pseudomonas putida; identical to SEQ ID NO: 4901

SEQ ID NO: 12543 - DNA, 1356 bp, Pseudomonas putida; identical to SEQ ID NO: 4902
  CDS (1)..(1356)

SEQ ID NO: 12544 - protein, 451 aa, Pseudomonas putida; identical to SEQ ID NO: 4903

SEQ ID NO: 12545 - DNA, 3435 bp, Lactobacillus plantarum; identical to SEQ ID NO: 4904
  CDS (1)..(3435)

SEQ ID NO: 12546 - protein, 1144 aa, Lactobacillus plantarum; identical to SEQ ID NO: 4905

SEQ ID NO: 12547 - DNA, 1389 bp, Lactobacillus plantarum; identical to SEQ ID NO: 4906
  CDS (1)..(1389)

SEQ ID NO: 12548 - protein, 462 aa, Lactobacillus plantarum; identical to SEQ ID NO: 4907

SEQ ID NO: 12549 - DNA, 1341 bp, Clostridium tetani; identical to SEQ ID NO: 4908
  CDS (1)..(1341)

SEQ ID NO: 12550 - protein, 446 aa, Clostridium tetani; identical to SEQ ID NO: 4909

SEQ ID NO: 12551 - DNA, 3318 bp, Bradyrhizobium japonicum; identical to SEQ ID NO: 4910
  CDS (1)..(3318)

SEQ ID NO: 12552 - protein, 1105 aa, Bradyrhizobium japonicum; identical to SEQ ID NO: 4911

SEQ ID NO: 12553 - DNA, 2016 bp, Bradyrhizobium japonicum; identical to SEQ ID NO: 4912
  CDS (1)..(2016)

SEQ ID NO: 12554 - protein, 671 aa, Bradyrhizobium japonicum; identical to SEQ ID NO: 4913

SEQ ID NO: 12555 - DNA, 2064 bp, Bradyrhizobium japonicum; identical to SEQ ID NO: 4914
  CDS (1)..(2064)

SEQ ID NO: 12556 - protein, 687 aa, Bradyrhizobium japonicum; identical to SEQ ID NO: 4915

SEQ ID NO: 12557 - DNA, 1359 bp, Bradyrhizobium japonicum; identical to SEQ ID NO: 4916
  CDS (1)..(1359)

SEQ ID NO: 12558 - protein, 452 aa, Bradyrhizobium japonicum; identical to SEQ ID NO: 4917

SEQ ID NO: 12559 - DNA, 1356 bp, Bradyrhizobium japonicum; identical to SEQ ID NO: 4918
  CDS (1)..(1356)

SEQ ID NO: 12560 - protein, 451 aa, Bradyrhizobium japonicum; identical to SEQ ID NO: 4919

SEQ ID NO: 12561 - DNA, 1977 bp, Bradyrhizobium japonicum; identical to SEQ ID NO: 4920
  CDS (1)..(1977)

SEQ ID NO: 12562 - protein, 658 aa, Bradyrhizobium japonicum; identical to SEQ ID NO: 4921

SEQ ID NO: 12563 - DNA, 1512 bp, Bacteroides thetaiotaomicron; identical to SEQ ID NO: 4922
  CDS (1)..(1512)

SEQ ID NO: 12564 - protein, 503 aa, Bacteroides thetaiotaomicron; identical to SEQ ID NO: 4923

SEQ ID NO: 12565 - DNA, 1512 bp, Bacteroides thetaiotaomicron; identical to SEQ ID NO: 4924
  CDS (1)..(1512)

SEQ ID NO: 12566 - protein, 503 aa, Bacteroides thetaiotaomicron; identical to SEQ ID NO: 4925

SEQ ID NO: 12567 - DNA, 2748 bp, Pagrus major; identical to SEQ ID NO: 4926
  CDS (188)..(2341): n means a or g or c or t/u

SEQ ID NO: 12568 - protein, 717 aa, Pagrus major; identical to SEQ ID NO: 4927

SEQ ID NO: 12569 - DNA, 4010 bp, Pagrus major; identical to SEQ ID NO: 4928
  CDS (389)..(3928): n means a or g or c or t/u

SEQ ID NO: 12570 - protein, 1179 aa, Pagrus major; identical to SEQ ID NO: 4929

SEQ ID NO: 12571 - DNA, 1359 bp, Staphylococcus epidermidis; identical to SEQ ID NO: 4930
  CDS (1)..(1359)

SEQ ID NO: 12572 - protein, 452 aa, Staphylococcus epidermidis; identical to SEQ ID NO: 4931

SEQ ID NO: 12573 - DNA, 1359 bp, Staphylococcus epidermidis; identical to SEQ ID NO: 4932
  CDS (1)..(1359)

SEQ ID NO: 12574 - protein, 452 aa, Staphylococcus epidermidis; identical to SEQ ID NO: 4933

SEQ ID NO: 12575 - DNA, 3465 bp, Staphylococcus epidermidis; identical to SEQ ID NO: 4934
  CDS (4)..(3465)

SEQ ID NO: 12576 - protein, 1153 aa, Staphylococcus epidermidis; identical to SEQ ID NO: 4935

SEQ ID NO: 12577 - DNA, 1338 bp, Wigglesworthia glossinidia brevipalpis; identical to SEQ ID NO: 4936
  CDS (1)..(1338)

SEQ ID NO: 12578 - protein, 445 aa, Wigglesworthia glossinidia brevipalpis; identical to SEQ ID NO: 4937

SEQ ID NO: 12579 - DNA, 1362 bp, Synechococcus elongatus; identical to SEQ ID NO: 4938
  CDS (1)..(1362)

SEQ ID NO: 12580 - protein, 453 aa, Synechococcus elongatus; identical to SEQ ID NO: 4939

SEQ ID NO: 12581 - DNA, 1371 bp, Streptococcus mutans; identical to SEQ ID NO: 4940
  CDS (1)..(1371)

SEQ ID NO: 12582 - protein, 456 aa, Streptococcus mutans; identical to SEQ ID NO: 4941

SEQ ID NO: 12583 - DNA, 1371 bp, Streptococcus agalactiae; identical to SEQ ID NO: 4942
  CDS (1)..(1371)

SEQ ID NO: 12584 - protein, 456 aa, Streptococcus agalactiae; identical to SEQ ID NO: 4943

SEQ ID NO: 12585 - DNA, 2085 bp, Shewanella oneidensis; identical to SEQ ID NO: 4944
  CDS (1)..(2085)

SEQ ID NO: 12586 - protein, 694 aa, Shewanella oneidensis; identical to SEQ ID NO: 4945

SEQ ID NO: 12587 - DNA, 4554 bp, Shewanella oneidensis; identical to SEQ ID NO: 4946
  CDS (1)..(4554)

SEQ ID NO: 12588 - protein, 1517 aa, Shewanella oneidensis; identical to SEQ ID NO: 4947

SEQ ID NO: 12589 - DNA, 1368 bp, Oceanobacillus iheyensis; identical to SEQ ID NO: 4948
  CDS (1)..(1368)

SEQ ID NO: 12590 - protein, 455 aa, Oceanobacillus iheyensis; identical to SEQ ID NO: 4949

SEQ ID NO: 12591 - DNA, 1341 bp, Oceanobacillus iheyensis; identical to SEQ ID NO: 4950
  CDS (1)..(1341)

SEQ ID NO: 12592 - protein, 446 aa, Oceanobacillus iheyensis; identical to SEQ ID NO: 4951

SEQ ID NO: 12593 - DNA, 3444 bp, Oceanobacillus iheyensis; identical to SEQ ID NO: 4952
  CDS (1)..(3444)

SEQ ID NO: 12594 - protein, 1147 aa, Oceanobacillus iheyensis; identical to SEQ ID NO: 4953

SEQ ID NO: 12595 - DNA, 1464 bp, Leptospira interrogans; identical to SEQ ID NO: 4954
  CDS (1)..(1464)

SEQ ID NO: 12596 - protein, 487 aa, Leptospira interrogans; identical to SEQ ID NO: 4955

SEQ ID NO: 12597 - DNA, 2381 bp, Corynebacterium efficiens; identical to SEQ ID NO: 4956
  CDS (982)..(2352)

SEQ ID NO: 12598 - protein, 456 aa, Corynebacterium efficiens; identical to SEQ ID NO: 4957

SEQ ID NO: 12599 - DNA, 3609 bp, Corynebacterium efficiens; identical to SEQ ID NO: 4958
  CDS (1)..(3609)

SEQ ID NO: 12600 - protein, 1202 aa, Corynebacterium efficiens; identical to SEQ ID NO: 4959

SEQ ID NO: 12601 - DNA, 3507 bp, Corynebacterium efficiens; identical to SEQ ID NO: 4960
  CDS (1)..(3507)

SEQ ID NO: 12602 - protein, 1168 aa, Corynebacterium efficiens; identical to SEQ ID NO: 4961

SEQ ID NO: 12603 - DNA, 3477 bp, Brucella suis; identical to SEQ ID NO: 4962
  CDS (1)..(3477)

SEQ ID NO: 12604 - protein, 1158 aa, Brucella suis; identical to SEQ ID NO: 4963

SEQ ID NO: 12605 - DNA, 2004 bp, Brucella suis; identical to SEQ ID NO: 4964
  CDS (1)..(2004)

SEQ ID NO: 12606 - protein, 667 aa, Brucella suis; identical to SEQ ID NO: 4965

SEQ ID NO: 12607 - DNA, 1359 bp, Brucella suis; identical to SEQ ID NO: 4966
  CDS (1)..(1359)

SEQ ID NO: 12608 - protein, 452 aa, Brucella suis; identical to SEQ ID NO: 4967

SEQ ID NO: 12609 - DNA, 1965 bp, Bifidobacterium longum; identical to SEQ ID NO: 4968
  CDS (1)..(1965)

SEQ ID NO: 12610 - protein, 654 aa, Bifidobacterium longum; identical to SEQ ID NO: 4969

SEQ ID NO: 12611 - DNA, 10011 bp, Plasmodium falciparum; identical to SEQ ID NO: 4970
  CDS (1)..(10011)

SEQ ID NO: 12612 - protein, 3336 aa, Plasmodium falciparum; identical to SEQ ID NO: 4971

SEQ ID NO: 12613 - DNA, 1533 bp, Metallosphaera sedula; identical to SEQ ID NO: 4972
  CDS (1)..(1533)

SEQ ID NO: 12614 - protein, 510 aa, Metallosphaera sedula; identical to SEQ ID NO: 4973

SEQ ID NO: 12615 - DNA, 3559 bp, Gallus gallus; identical to SEQ ID NO: 4974
  CDS (1)..(3537): s means g or c

SEQ ID NO: 12616 - protein, 1178 aa, Gallus gallus; identical to SEQ ID NO: 4975
  misc_feature (566)..(566): Xaa can be Ala or Pro

SEQ ID NO: 12617 - DNA, 1365 bp, Streptococcus pyogenes; identical to SEQ ID NO: 4976
  CDS (1)..(1365)

SEQ ID NO: 12618 - protein, 454 aa, Streptococcus pyogenes; identical to SEQ ID NO: 4977

SEQ ID NO: 12619 - DNA, 1344 bp, Chlorobium tepidum; identical to SEQ ID NO: 4978
  CDS (1)..(1344)

SEQ ID NO: 12620 - protein, 447 aa, Chlorobium tepidum; identical to SEQ ID NO: 4979

SEQ ID NO: 12621 - DNA, 7589 bp, Alopecurus myosuroides; identical to SEQ ID NO: 4980
  CDS (157)..(7119)

SEQ ID NO: 12622 - protein, 2320 aa, Alopecurus myosuroides; identical to SEQ ID NO: 4981

SEQ ID NO: 12623 - DNA, 4439 bp, Drosophila melanogaster; identical to SEQ ID NO: 4982
  CDS (417)..(4010)

SEQ ID NO: 12624 - protein, 1197 aa, Drosophila melanogaster; identical to SEQ ID NO: 4983

SEQ ID NO: 12625 - DNA, 1362 bp, Staphylococcus aureus; identical to SEQ ID NO: 4984
  CDS (1)..(1362)

SEQ ID NO: 12626 - protein, 453 aa, Staphylococcus aureus; identical to SEQ ID NO: 4985

SEQ ID NO: 12627 - DNA, 3453 bp, Staphylococcus aureus; identical to SEQ ID NO: 4986
  CDS (1)..(3453)

SEQ ID NO: 12628 - protein, 1150 aa, Staphylococcus aureus; identical to SEQ ID NO: 4987

SEQ ID NO: 12629 - DNA, 2028 bp, Xanthomonas campestris; identical to SEQ ID NO: 4988
  CDS (1)..(2028)

SEQ ID NO: 12630 - protein, 675 aa, Xanthomonas campestris; identical to SEQ ID NO: 4989

SEQ ID NO: 12631 - DNA, 3648 bp, Xanthomonas axonopodis; identical to SEQ ID NO: 4990
  CDS (1)..(3648)

SEQ ID NO: 12632 - protein, 1215 aa, Xanthomonas axonopodis; identical to SEQ ID NO: 4991

SEQ ID NO: 12633 - DNA, 2028 bp, Xanthomonas axonopodis; identical to SEQ ID NO: 4992
  CDS (1)..(2028)

SEQ ID NO: 12634 - protein, 675 aa, Xanthomonas axonopodis; identical to SEQ ID NO: 4993

SEQ ID NO: 12635 - DNA, 1494 bp, Methanosarcina mazei; identical to SEQ ID NO: 4994
  CDS (1)..(1494)

SEQ ID NO: 12636 - protein, 497 aa, Methanosarcina mazei; identical to SEQ ID NO: 4995

SEQ ID NO: 12637 - DNA, 1897 bp, Amycolatopsis mediterranei; identical to SEQ ID NO: 4996
  CDS (101)..(1897)

SEQ ID NO: 12638 - protein, 598 aa, Amycolatopsis mediterranei; identical to SEQ ID NO: 4997

SEQ ID NO: 12639 - DNA, 2381 bp, Corynebacterium efficiens; identical to SEQ ID NO: 4998
  CDS (577)..(2352)

SEQ ID NO: 12640 - protein, 591 aa, Corynebacterium efficiens; identical to SEQ ID NO: 4999

SEQ ID NO: 12641 - DNA, 7223 bp, Oryza sativa; identical to SEQ ID NO: 5000
  CDS (1)..(6804)

SEQ ID NO: 12642 - protein, 2267 aa, Oryza sativa; identical to SEQ ID NO: 5001

SEQ ID NO: 12643 - DNA, 1482 bp, Methanosarcina acetivorans; identical to SEQ ID NO: 5002
  CDS (1)..(1482)

SEQ ID NO: 12644 - protein, 493 aa, Methanosarcina acetivorans; identical to SEQ ID NO: 5003

SEQ ID NO: 12645 - DNA, 2511 bp, Homo sapiens; identical to SEQ ID NO: 5004
  CDS (47)..(2233)

SEQ ID NO: 12646 - protein, 728 aa, Homo sapiens; identical to SEQ ID NO: 5005

SEQ ID NO: 12647 - DNA, 4190 bp, Pichia angusta; identical to SEQ ID NO: 5006
  CDS (275)..(3802)

SEQ ID NO: 12648 - protein, 1175 aa, Pichia angusta; identical to SEQ ID NO: 5007

SEQ ID NO: 12649 - DNA, 1353 bp, Clostridium perfringens; identical to SEQ ID NO: 5008
  CDS (1)..(1353)

SEQ ID NO: 12650 - protein, 450 aa, Clostridium perfringens; identical to SEQ ID NO: 5009

SEQ ID NO: 12651 - DNA, 1368 bp, Ralstonia solanacearum; identical to SEQ ID NO: 5010
  CDS (1)..(1368)

SEQ ID NO: 12652 - protein, 455 aa, Ralstonia solanacearum; identical to SEQ ID NO: 5011

SEQ ID NO: 12653 - DNA, 1371 bp, Ralstonia solanacearum; identical to SEQ ID NO: 5012
  CDS (1)..(1371)

SEQ ID NO: 12654 - protein, 456 aa, Ralstonia solanacearum; identical to SEQ ID NO: 5013

SEQ ID NO: 12655 - DNA, 2139 bp, Ralstonia solanacearum; identical to SEQ ID NO: 5014
  CDS (1)..(2139)

SEQ ID NO: 12656 - protein, 712 aa, Ralstonia solanacearum; identical to SEQ ID NO: 5015

SEQ ID NO: 12657 - DNA, 3459 bp, Rhizobium meliloti; identical to SEQ ID NO: 5016
  CDS (1)..(3459)

SEQ ID NO: 12658 - protein, 1152 aa, Rhizobium meliloti; identical to SEQ ID NO: 5017

SEQ ID NO: 12659 - DNA, 1350 bp, Rhizobium meliloti; identical to SEQ ID NO: 5018
  CDS (1)..(1350)

SEQ ID NO: 12660 - protein, 449 aa, Rhizobium meliloti; identical to SEQ ID NO: 5019

SEQ ID NO: 12661 - DNA, 1677 bp, Brassica napus; identical to SEQ ID NO: 5020
  CDS (34)..(1641)

SEQ ID NO: 12662 - protein, 535 aa, Brassica napus; identical to SEQ ID NO: 5021

SEQ ID NO: 12663 - DNA, 1542 bp, Sulfolobus tokodaii; identical to SEQ ID NO: 5022
  CDS (1)..(1542)

SEQ ID NO: 12664 - protein, 513 aa, Sulfolobus tokodaii; identical to SEQ ID NO: 5023

SEQ ID NO: 12665 - DNA, 2085 bp, Rhizobium loti; identical to SEQ ID NO: 5024
  CDS (1)..(2085)

SEQ ID NO: 12666 - protein, 694 aa, Rhizobium loti; identical to SEQ ID NO: 5025

SEQ ID NO: 12667 - DNA, 1962 bp, Rhizobium loti; identical to SEQ ID NO: 5026
  CDS (1)..(1962)

SEQ ID NO: 12668 - protein, 653 aa, Rhizobium loti; identical to SEQ ID NO: 5027

SEQ ID NO: 12669 - DNA, 3459 bp, Rhizobium loti; identical to SEQ ID NO: 5028
  CDS (1)..(3459)

SEQ ID NO: 12670 - protein, 1152 aa, Rhizobium loti; identical to SEQ ID NO: 5029

SEQ ID NO: 12671 - DNA, 2013 bp, Rhizobium loti; identical to SEQ ID NO: 5030
  CDS (1)..(2013)

SEQ ID NO: 12672 - protein, 670 aa, Rhizobium loti; identical to SEQ ID NO: 5031

SEQ ID NO: 12673 - DNA, 1347 bp, Pasteurella multocida; identical to SEQ ID NO: 5032
  CDS (1)..(1347)

SEQ ID NO: 12674 - protein, 448 aa, Pasteurella multocida; identical to SEQ ID NO: 5033

SEQ ID NO: 12675 - DNA, 4000 bp, Brachydanio rerio; identical to SEQ ID NO: 5034
  CDS (25)..(3567)

SEQ ID NO: 12676 - protein, 1180 aa, Brachydanio rerio; identical to SEQ ID NO: 5035

SEQ ID NO: 12677 - DNA, 1386 bp, Streptomyces sp; identical to SEQ ID NO: 5036
  CDS (1)..(1386)

SEQ ID NO: 12678 - protein, 461 aa, Streptomyces sp; identical to SEQ ID NO: 5037

SEQ ID NO: 12679 - DNA, 1344 bp, Gamma; identical to SEQ ID NO: 5038
  CDS (1)..(1344)

SEQ ID NO: 12680 - protein, 447 aa, Gamma; identical to SEQ ID NO: 5039

SEQ ID NO: 12681 - DNA, 4218 bp, Mycobacterium smegmatis; identical to SEQ ID NO: 5040
  CDS (600)..(3983)

SEQ ID NO: 12682 - protein, 1127 aa, Mycobacterium smegmatis; identical to SEQ ID NO: 5041

SEQ ID NO: 12683 - DNA, 1722 bp, Myxococcus xanthus; identical to SEQ ID NO: 5042
  CDS (1)..(1722)

SEQ ID NO: 12684 - protein, 573 aa, Myxococcus xanthus; identical to SEQ ID NO: 5043

SEQ ID NO: 12685 - DNA, 6966 bp, Brassica napus; identical to SEQ ID NO: 5044
  CDS (1)..(6966)

SEQ ID NO: 12686 - protein, 2321 aa, Brassica napus; identical to SEQ ID NO: 5045

SEQ ID NO: 12687 - DNA, 7128 bp, Arabidopsis thaliana; identical to SEQ ID NO: 5046
  CDS (1)..(7128)

SEQ ID NO: 12688 - protein, 2375 aa, Arabidopsis thaliana; identical to SEQ ID NO: 5047

SEQ ID NO: 12689 - DNA, 3579 bp, Aspergillus niger; identical to SEQ ID NO: 5048
  CDS (1)..(3579)

SEQ ID NO: 12690 - protein, 1192 aa, Aspergillus niger; identical to SEQ ID NO: 5049

SEQ ID NO: 12691 - DNA, 1482 bp, Methanosarcina barkeri; identical to SEQ ID NO: 5050
  CDS (1)..(1482)

SEQ ID NO: 12692 - protein, 493 aa, Methanosarcina barkeri; identical to SEQ ID NO: 5051

SEQ ID NO: 12693 - DNA, 1845 bp, Streptomyces coelicolor; identical to SEQ ID NO: 5052
  CDS (1)..(1845)

SEQ ID NO: 12694 - protein, 614 aa, Streptomyces coelicolor; identical to SEQ ID NO: 5053

SEQ ID NO: 12695 - DNA, 1941 bp, Streptomyces coelicolor; identical to SEQ ID NO: 5054
  CDS (1)..(1941)

SEQ ID NO: 12696 - protein, 646 aa, Streptomyces coelicolor; identical to SEQ ID NO: 5055

SEQ ID NO: 12697 - DNA, 1293 bp, Bacillus subtilis; identical to SEQ ID NO: 5056
  CDS (1)..(1293)

SEQ ID NO: 12698 - protein, 430 aa, Bacillus subtilis; identical to SEQ ID NO: 5057

SEQ ID NO: 12699 - DNA, 1323 bp, Lactobacillus plantarum; identical to SEQ ID NO: 5058
  CDS (1)..(1323)

SEQ ID NO: 12700 - protein, 440 aa, Lactobacillus plantarum; identical to SEQ ID NO: 5059

SEQ ID NO: 12701 - DNA, 1620 bp, Glycine max; identical to SEQ ID NO: 5060
  CDS (1)..(1620)

SEQ ID NO: 12702 - protein, 539 aa, Glycine max; identical to SEQ ID NO: 5061

SEQ ID NO: 12703 - DNA, 3622 bp, Lactococcus lactis; identical to SEQ ID NO: 5062
  CDS (105)..(3518)

SEQ ID NO: 12704 - protein, 1137 aa, Lactococcus lactis; identical to SEQ ID NO: 5063

SEQ ID NO: 12705 - DNA, 3375 bp, Streptomyces coelicolor; identical to SEQ ID NO: 5064
  CDS (1)..(3375)

SEQ ID NO: 12706 - protein, 1124 aa, Streptomyces coelicolor; identical to SEQ ID NO: 5065

SEQ ID NO: 12707 - DNA, 8001 bp, Drosophila melanogaster; identical to SEQ ID NO: 5066
  CDS (177)..(7625)

SEQ ID NO: 12708 - protein, 2482 aa, Drosophila melanogaster; identical to SEQ ID NO: 5067

SEQ ID NO: 12709 - DNA, 2397 bp, Drosophila melanogaster; identical to SEQ ID NO: 5068
  CDS (74)..(2170)

SEQ ID NO: 12710 - protein, 698 aa, Drosophila melanogaster; identical to SEQ ID NO: 5069

SEQ ID NO: 12711 - DNA, 4311 bp, Pseudomonas fluorescens; identical to SEQ ID NO: 5070
  CDS (125)..(3766)

SEQ ID NO: 12712 - protein, 1213 aa, Pseudomonas fluorescens; identical to SEQ ID NO: 5071

SEQ ID NO: 12713 - DNA, 1755 bp, Streptomyces venezuelae; identical to SEQ ID NO: 5072
  CDS (1)..(1755)

SEQ ID NO: 12714 - protein, 584 aa, Streptomyces venezuelae; identical to SEQ ID NO: 5073

SEQ ID NO: 12715 - DNA, 4391 bp, Drosophila melanogaster; identical to SEQ ID NO: 5074
  CDS (417)..(3962)

SEQ ID NO: 12716 - protein, 1181 aa, Drosophila melanogaster; identical to SEQ ID NO: 5075

SEQ ID NO: 12717 - DNA, 9422 bp, Ovis aries; identical to SEQ ID NO: 5076
  CDS (320)..(7360)

SEQ ID NO: 12718 - protein, 2346 aa, Ovis aries; identical to SEQ ID NO: 5077

SEQ ID NO: 12719 - DNA, 7452 bp, Homo sapiens; identical to SEQ ID NO: 5078
  CDS (1)..(7452)

SEQ ID NO: 12720 - protein, 2483 aa, Homo sapiens; identical to SEQ ID NO: 5079

SEQ ID NO: 12721 - DNA, 2546 bp, Homo sapiens; identical to SEQ ID NO: 5080
  CDS (133)..(2310)

SEQ ID NO: 12722 - protein, 725 aa, Homo sapiens; identical to SEQ ID NO: 5081

SEQ ID NO: 12723 - DNA, 3953 bp, Homo sapiens; identical to SEQ ID NO: 5082
  CDS (39)..(3575)

SEQ ID NO: 12724 - protein, 1178 aa, Homo sapiens; identical to SEQ ID NO: 5083

SEQ ID NO: 12725 - DNA, 4456 bp, Pichia pastoris; identical to SEQ ID NO: 5084
  CDS (700)..(4269)

SEQ ID NO: 12726 - protein, 1189 aa, Pichia pastoris; identical to SEQ ID NO: 5085

SEQ ID NO: 12727 - DNA, 3945 bp, Rattus norvegicus; identical to SEQ ID NO: 5086
  CDS (35)..(3571)

SEQ ID NO: 12728 - protein, 1178 aa, Rattus norvegicus; identical to SEQ ID NO: 5087

SEQ ID NO: 12729 - DNA, 3858 bp, Xenopus laevis; identical to SEQ ID NO: 5088
  CDS (33)..(3566)

SEQ ID NO: 12730 - protein, 1177 aa, Xenopus laevis; identical to SEQ ID NO: 5089

SEQ ID NO: 12731 - DNA, 3468 bp, Agrobacterium vitis; identical to SEQ ID NO: 5090
  CDS (1)..(3468)

SEQ ID NO: 12732 - protein, 1155 aa, Agrobacterium vitis; identical to SEQ ID NO: 5091

SEQ ID NO: 12733 - DNA, 1341 bp, Geobacter sulfurreducens; identical to SEQ ID NO: 5092
  CDS (1)..(1341)

SEQ ID NO: 12734 - protein, 446 aa, Geobacter sulfurreducens; identical to SEQ ID NO: 5093

SEQ ID NO: 12735 - DNA, 3447 bp, Geobacter sulfurreducens; identical to SEQ ID NO: 5094
  CDS (1)..(3447)

SEQ ID NO: 12736 - protein, 1148 aa, Geobacter sulfurreducens; identical to SEQ ID NO: 5095

SEQ ID NO: 12737 - DNA, 7496 bp, Homo sapiens; identical to SEQ ID NO: 5096
  CDS (120)..(7496)

SEQ ID NO: 12738 - protein, 2458 aa, Homo sapiens [sequence omitted]

SEQ ID NO: 12739 - DNA, 2172 bp, Emericella nidulans; identical to SEQ ID NO: 5098
  CDS (1)..(2172)

SEQ ID NO: 12740 - protein, 723 aa, Emericella nidulans; identical to SEQ ID NO: 5099

SEQ ID NO: 12741 - DNA, 3384 bp, Mycobacterium paratuberculosis; identical to SEQ ID NO: 5100
  CDS (1)..(3384)

SEQ ID NO: 12742 - protein, 1127 aa, Mycobacterium paratuberculosis; identical to SEQ ID NO: 5101

SEQ ID NO: 12743 - DNA, 1992 bp, Mycobacterium paratuberculosis; identical to SEQ ID NO: 5102
  CDS (1)..(1992)

SEQ ID NO: 12744 - protein, 663 aa, Mycobacterium paratuberculosis; identical to SEQ ID NO: 5103

SEQ ID NO: 12745 - DNA, 2016 bp, Mycobacterium paratuberculosis; identical to SEQ ID NO: 5104
  CDS (1)..(2016)

SEQ ID NO: 12746 - protein, 671 aa, Mycobacterium paratuberculosis; identical to SEQ ID NO: 5105

SEQ ID NO: 12747 - DNA, 3228 bp, Mycobacterium paratuberculosis; identical to SEQ ID NO: 5106
  CDS (1)..(3228)

SEQ ID NO: 12748 - protein, 1075 aa, Mycobacterium paratuberculosis; identical to SEQ ID NO: 5107

SEQ ID NO: 12749 - DNA, 1824 bp, Mycobacterium paratuberculosis; identical to SEQ ID NO: 5108
  CDS (1)..(1824)

SEQ ID NO: 12750 - protein, 607 aa, Mycobacterium paratuberculosis; identical to SEQ ID NO: 5109

SEQ ID NO: 12751 - DNA, 1320 bp, Treponema denticola; identical to SEQ ID NO: 5110
  CDS (1)..(1320)

SEQ ID NO: 12752 - protein, 439 aa, Treponema denticola; identical to SEQ ID NO: 5111

SEQ ID NO: 12753 - DNA, 2076 bp, Wolbachia pipientis wMel; identical to SEQ ID NO: 5112
  CDS (1)..(2076)

SEQ ID NO: 12754 - protein, 691 aa, Wolbachia pipientis wMel; identical to SEQ ID NO: 5113

SEQ ID NO: 12755 - DNA, 1338 bp, Bacillus cereus; identical to SEQ ID NO: 5114
  CDS (1)..(1338)

SEQ ID NO: 12756 - protein, 445 aa, Bacillus cereus; identical to SEQ ID NO: 5115

SEQ ID NO: 12757 - DNA, 6696 bp, Ashbya gossypii; identical to SEQ ID NO: 5116
  CDS (1)..(6696)

SEQ ID NO: 12758 - protein, 2231 aa, Ashbya gossypii; identical to SEQ ID NO: 5117

SEQ ID NO: 12759 - DNA, 3516 bp, Ashbya gossypii; identical to SEQ ID NO: 5118
  CDS (1)..(3516)

SEQ ID NO: 12760 - protein, 1171 aa, Ashbya gossypii; identical to SEQ ID NO: 5119

SEQ ID NO: 12761 - DNA, 5460 bp, Ashbya gossypii; identical to SEQ ID NO: 5120
  CDS (1)..(5460)

SEQ ID NO: 12762 - protein, 1819 aa, Ashbya gossypii; identical to SEQ ID NO: 5121

SEQ ID NO: 12763 - DNA, 1347 bp, uncultured marine gamma proteobacterium EBAC20E09; identical to SEQ ID NO: 5122
  CDS (1)..(1347)

SEQ ID NO: 12764 - protein, 448 aa, uncultured marine gamma proteobacterium EBAC20E09; identical to SEQ ID NO: 5123

SEQ ID NO: 12765 - DNA, 1338 bp, Thermus thermophilus; identical to SEQ ID NO: 5124
  CDS (1)..(1338)

SEQ ID NO: 12766 - protein, 445 aa, Thermus thermophilus; identical to SEQ ID NO: 5125

SEQ ID NO: 12767 - DNA, 3678 bp, Desulfovibrio vulgaris; identical to SEQ ID NO: 5126
  CDS (1)..(3678)

SEQ ID NO: 12768 - protein, 1225 aa, Desulfovibrio vulgaris; identical to SEQ ID NO: 5127

SEQ ID NO: 12769 - DNA, 1416 bp, Desulfovibrio vulgaris; identical to SEQ ID NO: 5128
  CDS (1)..(1416)

SEQ ID NO: 12770 - protein, 471 aa, Desulfovibrio vulgaris; identical to SEQ ID NO: 5129

SEQ ID NO: 12771 - DNA, 3441 bp, Listeria monocytogenes str; identical to SEQ ID NO: 5130
  CDS (1)..(3441)

SEQ ID NO: 12772 - protein, 1146 aa, Listeria monocytogenes str; identical to SEQ ID NO: 5131

SEQ ID NO: 12773 - DNA, 3516 bp, Oleomonas sagaranensis; identical to SEQ ID NO: 5132
  CDS (1)..(3516)

SEQ ID NO: 12774 - protein, 1171 aa, Oleomonas sagaranensis; identical to SEQ ID NO: 5133

SEQ ID NO: 12775 - DNA, 2016 bp, Caenorhabditis elegans; identical to SEQ ID NO: 5134
  CDS (1)..(2016)

SEQ ID NO: 12776 - protein, 671 aa, Caenorhabditis elegans; identical to SEQ ID NO: 5135

SEQ ID NO: 12777 - DNA, 1350 bp, Bacillus amyloliquefaciens; identical to SEQ ID NO: 5136
  CDS (1)..(1350)

SEQ ID NO: 12778 - protein, 449 aa, Bacillus amyloliquefaciens; identical to SEQ ID NO: 5137

SEQ ID NO: 12779 - DNA, 3549 bp, Rhodopseudomonas palustris; identical to SEQ ID NO: 5138
  CDS (1)..(3549)

SEQ ID NO: 12780 - protein, 1182 aa, Rhodopseudomonas palustris; identical to SEQ ID NO: 5139

SEQ ID NO: 12781 - DNA, 3312 bp, Rhodopseudomonas palustris; identical to SEQ ID NO: 5140
  CDS (1)..(3312)

SEQ ID NO: 12782 - protein, 1103 aa, Rhodopseudomonas palustris; identical to SEQ ID NO: 5141

SEQ ID NO: 12783 - DNA, 1983 bp, Rhodopseudomonas palustris; identical to SEQ ID NO: 5142
  CDS (1)..(1983)

SEQ ID NO: 12784 - protein, 660 aa, Rhodopseudomonas palustris; identical to SEQ ID NO: 5143

SEQ ID NO: 12785 - DNA, 1353 bp, Rhodopseudomonas palustris; identical to SEQ ID NO: 5144
  CDS (1)..(1353)

SEQ ID NO: 12786 - protein, 450 aa, Rhodopseudomonas palustris; identical to SEQ ID NO: 5145

SEQ ID NO: 12787 - DNA, 2016 bp, Rhodopseudomonas palustris; identical to SEQ ID NO: 5146
  CDS (1)..(2016)

SEQ ID NO: 12788 - protein, 671 aa, Rhodopseudomonas palustris; identical to SEQ ID NO: 5147

SEQ ID NO: 12789 - DNA, 2016 bp, Rhodopseudomonas palustris; identical to SEQ ID NO: 5148
  CDS (1)..(2016)

SEQ ID NO: 12790 - protein, 671 aa, Rhodopseudomonas palustris; identical to SEQ ID NO: 5149

SEQ ID NO: 12791 - DNA, 3426 bp, Corynebacterium diphtheriae; identical to SEQ ID NO: 5150
  CDS (1)..(3426)

SEQ ID NO: 12792 - protein, 1141 aa, Corynebacterium diphtheriae; identical to SEQ ID NO: 5151

SEQ ID NO: 12793 - DNA, 1785 bp, Corynebacterium diphtheriae; identical to SEQ ID NO: 5152
  CDS (1)..(1785)

SEQ ID NO: 12794 - protein, 594 aa, Corynebacterium diphtheriae; identical to SEQ ID NO: 5153

SEQ ID NO: 12795 - DNA, 1479 bp, Bdellovibrio bacteriovorus; identical to SEQ ID NO: 5154
  CDS (1)..(1479)

SEQ ID NO: 12796 - protein, 492 aa, Bdellovibrio bacteriovorus; identical to SEQ ID NO: 5155

SEQ ID NO: 12797 - DNA, 1503 bp, Bdellovibrio bacteriovorus; identical to SEQ ID NO: 5156
  CDS (1)..(1503)

SEQ ID NO: 12798 - protein, 500 aa, Bdellovibrio bacteriovorus; identical to SEQ ID NO: 5157

SEQ ID NO: 12799 - DNA, 1362 bp, Parachlamydia sp; identical to SEQ ID NO: 5158
  CDS (1)..(1362)

SEQ ID NO: 12800 - protein, 453 aa, Parachlamydia sp; identical to SEQ ID NO: 5159

SEQ ID NO: 12801 - DNA, 1506 bp, Methanococcus maripaludis; identical to SEQ ID NO: 5160
  CDS (1)..(1506)

SEQ ID NO: 12802 - protein, 501 aa, Methanococcus maripaludis; identical to SEQ ID NO: 5161

SEQ ID NO: 12803 - DNA, 1719 bp, Streptomyces antibioticus; identical to SEQ ID NO: 5162
  CDS (1)..(1719)

SEQ ID NO: 12804 - protein, 572 aa, Streptomyces antibioticus; identical to SEQ ID NO: 5163

SEQ ID NO: 12805 - DNA, 1344 bp, Photobacterium profundum; identical to SEQ ID NO: 5164
  CDS (1)..(1344)

SEQ ID NO: 12806 - protein, 447 aa, Photobacterium profundum; identical to SEQ ID NO: 5165

SEQ ID NO: 12807 - DNA, 26 bp, Primer
ttatttttcctgaagaccgagttttt

SEQ ID NO: 12808 - DNA, 24 bp, Primer
atgctggataaaattgttattgcc

SEQ ID NO: 12809 - DNA, 1062 bp, Escherichia coli K12; identical to SEQ ID NO: 2732
  CDS (1)..(1062)

SEQ ID NO: 12810 - protein, 353 aa, Escherichia coli K12; identical to SEQ ID NO: 2733

SEQ ID NO: 12811 - DNA, 1444 bp, Pseudomonas fluorescens; identical to SEQ ID NO: 2734
  CDS (156)..(1214)

SEQ ID NO: 12812 - protein, 352 aa, Pseudomonas fluorescens; identical to SEQ ID NO: 2735

SEQ ID NO: 12813 - DNA, 1484 bp, Haemophilus influenzae; identical to SEQ ID NO: 2736
  CDS (278)..(1342)

SEQ ID NO: 12814 - protein, 354 aa, Haemophilus influenzae; identical to SEQ ID NO: 2737

SEQ ID NO: 12815 - DNA, 1131 bp, Thermus aquaticus; identical to SEQ ID NO: 2738
  CDS (62)..(1084)

SEQ ID NO: 12816 - protein, 340 aa, Thermus aquaticus; identical to SEQ ID NO: 2739

SEQ ID NO: 12817 - DNA, 1196 bp, Aquifex pyrophilus; identical to SEQ ID NO: 2740
  CDS (51)..(1097)

SEQ ID NO: 12818 - protein, 348 aa, Aquifex pyrophilus; identical to SEQ ID NO: 2741

SEQ ID NO: 12819 - DNA, 1023 bp, Rickettsia prowazekii; identical to SEQ ID NO: 2742
  CDS (1)..(1023)

SEQ ID NO: 12820 - protein, 340 aa, Rickettsia prowazekii; identical to SEQ ID NO: 2743

SEQ ID NO: 12821 - DNA, 1329 bp, Myxococcus xanthus; identical to SEQ ID NO: 2744
  CDS (201)..(1229)

SEQ ID NO: 12822 - protein, 342 aa, Myxococcus xanthus; identical to SEQ ID NO: 2745

SEQ ID NO: 12823 - DNA, 1394 bp, Legionella pneumophila; identical to SEQ ID NO: 2746
  CDS (166)..(1212)

SEQ ID NO: 12824 - protein, 348 aa, Legionella pneumophila; identical to SEQ ID NO: 2747

SEQ ID NO: 12825 - DNA, 1224 bp, Treponema pallidum subsp. pallidum (syphilis spirochete); identical to SEQ ID NO: 2748
  CDS (1)..(1224): k means g or t/u

SEQ ID NO: 12826 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 12827 - DNA, 1050 bp, Clostridium acetobutylicum; identical to SEQ ID NO: 2750
  CDS (1)..(1050)

SEQ ID NO: 12828 - protein, 349 aa, Clostridium acetobutylicum; identical to SEQ ID NO: 2751

SEQ ID NO: 12829 - DNA, 1047 bp, Listeria innocua; identical to SEQ ID NO: 2752
  CDS (1)..(1047)

SEQ ID NO: 12830 - protein, 348 aa, Listeria innocua; identical to SEQ ID NO: 2753

SEQ ID NO: 12831 - DNA, 1137 bp, Brucella melitensis; identical to SEQ ID NO: 2754
  CDS (1)..(1137)

SEQ ID NO: 12832 - protein, 378 aa, Brucella melitensis; identical to SEQ ID NO: 2755

SEQ ID NO: 12833 - DNA, 1062 bp, Salmonella enterica subsp. enterica serovar Typhi; identical to SEQ ID NO: 2756
  CDS (1)..(1062)

SEQ ID NO: 12834 - protein, 353 aa, Salmonella enterica subsp. enterica serovar Typhi; identical to SEQ ID NO: 2757

SEQ ID NO: 12835 - DNA, 1074 bp, Nostoc sp. PCC 7120; identical to SEQ ID NO: 2758
  CDS (1)..(1074)

SEQ ID NO: 12836 - protein, 357 aa, Nostoc sp. PCC 7120; identical to SEQ ID NO: 2759

SEQ ID NO: 12837 - DNA, 1044 bp, Xylella fastidiosa; identical to SEQ ID NO: 2760
  CDS (1)..(1044)

SEQ ID NO: 12838 - protein, 347 aa, Xylella fastidiosa; identical to SEQ ID NO: 2761

SEQ ID NO: 12839 - DNA, 1164 bp, Lactococcus lactis subsp. lactis; identical to SEQ ID NO: 2762
  CDS (1)..(1164)

SEQ ID NO: 12840 - protein, 387 aa, Lactococcus lactis subsp. lactis; identical to SEQ ID NO: 2763

SEQ ID NO: 12841 - DNA, 2025 bp, Borrelia burgdorferi (Lyme disease spirochete); identical to SEQ ID NO: 2764
  CDS (25)..(1122)

SEQ ID NO: 12842 - protein, 365 aa, Borrelia burgdorferi (Lyme disease spirochete); identical to SEQ ID NO: 2765

SEQ ID NO: 12843 - DNA, 1728 bp, Deinococcus radiodurans; identical to SEQ ID NO: 2766
  CDS (399)..(1490)

SEQ ID NO: 12844 - protein, 363 aa, Deinococcus radiodurans; identical to SEQ ID NO: 2767

SEQ ID NO: 12845 - DNA, 1071 bp, Caulobacter crescentus; identical to SEQ ID NO: 2768
  CDS (1)..(1071)

SEQ ID NO: 12846 - protein, 356 aa, Caulobacter crescentus; identical to SEQ ID NO: 2769

SEQ ID NO: 12847 - DNA, 1199 bp, Thermotoga maritima; identical to SEQ ID NO: 2770
  CDS (67)..(1137)

SEQ ID NO: 12848 - protein, 356 aa, Thermotoga maritima; identical to SEQ ID NO: 2771

SEQ ID NO: 12849 - DNA, 1662 bp, Arabidopsis thaliana (mouse-ear cress); identical to SEQ ID NO: 2772
  CDS (368)..(1498)

SEQ ID NO: 12850 - protein, 376 aa, Arabidopsis thaliana (mouse-ear cress); identical to SEQ ID NO: 2773

SEQ ID NO: 12851 - DNA, 1038 bp, Aquifex aeolicus; identical to SEQ ID NO: 2774
  CDS (1)..(1038)

SEQ ID NO: 12852 - protein, 345 aa, Aquifex aeolicus; identical to SEQ ID NO: 2775

SEQ ID NO: 12853 - DNA, 1062 bp, Chlamydophila pneumoniae, Chlamydia pneumoniae; identical to SEQ ID NO: 2776
  CDS (1)..(1062)

SEQ ID NO: 12854 - protein, 353 aa, Chlamydophila pneumoniae, Chlamydia pneumoniae; identical to SEQ ID NO: 2777

SEQ ID NO: 12855 - DNA, 1047 bp, Neisseria meningitidis; identical to SEQ ID NO: 2778
  CDS (1)..(1047)

SEQ ID NO: 12856 - protein, 348 aa, Neisseria meningitidis; identical to SEQ ID NO: 2779

SEQ ID NO: 12857 - DNA, 1032 bp, Campylobacter jejuni; identical to SEQ ID NO: 2780
  CDS (1)..(1032)

SEQ ID NO: 12858 - protein, 343 aa, Campylobacter jejuni; identical to SEQ ID NO: 2781

SEQ ID NO: 12859 - DNA, 1065 bp, Chlamydia muridarum, Chlamydia trachomatis MoPn; identical to SEQ ID NO: 2782
  CDS (1)..(1065)

SEQ ID NO: 12860 - protein, 354 aa, Chlamydia muridarum, Chlamydia trachomatis MoPn; identical to SEQ ID NO: 2783

SEQ ID NO: 12861 - DNA, 1050 bp, Bacillus halodurans; identical to SEQ ID NO: 2784
  CDS (1)..(1050)

SEQ ID NO: 12862 - protein, 349 aa, Bacillus halodurans; identical to SEQ ID NO: 2785

SEQ ID NO: 12863 - DNA, 1229 bp, Streptococcus pneumoniae; identical to SEQ ID NO: 2786
  CDS (26)..(1192)

SEQ ID NO: 12864 - protein, 388 aa, Streptococcus pneumoniae; identical to SEQ ID NO: 2787

SEQ ID NO: 12865 - DNA, 1251 bp, Agrobacterium tumefaciens; identical to SEQ ID NO: 2788
  CDS (1)..(1251)

SEQ ID NO: 12866 - protein, 416 aa, Agrobacterium tumefaciens; identical to SEQ ID NO: 2789

SEQ ID NO: 12867 - DNA, 1044 bp, Staphylococcus aureus; identical to SEQ ID NO: 2790
  CDS (1)..(1044)

SEQ ID NO: 12868 - protein, 347 aa, Staphylococcus aureus; identical to SEQ ID NO: 2791

SEQ ID NO: 12869 - DNA, 1506 bp, Acinetobacter calcoaceticus; identical to SEQ ID NO: 2792
  CDS (403)..(1452)

SEQ ID NO: 12870 - protein, 349 aa, Acinetobacter calcoaceticus; identical to SEQ ID NO: 2793

SEQ ID NO: 12871 - DNA, 1479 bp, Brucella abortus; identical to SEQ ID NO: 2794
  CDS (316)..(1398)

SEQ ID NO: 12872 - protein, 360 aa, Brucella abortus; identical to SEQ ID NO: 2795

SEQ ID NO: 12873 - DNA, 981 bp, Streptococcus pyogenes; identical to SEQ ID NO: 2796
  CDS (1)..(981)

SEQ ID NO: 12874 - protein, 326 aa, Streptococcus pyogenes; identical to SEQ ID NO: 2797

SEQ ID NO: 12875 - DNA, 1349 bp, Leptospira biflexa; identical to SEQ ID NO: 2798
  CDS (107)..(1270)

SEQ ID NO: 12876 - protein, 387 aa, Leptospira biflexa; identical to SEQ ID NO: 2799

SEQ ID NO: 12877 - DNA, 1762 bp, Xanthomonas campestris pv. campestris; identical to SEQ ID NO: 2800
  CDS (159)..(1190)

SEQ ID NO: 12878 - protein, 343 aa, Xanthomonas campestris pv. campestris; identical to SEQ ID NO: 2801

SEQ ID NO: 12879 - DNA, 1212 bp, Aeromonas salmonicida; identical to SEQ ID NO: 2802
  CDS (151)..(1212)

SEQ ID NO: 12880 - protein, 353 aa, Aeromonas salmonicida; identical to SEQ ID NO: 2803

SEQ ID NO: 12881 - DNA, 1433 bp, Azotobacter vinelandii; identical to SEQ ID NO: 2804
  CDS (311)..(1360)

SEQ ID NO: 12882 - protein, 349 aa, Azotobacter vinelandii; identical to SEQ ID NO: 2805

SEQ ID NO: 12883 - DNA, 1108 bp, Acetobacter polyoxogenes; identical to SEQ ID NO: 2806
  CDS (35)..(1081)

SEQ ID NO: 12884 - protein, 348 aa, Acetobacter polyoxogenes; identical to SEQ ID NO: 2807

SEQ ID NO: 12885 - DNA, 1230 bp, Neisseria gonorrhoeae; identical to SEQ ID NO: 2808
  CDS (133)..(1179)

SEQ ID NO: 12886 - protein, 348 aa, Neisseria gonorrhoeae; identical to SEQ ID NO: 2809

SEQ ID NO: 12887 - DNA, 1649 bp, Bacteroides fragilis; identical to SEQ ID NO: 2810
  CDS (351)..(1307)

SEQ ID NO: 12888 - protein, 318 aa, Bacteroides fragilis; identical to SEQ ID NO: 2811

SEQ ID NO: 12889 - DNA, 1349 bp, Methylobacillus sp; identical to SEQ ID NO: 2812
  CDS (293)..(1327)

SEQ ID NO: 12890 - protein, 344 aa, Methylobacillus sp; identical to SEQ ID NO: 2813

SEQ ID NO: 12891 - DNA, 1320 bp, Vibrio anguillarum; identical to SEQ ID NO: 2814
  CDS (166)..(1212)

SEQ ID NO: 12892 - protein, 348 aa, Vibrio anguillarum; identical to SEQ ID NO: 2815

SEQ ID NO: 12893 - DNA, 1394 bp, Anabaena variabilis; identical to SEQ ID NO: 2816
  CDS (125)..(1201)

SEQ ID NO: 12894 - protein, 358 aa, Anabaena variabilis; identical to SEQ ID NO: 2817

SEQ ID NO: 12895 - DNA, 1334 bp, Bacillus subtilis; identical to SEQ ID NO: 2818
  CDS (215)..(1258)

SEQ ID NO: 12896 - protein, 347 aa, Bacillus subtilis; identical to SEQ ID NO: 2819

SEQ ID NO: 12897 - DNA, 1348 bp, Proteus mirabilis; identical to SEQ ID NO: 2820
  CDS (151)..(1218)

SEQ ID NO: 12898 - protein, 355 aa, Proteus mirabilis; identical to SEQ ID NO: 2821

SEQ ID NO: 12899 - DNA, 1384 bp, Pseudomonas aeruginosa; identical to SEQ ID NO: 2822
  CDS (145)..(1185)

SEQ ID NO: 12900 - protein, 346 aa, Pseudomonas aeruginosa; identical to SEQ ID NO: 2823

SEQ ID NO: 12901 - DNA, 1352 bp, Pseudomonas cepacia; identical to SEQ ID NO: 2824
  CDS (223)..(1266)

SEQ ID NO: 12902 - protein, 347 aa, Pseudomonas cepacia; identical to SEQ ID NO: 2825

SEQ ID NO: 12903 - DNA, 1047 bp, Synechococcus sp; identical to SEQ ID NO: 2826
  CDS (1)..(1047)

SEQ ID NO: 12904 - protein, 348 aa, Synechococcus sp; identical to SEQ ID NO: 2827

SEQ ID NO: 12905 - DNA, 1190 bp, Aquaspirillum magnetotacticum; identical to SEQ ID NO: 2828
  CDS (112)..(1146)

SEQ ID NO: 12906 - protein, 344 aa, Aquaspirillum magnetotacticum; identical to SEQ ID NO: 2829

SEQ ID NO: 12907 - DNA, 1841 bp, Rhizobium leguminosarum bv. viciae; identical to SEQ ID NO: 2830
  CDS (32)..(1087)

SEQ ID NO: 12908 - protein, 351 aa, Rhizobium leguminosarum bv. viciae; identical to SEQ ID NO: 2831

SEQ ID NO: 12909 - DNA, 1047 bp, Rhizobium meliloti; identical to SEQ ID NO: 2832
  CDS (1)..(1047)

SEQ ID NO: 12910 - protein, 348 aa, Rhizobium meliloti; identical to SEQ ID NO: 2833

SEQ ID NO: 12911 - DNA, 2762 bp, Mycobacterium tuberculosis; identical to SEQ ID NO: 2834
  CDS (311)..(2683)

SEQ ID NO: 12912 - protein, 790 aa, Mycobacterium tuberculosis; identical to SEQ ID NO: 2835

SEQ ID NO: 12913 - DNA, 1249 bp, Methylomonas clara; identical to SEQ ID NO: 2836
  CDS (123)..(1151)

SEQ ID NO: 12914 - protein, 342 aa, Methylomonas clara; identical to SEQ ID NO: 2837

SEQ ID NO: 12915 - DNA, 1065 bp, Enterobacter agglomerans; identical to SEQ ID NO: 2838
  CDS (1)..(1065)

SEQ ID NO: 12916 - protein, 354 aa, Enterobacter agglomerans; identical to SEQ ID NO: 2839

SEQ ID NO: 12917 - DNA, 1125 bp, Streptomyces lividans; identical to SEQ ID NO: 2840
  CDS (1)..(1125)

SEQ ID NO: 12918 - protein, 374 aa, Streptomyces lividans; identical to SEQ ID NO: 2841

SEQ ID NO: 12919 - DNA, 1347 bp, Rhodobacter sphaeroides; identical to SEQ ID NO: 2842
  CDS (220)..(1251)

SEQ ID NO: 12920 - protein, 343 aa, Rhodobacter sphaeroides; identical to SEQ ID NO: 2843

SEQ ID NO: 12921 - DNA, 1065 bp, Vibrio cholerae; identical to SEQ ID NO: 2844
  CDS (1)..(1065)

SEQ ID NO: 12922 - protein, 354 aa, Vibrio cholerae; identical to SEQ ID NO: 2845

SEQ ID NO: 12923 - DNA, 1068 bp, Rhodobacter capsulatus; identical to SEQ ID NO: 2846
  CDS (1)..(1068)

SEQ ID NO: 12924 - protein, 355 aa, Rhodobacter capsulatus; identical to SEQ ID NO: 2847

SEQ ID NO: 12925 - DNA, 1533 bp, Helicobacter pylori; identical to SEQ ID NO: 2848
  CDS (275)..(1318)

SEQ ID NO: 12926 - protein, 347 aa, Helicobacter pylori; identical to SEQ ID NO: 2849

SEQ ID NO: 12927 - DNA, 1065 bp, Synechocystis sp; identical to SEQ ID NO: 2850
  CDS (1)..(1065)

SEQ ID NO: 12928 - protein, 354 aa, Synechocystis sp; identical to SEQ ID NO: 2851

SEQ ID NO: 12929 - DNA, 1351 bp, Arabidopsis thaliana (mouse-ear cress); identical to SEQ ID NO: 2852
  CDS (1)..(1320)

SEQ ID NO: 12930 - protein, 439 aa, Arabidopsis thaliana (mouse-ear cress); identical to SEQ ID NO: 2853

SEQ ID NO: 12931 - DNA, 1392 bp, Pseudomonas putida; identical to SEQ ID NO: 2854
  CDS (111)..(1178)

SEQ ID NO: 12932 - protein, 355 aa, Pseudomonas putida; identical to SEQ ID NO: 2855

SEQ ID NO: 12933 - DNA, 1053 bp, Mycobacterium tuberculosis; identical to SEQ ID NO: 2856
  CDS (1)..(1053)

SEQ ID NO: 12934 - protein, 350 aa, Mycobacterium tuberculosis; identical to SEQ ID NO: 2857

SEQ ID NO: 12935 - DNA, 1053 bp, Wolinella succinogenes; identical to SEQ ID NO: 2858
  CDS (1)..(1053)

SEQ ID NO: 12936 - protein, 350 aa, Wolinella succinogenes; identical to SEQ ID NO: 2859

SEQ ID NO: 12937 - DNA, 1110 bp, Vibrio vulnificus; identical to SEQ ID NO: 2860
  CDS (1)..(1110)

SEQ ID NO: 12938 - protein, 369 aa, Vibrio vulnificus; identical to SEQ ID NO: 2861

SEQ ID NO: 12939 - DNA, 1068 bp, Photorhabdus luminescens; identical to SEQ ID NO: 2862
  CDS (1)..(1068)

SEQ ID NO: 12940 - protein, 355 aa, Photorhabdus luminescens; identical to SEQ ID NO: 2863

SEQ ID NO: 12941 - DNA, 1110 bp, Gloeobacter violaceus; identical to SEQ ID NO: 2864
  CDS (1)..(1110)

SEQ ID NO: 12942 - protein, 369 aa, Gloeobacter violaceus; identical to SEQ ID NO: 2865

SEQ ID NO: 12943 - DNA, 1053 bp, Chromobacterium violaceum; identical to SEQ ID NO: 2866
  CDS (1)..(1053)

SEQ ID NO: 12944 - protein, 350 aa, Chromobacterium violaceum; identical to SEQ ID NO: 2867

SEQ ID NO: 12945 - DNA, 1128 bp, Synechococcus sp; identical to SEQ ID NO: 2868
  CDS (1)..(1128)

SEQ ID NO: 12946 - protein, 375 aa, Synechococcus sp; identical to SEQ ID NO: 2869

SEQ ID NO: 12947 - DNA, 1128 bp, Rhodopirellula baltica; identical to SEQ ID NO: 2870
  CDS (1)..(1128)

SEQ ID NO: 12948 - protein, 375 aa, Rhodopirellula baltica; identical to SEQ ID NO: 2871

SEQ ID NO: 12949 - DNA, 1113 bp, Prochlorococcus marinus subsp; identical to SEQ ID NO: 2872
  CDS (1)..(1113)

SEQ ID NO: 12950 - protein, 370 aa, Prochlorococcus marinus subsp; identical to SEQ ID NO: 2873

SEQ ID NO: 12951 - DNA, 1140 bp, Prochlorococcus marinus; identical to SEQ ID NO: 2874
  CDS (1)..(1140)

SEQ ID NO: 12952 - protein, 379 aa, Prochlorococcus marinus; identical to SEQ ID NO: 2875

SEQ ID NO: 12953 - DNA, 1140 bp, Prochlorococcus marinus; identical to SEQ ID NO: 2876
  CDS (1)..(1140)

SEQ ID NO: 12954 - protein, 379 aa, Prochlorococcus marinus; identical to SEQ ID NO: 2877

SEQ ID NO: 12955 - DNA, 1038 bp, Helicobacter hepaticus; identical to SEQ ID NO: 2878
  CDS (1)..(1038)

SEQ ID NO: 12956 - protein, 345 aa, Helicobacter hepaticus; identical to SEQ ID NO: 2879

SEQ ID NO: 12957 - DNA, 1119 bp, Haemophilus ducreyi; identical to SEQ ID NO: 2880
  CDS (1)..(1119)

SEQ ID NO: 12958 - protein, 372 aa, Haemophilus ducreyi; identical to SEQ ID NO: 2881

SEQ ID NO: 12959 - DNA, 1048 bp, Campylobacter lari; identical to SEQ ID NO: 2882
  CDS (9)..(1043)

SEQ ID NO: 12960 - protein, 344 aa, Campylobacter lari; identical to SEQ ID NO: 2883

SEQ ID NO: 12961 - DNA, 1077 bp, Burkholderia fungorum; identical to SEQ ID NO: 2884
  CDS (1)..(1077)

SEQ ID NO: 12962 - protein, 358 aa, Burkholderia fungorum; identical to SEQ ID NO: 2885

SEQ ID NO: 12963 - DNA, 963 bp, Mycobacteriophage CJW1; identical to SEQ ID NO: 2886
  CDS (1)..(963)

SEQ ID NO: 12964 - protein, 320 aa, Mycobacteriophage CJW1; identical to SEQ ID NO: 2887

SEQ ID NO: 12965 - DNA, 1563 bp, Zymomonas mobilis; identical to SEQ ID NO: 2888
  CDS (231)..(1250)

SEQ ID NO: 12966 - protein, 339 aa, Zymomonas mobilis; identical to SEQ ID NO: 2889

SEQ ID NO: 12967 - DNA, 1038 bp, Bacillus megaterium; identical to SEQ ID NO: 2890
  CDS (1)..(1038)

SEQ ID NO: 12968 - protein, 345 aa, Bacillus megaterium; identical to SEQ ID NO: 2891

SEQ ID NO: 12969 - DNA, 1038 bp, Bacillus megaterium; identical to SEQ ID NO: 2892
  CDS (1)..(1038)

SEQ ID NO: 12970 - protein, 345 aa, Bacillus megaterium; identical to SEQ ID NO: 2893

SEQ ID NO: 12971 - DNA, 1044 bp, Bacillus amyloliquefaciens; identical to SEQ ID NO: 2894
  CDS (1)..(1044)

SEQ ID NO: 12972 - protein, 347 aa, Bacillus amyloliquefaciens; identical to SEQ ID NO: 2895

SEQ ID NO: 12973 - DNA, 1047 bp, Listeria monocytogenes; identical to SEQ ID NO: 2896
  CDS (1)..(1047): m means a or c

SEQ ID NO: 12974 - protein, 348 aa, Listeria monocytogenes; identical to SEQ ID NO: 2897
  misc_feature (228)..(228): Xaa can be Pro or Gln

SEQ ID NO: 12975 - DNA, 1035 bp, Oryza sativa; identical to SEQ ID NO: 2898
  CDS (1)..(1035)

SEQ ID NO: 12976 - protein, 344 aa, Oryza sativa; identical to SEQ ID NO: 2899

SEQ ID NO: 12977 - DNA, 1035 bp, Campylobacter lari; identical to SEQ ID NO: 2900
  CDS (1)..(1035)

SEQ ID NO: 12978 - protein, 344 aa, Campylobacter lari; identical to SEQ ID NO: 2901

SEQ ID NO: 12979 - DNA, 2035 bp, Borrelia hermsii; identical to SEQ ID NO: 2902
  CDS (256)..(1326)

SEQ ID NO: 12980 - protein, 356 aa, Borrelia hermsii; identical to SEQ ID NO: 2903

SEQ ID NO: 12981 - DNA, 1487 bp, Chlamydomonas reinhardtii; identical to SEQ ID NO: 2904
  CDS (121)..(1365)

SEQ ID NO: 12982 - protein, 414 aa, Chlamydomonas reinhardtii; identical to SEQ ID NO: 2905

SEQ ID NO: 12983 - DNA, 1669 bp, Streptococcus suis; identical to SEQ ID NO: 2906
  CDS (469)..(1500)

SEQ ID NO: 12984 - protein, 343 aa, Streptococcus suis; identical to SEQ ID NO: 2907

SEQ ID NO: 12985 - DNA, 1439 bp, Peanut witches; identical to SEQ ID NO: 2908
  CDS (218)..(1228)

SEQ ID NO: 12986 - protein, 336 aa, Peanut witches; identical to SEQ ID NO: 2909

SEQ ID NO: 12987 - DNA, 1377 bp, Myxococcus xanthus; identical to SEQ ID NO: 2910
  CDS (201)..(1277)

SEQ ID NO: 12988 - protein, 358 aa, Myxococcus xanthus; identical to SEQ ID NO: 2911

SEQ ID NO: 12989 - DNA, 1404 bp, Acidiphilium facilis; identical to SEQ ID NO: 2912
  CDS (187)..(1251)

SEQ ID NO: 12990 - protein, 354 aa, Acidiphilium facilis; identical to SEQ ID NO: 2913

SEQ ID NO: 12991 - DNA, 1059 bp, Actinobacillus actinomycetemcomitans; identical to SEQ ID NO: 2914
  CDS (1)..(1059)

SEQ ID NO: 12992 - protein, 352 aa, Actinobacillus actinomycetemcomitans; identical to SEQ ID NO: 2915

SEQ ID NO: 12993 - DNA, 1565 bp, Alcaligenes eutrophus; identical to SEQ ID NO: 2916
  CDS (194)..(1255)

SEQ ID NO: 12994 - protein, 353 aa, Alcaligenes eutrophus; identical to SEQ ID NO: 2917

SEQ ID NO: 12995 - DNA, 1047 bp, Amycolatopsis mediterranei; identical to SEQ ID NO: 2918
  CDS (1)..(1047)

SEQ ID NO: 12996 - protein, 348 aa, Amycolatopsis mediterranei; identical to SEQ ID NO: 2919

SEQ ID NO: 12997 - DNA, 1035 bp, Bacteroides thetaiotaomicron; identical to SEQ ID NO: 2920
  CDS (1)..(1035)

SEQ ID NO: 12998 - protein, 344 aa, Bacteroides thetaiotaomicron; identical to SEQ ID NO: 2921

SEQ ID NO: 12999 - DNA, 1194 bp, Bifidobacterium longum; identical to SEQ ID NO: 2922
  CDS (1)..(1194)

SEQ ID NO: 13000 - protein, 397 aa, Bifidobacterium longum; identical to SEQ ID NO: 2923

SEQ ID NO: 13001 - DNA, 1062 bp, Bordetella pertussis; identical to SEQ ID NO: 2924
  CDS (1)..(1062)

SEQ ID NO: 13002 - protein, 353 aa, Bordetella pertussis; identical to SEQ ID NO: 2925

SEQ ID NO: 13003 - DNA, 1089 bp, Bradyrhizobium japonicum; identical to SEQ ID NO: 2926
  CDS (1)..(1089)

SEQ ID NO: 13004 - protein, 362 aa, Bradyrhizobium japonicum; identical to SEQ ID NO: 2927

SEQ ID NO: 13005 - DNA, 2058 bp, Campylobacter fetus; identical to SEQ ID NO: 2928
  CDS (401)..(1438)

SEQ ID NO: 13006 - protein, 345 aa, Campylobacter fetus; identical to SEQ ID NO: 2929

SEQ ID NO: 13007 - DNA, 1458 bp, Chloroflexus aurantiacus; identical to SEQ ID NO: 2930
  CDS (116)..(1171)

SEQ ID NO: 13008 - protein, 351 aa, Chloroflexus aurantiacus; identical to SEQ ID NO: 2931

SEQ ID NO: 13009 - DNA, 1053 bp, Chlamydophila caviae; identical to SEQ ID NO: 2932
  CDS (1)..(1053)

SEQ ID NO: 13010 - protein, 350 aa, Chlamydophila caviae; identical to SEQ ID NO: 2933

SEQ ID NO: 13011 - DNA, 1087 bp, Chromatium vinosum; identical to SEQ ID NO: 2934
  CDS (1)..(1044)

SEQ ID NO: 13012 - protein, 347 aa, Chromatium vinosum; identical to SEQ ID NO: 2935

SEQ ID NO: 13013 - DNA, 1346 bp, Clostridium perfringens; identical to SEQ ID NO: 2936
  CDS (172)..(1230)

SEQ ID NO: 13014 - protein, 352 aa, Clostridium perfringens; identical to SEQ ID NO: 2937

SEQ ID NO: 13015 - DNA, 1053 bp, Clostridium tetani; identical to SEQ ID NO: 2938
  CDS (1)..(1053)

SEQ ID NO: 13016 - protein, 350 aa, Clostridium tetani; identical to SEQ ID NO: 2939

SEQ ID NO: 13017 - DNA, 1161 bp, Corynebacterium efficiens; identical to SEQ ID NO: 2940
  CDS (1)..(1161)

SEQ ID NO: 13018 - protein, 386 aa, Corynebacterium efficiens; identical to SEQ ID NO: 2941

SEQ ID NO: 13019 - DNA, 1402 bp, Corynebacterium glutamicum; identical to SEQ ID NO: 2942
  CDS (133)..(1263)

SEQ ID NO: 13020 - protein, 376 aa, Corynebacterium glutamicum; identical to SEQ ID NO: 2943

SEQ ID NO: 13021 - DNA, 1409 bp, Corynebacterium pseudotuberculosis; identical to SEQ ID NO: 2944
  CDS (223)..(1332)

SEQ ID NO: 13022 - protein, 369 aa, Corynebacterium pseudotuberculosis; identical to SEQ ID NO: 2945

SEQ ID NO: 13023 - DNA, 1032 bp, Coxiella burnetii; identical to SEQ ID NO: 2946
  CDS (1)..(1032)

SEQ ID NO: 13024 - protein, 343 aa, Coxiella burnetii; identical to SEQ ID NO: 2947

SEQ ID NO: 13025 - DNA, 1047 bp, Enterococcus faecalis; identical to SEQ ID NO: 2948
  CDS (1)..(1047)

SEQ ID NO: 13026 - protein, 348 aa, Enterococcus faecalis; identical to SEQ ID NO: 2949

SEQ ID NO: 13027 - DNA, 1072 bp, Erwinia carotovora; identical to SEQ ID NO: 2950
  CDS (1)..(1029)

SEQ ID NO: 13028 - protein, 342 aa, Erwinia carotovora; identical to SEQ ID NO: 2951

SEQ ID NO: 13029 - DNA, 1137 bp, Fusobacterium nucleatum; identical to SEQ ID NO: 2952
  CDS (1)..(1137)

SEQ ID NO: 13030 - protein, 378 aa, Fusobacterium nucleatum; identical to SEQ ID NO: 2953

SEQ ID NO: 13031 - DNA, 1613 bp, Herbaspirillum seropedicae; identical to SEQ ID NO: 2954
  CDS (199)..(1254)

SEQ ID NO: 13032 - protein, 351 aa, Herbaspirillum seropedicae; identical to SEQ ID NO: 2955

SEQ ID NO: 13033 - DNA, 1143 bp, Lactobacillus plantarum; identical to SEQ ID NO: 2956
  CDS (1)..(1143)

SEQ ID NO: 13034 - protein, 380 aa, Lactobacillus plantarum; identical to SEQ ID NO: 2957

SEQ ID NO: 13035 - DNA, 1101 bp, Leptospira interrogans; identical to SEQ ID NO: 2958
  CDS (1)..(1101)

SEQ ID NO: 13036 - protein, 366 aa, Leptospira interrogans; identical to SEQ ID NO: 2959

SEQ ID NO: 13037 - DNA, 1126 bp, Mycoplasma mycoides; identical to SEQ ID NO: 2960
  CDS (79)..(1116)

SEQ ID NO: 13038 - protein, 345 aa, Mycoplasma mycoides; identical to SEQ ID NO: 2961

SEQ ID NO: 13039 - DNA, 1050 bp, Mycobacterium smegmatis; identical to SEQ ID NO: 2962
  CDS (1)..(1050)

SEQ ID NO: 13040 - protein, 349 aa, Mycobacterium smegmatis; identical to SEQ ID NO: 2963

SEQ ID NO: 13041 - DNA, 1044 bp, Oceanobacillus iheyensis; identical to SEQ ID NO: 2964
  CDS (1)..(1044)

SEQ ID NO: 13042 - protein, 347 aa, Oceanobacillus iheyensis; identical to SEQ ID NO: 2965

SEQ ID NO: 13043 - DNA, 1071 bp, Paracoccus denitrificans; identical to SEQ ID NO: 2966
  CDS (1)..(1071)

SEQ ID NO: 13044 - protein, 356 aa, Paracoccus denitrificans; identical to SEQ ID NO: 2967

SEQ ID NO: 13045 - DNA, 1320 bp, Pasteurella haemolytica; identical to SEQ ID NO: 2968
  CDS (157)..(1263)

SEQ ID NO: 13046 - protein, 368 aa, Pasteurella haemolytica; identical to SEQ ID NO: 2969

SEQ ID NO: 13047 - DNA, 1500 bp, Pasteurella multocida; identical to SEQ ID NO: 2970
  CDS (175)..(1239)

SEQ ID NO: 13048 - protein, 354 aa, Pasteurella multocida; identical to SEQ ID NO: 2971

SEQ ID NO: 13049 - DNA, 1023 bp, Porphyromonas gingivalis; identical to SEQ ID NO: 2972
  CDS (1)..(1023)

SEQ ID NO: 13050 - protein, 340 aa, Porphyromonas gingivalis; identical to SEQ ID NO: 2973

SEQ ID NO: 13051 - DNA, 1824 bp, Prevotella ruminicola; identical to SEQ ID NO: 2974
  CDS (501)..(1523)

SEQ ID NO: 13052 - protein, 340 aa, Prevotella ruminicola; identical to SEQ ID NO: 2975

SEQ ID NO: 13053 - DNA, 978 bp, Proteus vulgaris; identical to SEQ ID NO: 2976
  CDS (1)..(978)

SEQ ID NO: 13054 - protein, 325 aa, Proteus vulgaris; identical to SEQ ID NO: 2977

SEQ ID NO: 13055 - DNA, 1047 bp, Pseudomonas oleovorans; identical to SEQ ID NO: 2978
  CDS (1)..(1047)

SEQ ID NO: 13056 - protein, 348 aa, Pseudomonas oleovorans; identical to SEQ ID NO: 2979

SEQ ID NO: 13057 - DNA, 1068 bp, Pseudomonas putida; identical to SEQ ID NO: 2980
  CDS (1)..(1068)

SEQ ID NO: 13058 - protein, 355 aa, Pseudomonas putida; identical to SEQ ID NO: 2981

SEQ ID NO: 13059 - DNA, 1110 bp, Pseudomonas syringae; identical to SEQ ID NO: 2982
  CDS (46)..(1110)

SEQ ID NO: 13060 - protein, 354 aa, Pseudomonas syringae; identical to SEQ ID NO: 2983

SEQ ID NO: 13061 - DNA, 1980 bp, Pseudomonas tolaasii; identical to SEQ ID NO: 2984
  CDS (414)..(1472)

SEQ ID NO: 13062 - protein, 352 aa, Pseudomonas tolaasii; identical to SEQ ID NO: 2985

SEQ ID NO: 13063 - DNA, 1501 bp, Rhizobium etli; identical to SEQ ID NO: 2986
  CDS (242)..(1327)

SEQ ID NO: 13064 - protein, 361 aa, Rhizobium etli; identical to SEQ ID NO: 2987

SEQ ID NO: 13065 - DNA, 1098 bp, Rhizobium loti; identical to SEQ ID NO: 2988
  CDS (1)..(1098)

SEQ ID NO: 13066 - protein, 365 aa, Rhizobium loti; identical to SEQ ID NO: 2989

SEQ ID NO: 13067 - DNA, 1092 bp, Rhodopseudomonas palustris; identical to SEQ ID NO: 2990
  CDS (1)..(1092)

SEQ ID NO: 13068 - protein, 363 aa, Rhodopseudomonas palustris; identical to SEQ ID NO: 2991

SEQ ID NO: 13069 - DNA, 1047 bp, Rhodopseudomonas viridis; identical to SEQ ID NO: 2992
  CDS (1)..(1047)

SEQ ID NO: 13070 - protein, 348 aa, Rhodopseudomonas viridis; identical to SEQ ID NO: 2993

SEQ ID NO: 13071 - DNA, 1074 bp, Shewanella oneidensis; identical to SEQ ID NO: 2994
  CDS (1)..(1074)

SEQ ID NO: 13072 - protein, 357 aa, Shewanella oneidensis; identical to SEQ ID NO: 2995

SEQ ID NO: 13073 - DNA, 1235 bp, Spirulina platensis; identical to SEQ ID NO: 2996
  CDS (54)..(1151)

SEQ ID NO: 13074 - protein, 365 aa, Spirulina platensis; identical to SEQ ID NO: 2997

SEQ ID NO: 13075 - DNA, 1074 bp, Staphylococcus epidermidis; identical to SEQ ID NO: 2998
  CDS (25)..(1074)

SEQ ID NO: 13076 - protein, 349 aa, Staphylococcus epidermidis; identical to SEQ ID NO: 2999

SEQ ID NO: 13077 - DNA, 1140 bp, Streptococcus agalactiae; identical to SEQ ID NO: 3000
  CDS (1)..(1140)

SEQ ID NO: 13078 - protein, 379 aa, Streptococcus agalactiae; identical to SEQ ID NO: 3001

SEQ ID NO: 13079 - DNA, 1119 bp, Streptomyces ambofaciens; identical to SEQ ID NO: 3002
  CDS (1)..(1119)

SEQ ID NO: 13080 - protein, 372 aa, Streptomyces ambofaciens; identical to SEQ ID NO: 3003

SEQ ID NO: 13081 - DNA, 1134 bp, Streptomyces avermitilis; identical to SEQ ID NO: 3004
  CDS (1)..(1134)

SEQ ID NO: 13082 - protein, 377 aa, Streptomyces avermitilis; identical to SEQ ID NO: 3005

SEQ ID NO: 13083 - DNA, 1152 bp, Streptococcus mutans; identical to SEQ ID NO: 3006
  CDS (1)..(1152)

SEQ ID NO: 13084 - protein, 383 aa, Streptococcus mutans; identical to SEQ ID NO: 3007

SEQ ID NO: 13085 - DNA, 1137 bp, Streptococcus pyogenes; identical to SEQ ID NO: 3008
  CDS (1)..(1137)

SEQ ID NO: 13086 - protein, 378 aa, Streptococcus pyogenes; identical to SEQ ID NO: 3009

SEQ ID NO: 13087 - DNA, 1356 bp, Streptococcus parasanguis; identical to SEQ ID NO: 3010
  CDS (118)..(1263)

SEQ ID NO: 13088 - protein, 381 aa, Streptococcus parasanguis; identical to SEQ ID NO: 3011

SEQ ID NO: 13089 - DNA, 1416 bp, Streptomyces rimosus; identical to SEQ ID NO: 3012
  CDS (229)..(1359)

SEQ ID NO: 13090 - protein, 376 aa, Streptomyces rimosus; identical to SEQ ID NO: 3013

SEQ ID NO: 13091 - DNA, 1916 bp, Streptococcus thermophilus; identical to SEQ ID NO: 3014
  CDS (555)..(1694)

SEQ ID NO: 13092 - protein, 379 aa, Streptococcus thermophilus; identical to SEQ ID NO: 3015

SEQ ID NO: 13093 - DNA, 1271 bp, Streptomyces violaceus; identical to SEQ ID NO: 3016
  CDS (75)..(1208)

SEQ ID NO: 13094 - protein, 377 aa, Streptomyces violaceus; identical to SEQ ID NO: 3017

SEQ ID NO: 13095 - DNA, 1068 bp, Synechococcus elongatus; identical to SEQ ID NO: 3018
  CDS (1)..(1068)

SEQ ID NO: 13096 - protein, 355 aa, Synechococcus elongatus; identical to SEQ ID NO: 3019

SEQ ID NO: 13097 - DNA, 1023 bp, Thermus thermophilus; identical to SEQ ID NO: 3020
  CDS (1)..(1023)

SEQ ID NO: 13098 - protein, 340 aa, Thermus thermophilus; identical to SEQ ID NO: 3021

SEQ ID NO: 13099 - DNA, 1405 bp, Thiobacillus ferrooxidans; identical to SEQ ID NO: 3022
  CDS (196)..(1236)

SEQ ID NO: 13100 - protein, 346 aa, Thiobacillus ferrooxidans; identical to SEQ ID NO: 3023

SEQ ID NO: 13101 - DNA, 1314 bp, Tropheryma whipplei; identical to SEQ ID NO: 3024
  CDS (1)..(1314)

SEQ ID NO: 13102 - protein, 437 aa, Tropheryma whipplei; identical to SEQ ID NO: 3025

SEQ ID NO: 13103 - DNA, 1411 bp, Vibrio cholerae; identical to SEQ ID NO: 3026
  CDS (183)..(1247)

SEQ ID NO: 13104 - protein, 354 aa, Vibrio cholerae; identical to SEQ ID NO: 3027

SEQ ID NO: 13105 - DNA, 1044 bp, Vibrio parahaemolyticus; identical to SEQ ID NO: 3028
  CDS (1)..(1044)

SEQ ID NO: 13106 - protein, 347 aa, Vibrio parahaemolyticus; identical to SEQ ID NO: 3029

SEQ ID NO: 13107 - DNA, 996 bp, Wigglesworthia glossinidia brevipalpis; identical to SEQ ID NO: 3030
  CDS (1)..(996)

SEQ ID NO: 13108 - protein, 331 aa, Wigglesworthia glossinidia brevipalpis; identical to SEQ ID NO: 3031

SEQ ID NO: 13109 - DNA, 1035 bp, Xanthomonas axonopodis; identical to SEQ ID NO: 3032
  CDS (1)..(1035)

SEQ ID NO: 13110 - protein, 344 aa, Xanthomonas axonopodis; identical to SEQ ID NO: 3033

SEQ ID NO: 13111 - DNA, 1594 bp, Xenorhabdus nematophilus; identical to SEQ ID NO: 3034
  CDS (142)..(1218)

SEQ ID NO: 13112 - protein, 358 aa, Xenorhabdus nematophilus; identical to SEQ ID NO: 3035

SEQ ID NO: 13113 - DNA, 1044 bp, Xylella fastidiosa; identical to SEQ ID NO: 3036
  CDS (1)..(1044)

SEQ ID NO: 13114 - protein, 347 aa, Xylella fastidiosa; identical to SEQ ID NO: 3037

SEQ ID NO: 13115 - DNA, 1020 bp, Zymomonas mobilis; identical to SEQ ID NO: 3038
  CDS (1)..(1020)

SEQ ID NO: 13116 - protein, 339 aa, Zymomonas mobilis; identical to SEQ ID NO: 3039

SEQ ID NO: 13117 - DNA, 1660 bp, primary endosymbiont of Sitophilus oryzae; identical to SEQ ID NO: 3040
  CDS (11)..(1078)

SEQ ID NO: 13118 - protein, 355 aa, primary endosymbiont of Sitophilus oryzae; identical to SEQ ID NO: 3041

SEQ ID NO: 13119 - DNA, 1110 bp, Azospirillum lipoferum; identical to SEQ ID NO: 3042
  CDS (1)..(1110)

SEQ ID NO: 13120 - protein, 369 aa, Azospirillum lipoferum; identical to SEQ ID NO: 3043

SEQ ID NO: 13121 - DNA, 1017 bp, Geobacter sulfurreducens; identical to SEQ ID NO: 3044
  CDS (1)..(1017)

SEQ ID NO: 13122 - protein, 338 aa, Geobacter sulfurreducens; identical to SEQ ID NO: 3045

SEQ ID NO: 13123 - DNA, 1230 bp, Mycobacterium paratuberculosis; identical to SEQ ID NO: 3046
  CDS (1)..(1230)

SEQ ID NO: 13124 - protein, 409 aa, Mycobacterium paratuberculosis; identical to SEQ ID NO: 3047

SEQ ID NO: 13125 - DNA, 1083 bp, Lactobacillus johnsonii; identical to SEQ ID NO: 3048
  CDS (1)..(1083)

SEQ ID NO: 13126 - protein, 360 aa, Lactobacillus johnsonii; identical to SEQ ID NO: 3049

SEQ ID NO: 13127 - DNA, 1245 bp, Treponema denticola; identical to SEQ ID NO: 3050
  CDS (1)..(1245)

SEQ ID NO: 13128 - protein, 414 aa, Treponema denticola; identical to SEQ ID NO: 3051

SEQ ID NO: 13129 - DNA, 1068 bp, Wolbachia pipientis wMel; identical to SEQ ID NO: 3052
  CDS (1)..(1068)

SEQ ID NO: 13130 - protein, 355 aa, Wolbachia pipientis wMel; identical to SEQ ID NO: 3053

SEQ ID NO: 13131 - DNA, 1074 bp, Desulfovibrio vulgaris; identical to SEQ ID NO: 3054
  CDS (1)..(1074)

SEQ ID NO: 13132 - protein, 357 aa, Desulfovibrio vulgaris; identical to SEQ ID NO: 3055

SEQ ID NO: 13133 - DNA, 1557 bp, Bacillus licheniformis; identical to SEQ ID NO: 3056
  CDS (369)..(1415)

SEQ ID NO: 13134 - protein, 348 aa, Bacillus licheniformis; identical to SEQ ID NO: 3057

SEQ ID NO: 13135 - DNA, 1119 bp, Corynebacterium diphtheriae; identical to SEQ ID NO: 3058
  CDS (1)..(1119)

SEQ ID NO: 13136 - protein, 372 aa, Corynebacterium diphtheriae; identical to SEQ ID NO: 3059

SEQ ID NO: 13137 - DNA, 1038 bp, Mycoplasma mycoides; identical to SEQ ID NO: 3060
  CDS (1)..(1038)

SEQ ID NO: 13138 - protein, 345 aa, Mycoplasma mycoides; identical to SEQ ID NO: 3061

SEQ ID NO: 13139 - DNA, 1134 bp, Bdellovibrio bacteriovorus; identical to SEQ ID NO: 3062
  CDS (1)..(1134)

SEQ ID NO: 13140 - protein, 377 aa, Bdellovibrio bacteriovorus; identical to SEQ ID NO: 3063

SEQ ID NO: 13141 - DNA, 1086 bp, Parachlamydia sp; identical to SEQ ID NO: 3064
  CDS (1)..(1086)

SEQ ID NO: 13142 - protein, 361 aa, Parachlamydia sp; identical to SEQ ID NO: 3065

SEQ ID NO: 13143 - DNA, 1071 bp, Photobacterium profundum; identical to SEQ ID NO: 3066

SEQ ID NO: 13144 - protein, 356 aa, Photobacterium profundum; identical to SEQ ID NO: 3067

SEQ ID NO: 13145 - DNA, 24 bp, Primer
atggctatcgacgaaaacaaacag

SEQ ID NO: 13146 - DNA, 27 bp, Primer
ttaaaaatcttcgttagtttctgctac

SEQ ID NO: 13147 - DNA, 1167 bp, Escherichia coli
  CDS (1)..(1167)
atgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttga

SEQ ID NO: 13148 - protein, 388 aa, Escherichia coli
MKHLHRFFSSDASGGIILIIAAILAMIMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLAVLNLCGARRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMVVGILCGIGFTMSIFIASLAFGSVDPELINWAKLGILVGSISSAVIGYSWLRVRLRPSV

SEQ ID NO: 13149 - DNA, 1242 bp, Caulobacter crescentus
  CDS (1)..(1242)
atgctgcaacgcgtccgcaaactgtcccttctgagagagcttctggaaagcggggccgccggcggtctgcttctgatggcctgcgccgttcttgccctcttcgtcgccaactcgccgctggcggagggctatttccacgccctgcatgtcccgttcgccgggcttgatctgctgcactggatcaacgacggcctgatggcgatcttctttctgttcgtcggcctggagatcaagcgagagttcctggacgggcagttgtcgacctgggccaaccgcgcgctgccatgcatcgctgcggcggggggcgtcgttgttccaggcctcatctacgcaagtctgaacgccggcagtccagagacgctgcgcggctgggcaattccgacggcgacggatatagccttcgcgctgggcgtcctctcgcttctgggatcacgcgtcccgaccagcctcaagatcttcctcgcgacgctggcgatcgtcgacgacctcgtggcggttctgatcatcgccgtgttctataccgctgaactcaacaccgccgccctgatgggcgcggcgctggtgacgctcgttctgctcggcttcaatcgactgaaggtgaagcggctcgcgccgtatctggtcatgggcgtggcgctgtggtggctggtccttctgtccggagttcatgcgaccatcgccggcgtggtgctggccatgaccatccccttgcacgcctcgaaggctgcgccggacgacgcgacctcgccgctgcatcgcctggagcatgcgctctcgccctgggtggccttcctggtggtgccgatcttcggcttcgccaatgcgggcctgtcgttcgccggcatgacgccgtcggtcctggcggagcccgtgacgctcggcgtggccctggggctgttcttcggcaagcagatcggcgtgttcggggcggcgtggctcgccatccgcctgggcgtcgcgcgcctgccggtggcggcctcctgggcgcagctctatggggtcagcctgctctgcggcatcggcttcaccatgagtctcttcattggtctgctggcgttccgcgatgcagcgctgcaaaacgaggtgaaggtcggcgtgctggtcggctcgctcagctcggccctgatcggcgcgaccctgctgagcctgacgaaaaggcggctaccggctgtcgatccgtcgcgcgatcatcaggctgacgccaccgcgttggacgacctcggccgcgaagacgcgcgctga

SEQ ID NO: 13150 - protein, 413 aa, Caulobacter crescentus; identical to SEQ ID NO: 652

SEQ ID NO: 13151 - DNA, 1149 bp, Geobacter sulfurreducens; identical to SEQ ID NO: 729
  CDS (1)..(1149)

SEQ ID NO: 13152 - protein, 382 aa, Geobacter sulfurreducens; identical to SEQ ID NO: 730

SEQ ID NO: 13153 - DNA, 1167 bp, Salmonella enterica subsp. enterica serovar Typhi; identical to SEQ ID NO: 669
  CDS (1)..(1167)

SEQ ID NO: 13154 - protein, 388 aa, Salmonella enterica subsp. enterica serovar Typhi; identical to SEQ ID NO: 670

SEQ ID NO: 13155 - DNA, 1185 bp, Yersinia pestis; identical to SEQ ID NO: 663
  CDS (1)..(1185)

SEQ ID NO: 13156 - protein, 394 aa, Yersinia pestis; identical to SEQ ID NO: 664

SEQ ID NO: 13157 - DNA, 1350 bp, Helicobacter pylori
  CDS (34)..(1350)
atgggtttgaaaataaaaattttaaggttgtctatgaatctcaaaaaaacagaaaacgcgctcagtttgacgcttaaaaacttcattaaaagcgagtcttttggagggattttcctctttttgaacgccgttttagcgatggtggtggctaattcgtttttaaaagaaagttattttgcgctatggcacaccccttttgggtttcaagtaggggatttttttatcggctttagtttgcacaactggattgatgatgtcttaatggcgttattctttttaatgataggcttagagatcaagcgagaattgttgtttggggaattatccagttttaaaaaagcttctttccctgtgatcgcagccatagggggcatgatagctccaggattgatttatttttttcttaacgccaacacgccctctcagcatggttttgggatccctatggcaacggatattgcgttcgctttaggcgtgatcatgcttttaggcaagagggtgccaaccgccttaaaggtttttttaatcactctagcggtggctgatgacttaggggctattgtggtgatcgcgctcttttataccacgaatttaaaattcgcatggcttttaggggctttaggggtggttcttgttttagccatattgaaccgcctgaatatccgatcgctcatcccttacttgcttttaggggtgttgctttggttttgcgtgcatcaaagcggtatccatgcgacgatcgctgcggtggttctagcttttatgataccggtgaaaatccctaaagattctaaaaatgtagagcttttggaattaggcaaacgatacgcagagacgagttcaggagtgcttttaaccaaagagcagcaagaaatcttgcattctattgaagaaaaagcgagtgctttacaaagccccttagaaagattggagcattttctagcccccatcagcgggtatttcatcatgcccttattcgcgtttgcaaacgctggggtgagcgttgattctagcatcaatttagaagtggataaggtgcttttaggggttattttagggctttgtttgggcaagcctttagggattttcttaatcactttcataagcgaaaagcttaaaatcactgcgcgccctaaaggcatcggctggtggcatattttaggggctgggcttttagcagggattggctttaccatgtctatgttcatttctaatctggctttcacgagcgaacataaggacgctatggaagtggcaaaaattgcgattttactcggatctttgatttctgggatcataggggctttatatttattcgcactagataaaagagcggctttaaagaaatag

SEQ ID NO: 13158 - protein, 438 aa, Helicobacter pylori; identical to SEQ ID NO: 656

SEQ ID NO: 13159 - DNA, 1149 bp, Vibrio cholerae; identical to SEQ ID NO: 653
  CDS (1)..(1149)

SEQ ID NO: 13160 - protein, 382 aa, Vibrio cholerae; identical to SEQ ID NO: 654

SEQ ID NO: 13161 - DNA, 1203 bp, Haemophilus influenzae; identical to SEQ ID NO: 647
  CDS (1)..(1203)

SEQ ID NO: 13162 - protein, 400 aa, Haemophilus influenzae; identical to SEQ ID NO: 648

SEQ ID NO: 13163 - DNA, 1314 bp, Sinorhizobium meliloti
  CDS (1)..(1314)
atgaacgacagtctctcacggcttcccagggaaccggcagatcggcttaccaagccgtttatgcggttcctccggatcgaggccaccgcgggcattatccttttgctcagcacgctcttggcgctcggcctcgcaaataccgcgtggtcgtcgtcgtttctcgccttttgggagatgcccgcgggtgtcagactgggcgacatcgggatctatcgttcgctgaagcactggatcaacgacgggctgatgacgttttttttcttcgtcatcgcccttgagctgaagcgtgagctggtgctgggggagctgcgcaatccgcgcatggccgccctacccgtcgccgccgctctcgggggaatggctgcgccggccggaatctatttgctgcttgtcggcggggggccgggtgcgagcggctggggcaccgttatgtccacggacacggcgttcgtcatcggatgccttgctttgctcggttcccgcgtacctggtagcttgcgactgttcctgctctctcttgcgatcttcgacgacatcggcgcaatattgatcgtggcggtcggctatggcgaaccgttgaattgggtggcactcggaaccggaggactcggatttgccttcgtcgcaggaattgcgcttctgggcatccgcagcattccggtctatttcgcgatgggtagcgccatctggctggcattcgacgcatcgggcgttcacgcgacgctcgtcggagtgatacttggcttgatgacgccggcgcggaggtgggtaagcgagatccgcctccacgcgatactcgaccgggtgatcgcccatccccccggcgaccatcgcagccgtgacacggcggcacgcagcgaccttcatcgggcaggcgtcgcgacccgcgaagcagtgtcgccgatcgagcgtctcgagatcgccctccatccctgggtcgcattcgcaatcatgccgctctttgccgtctccaacgcgggcatcccgatagaggatgcaaacttcgacgttcccctcacgatcgcaattgtcgtcgccttcgtggtcggcaagccggctggcattgtgctcttcagtttcctcgccgtgaaacttcgcctcgcgagtcgtccggaacagctatcctggagcctgttggcggccggcagtctgctgaccgggatcggcttcaccatggctctgttcattgccgagcttgctttcgagcccgagcttctgatccccgtcaagctcggtgtgctcggcgcttccgtcatatcggccgcactcggttttatggcgctgaccttactgacgtctcctaatagacgatag

SEQ ID NO: 13164 - protein, 437 aa, Sinorhizobium meliloti; identical to SEQ ID NO: 662

SEQ ID NO: 13165 - DNA, 441 bp, Rickettsia conorii; identical to SEQ ID NO: 671
  CDS (1)..(441)

SEQ ID NO: 13166 - protein, 146 aa, Rickettsia conorii; identical to SEQ ID NO: 672

SEQ ID NO: 13167 - DNA, 1170 bp, Campylobacter jejuni; identical to SEQ ID NO: 665
  CDS (1)..(1170)

SEQ ID NO: 13168 - protein, 389 aa, Campylobacter jejuni; identical to SEQ ID NO: 666

SEQ ID NO: 13169 - DNA, 1149 bp, Campylobacter jejuni
  CDS (1)..(1149)
atgcaaatgataaagaagatggttttaagtgaaactttccctggtattttgcttatattttttacatttttagctttattatgtaaaaattcttctttaagtgttatttatacagatttttttcatgctaattttacagtaggatttgatcattttcaaatttcaaaatcgttggatttatggataaatgatggtttgatagctatattttttctatgtatagggcttgagttaaaatatgaaattttacgtgggcaacttaaaaatataagagctgtatctttacctatatttggagctttagggggtatgattactccggctttaatttttattgctattaattattctcatgattttgctatgaaaggttgggcaatacctacagcaactgatatagcttttgcagtgggtattttaatgcttttgggaaataaaattcctacaagtttaaaactttttttgctctctttagctatttttgatgatttgggtgctattgttattattgctttgttttatacagatcagctttcagctttagcaattattatttgtttgttttgtatatttgctctgcttttgttaaattattatcacatcacccatctttctttgtacgtgttggtaggtgttgtgttgtggatagctatgcttaaaagtggagtgcatgcaactttggctggtgtgatcatttctttgtttatacctcttgatacaaaaaataaaaaaccttatttacatgaagttcttaaggatttaaatccttgggtagtttattttattttacctttatttgcttttgccaatgctggaattgatattagagatatgcatcttggttcagtattttctcctgtaagtcttgggattattttaggactatttttaggaaaacaattaggtgttttcactttttgttttattgctatcaaacttaaacttgcaaaattacctgaaaatattaaatatggaaaattttatggtatatgtattttaacaggcatcggttttacgatgagcttgtttattgatggtttggcttataaaaatagtgatatttttgaatatgcggataaacttgctattttagtagctagttttttaagtgccattgttggttttatttatcttaagattgttaaatga

SEQ ID NO: 13170 - protein, 382 aa, Campylobacter jejuni; identical to SEQ ID NO: 668

SEQ ID NO: 13171 - DNA, 1317 bp, Helicobacter pylori
  CDS (1)..(1317)
atgaatctcaaaaaaacagaaaacgcgctcagtttgacgcttaagaacttcattaaaagcgagtcttttggagggattttcctctttttaaacgctgttttagcgatggtggtggctaattcgtttttaaaagaaagttattttgcactatggcacaccccttttgggtttcaaataggggattttttcatcggctttagtttgcacaactggattgatgatgtcttaatggcgttattctttttaatgataggcttagaaatcaaacgagaattgttgtttggggaattatccagtttcaaaaaagcttcttttcctgtgattgcggccatagggggcatgatagccccaggattgatttatttttttcttaacgctaacacgccttcccagcatggttttgggatccctatggcgacggatattgcgttcgctttaggcgtgatcatgcttttaggcaagagggtgccaaccgctttaaaggtttttttaatcactctagcggtggctgatgacttgggggctattgtggtgatcgcgctcttttataccacgaatttaaaattcgcatggcttttaggggctttaggggtggttcttgttttagccgtattaaaccgcctgaatatgcgctcgctcatcccttacttgcttttaggggtgttgctttggttttgcgtgcatcaaagcggtatccatgcgacgattgctgcagtgattctagcttttatgataccggtgaagatccctaaagattctaaaaatgtagagcttttggaactaggcaaacgatacgcagaaacgagttcaggagcgcttttgagtaaagagcagcaagaaatcttgcattctattgaagaaaaagcgagcgccttacaaagccccttagaaagattggagcattttctagcccccattagcgggtatttcatcatgcccttattcgcgtttgcaaacgctggggtgagcgttgattctagcatcaatttagaagtggataaggtgcttttaggggttattttagggctttgcttgggcaaacctttagggattttcttaatcacttttataagcgaaaagcttaaaatcaccgcacgccctaaaggcatcagctggtggcatattttaggggctgggcttttagcagggattggctttaccatgtctatgtttatttctaatctggccttcacgagcgagcataaagacgctatggaagtggcaaaaattgcgattttactcggatctttgatttctgggatcataggggctttgtatttatttgcgctagacaaaagagcggctttaaagaaatag

SEQ ID NO: 13172 - protein, 438 aa, Helicobacter pylori; identical to SEQ ID NO: 650

SEQ ID NO: 13173 - DNA, 1152 bp, Vibrio parahaemolyticus
  CDS (1)..(1152)
atgaacgatgtcatccgtgactttttcaaaatggaatccgcaggtggtattcttctcgtgattgcagcggcaattgcgatgaccattgcaaactcaccactgggcgaaacttatcaatctctactgcatacttatgtatttggtatgtctgtttctcactggatcaacgacggtctgatggctgtgttcttcctacttattggccttgaagtaaagcgcgagctgcttgaaggcgcgttaaaatcgaaagaaactgccatcttccctgcaattgctgcggtcggtggtatgttggctccggcacttatttacgttgcttttaatgcaaatgaccctgaagcgatctctggttgggcaattcctgcggcgacagacattgcatttgctctgggtatcatggcgttacttggtaagcgcgtaccagtgagtctaaaagtatttttattggctcttgcgatcattgacgacttaggtgttgttgtcatcattgctctgttctacaccggtgatctttcttcaatggcattgcttgtcggcttcgtcatgacaggtgtactgttcatgctgaacgcgaaagaagtcactaagctaacaccgtacatgattgtgggtgctattttgtggtttgctgtacttaagtctggtgttcacgcaacattggcaggtgtagtgatcggtttcgcgattccgctgaaaggaaagcagggcgaacactctccattgaaacacatggagcatgctcttcacccttatgtcgcatttggtattcttcctctgtttgcatttgcgaacgcaggtatctcgctagaaggcgtatcgatgtctggcctaacttcaatgctgcctctaggtattgcattaggtctattgattggtaagcctctaggtatcttcagctttagctgggcagctgtgaaactgggcgttgcgaagctaccagagggtataaacttcaagcatatcttcgcggtatcagtgttgtgtggtatcggttttacgatgtcgatctttatctcttcactggcgttcggtaacgtaagccctgagtttgatacatacgctcgattaggtattttgatgggctcaactactgcagcggtacttggttacgctctactgcatttctcattaccaaagaaagcacaagactaa

SEQ ID NO: 13174 - protein, 383 aa, Vibrio parahaemolyticus; identical to SEQ ID NO: 646

SEQ ID NO: 13175 - DNA, 2295 bp, Vibrio alginolyticus
  CDS (605)..(1756)
ctgtgtttggcaccttgtccacacgctcaggtaaagtcatcaatctctcagatgatgatatcagtattaaaccaatgcaagtgaccagtttatcaaatggaagaaggctgcctttgcagtggattattaatattccaaagcatcaaattaacttgaccactcgtattatcaaatcagatatgtggcttccttttgttataccgtattgggaaggtcctaccttagcttctggctccaacgagggttggggctttatgcagctcaccggttattaaattctgataaaaaccaccccaatgggtggttttttagtggatgaaacttcctgaatttttctcaaaagtatggggttatcatgacagtacatgccatgttatgctgattttctcataatcttgataaacatttggcgcgataaccacaagtacgcgctgtgatcaaaattgagtgttatgttggaaaatacgatgtatagtaaacttcatatcggaaaaatcgaagtttatactctgaagaagcgattattctaaagttttcgaccgctatacactcttatcattctttgttaatcgtttattaagataataaatataaggacgaaaccatgaacgatgtcattcgtgactttttcaaaatggaatcagctggtggtattcttctcgtgattgccgcggcaattgcgatgaccattgctaactcaccgctgggcgaaacttatcaatctgtactgcatacttatgtatttggtatgtcagtttctcactggattaatgacggcctaatggctgttttcttcttactcattggccttgaagttaagcgagagctacttgaaggtgcgttaaaatcaaaagaaaccgcaattttccctgcgattgcagcggttggcggtatgttagctcctgctcttatttacgtagcctttaatgccaacgatcctgaggcgatttctggttgggcaattccagcggcgacagatatcgcttttgctttaggtatcatcgcgttattaggtaagcgtgtaccagtaagcctaaaagtgttcttgctagcgcttgctatcatcgatgatttgggtgtggttgttattatcgcgctattttacaccggtgacctgtcgaccatggcgttgcttgttggcttcatcatgactggtgtcctattcatgttgaatgcgaaggaagtaacaaaacttacgccatacatgatcgtcggtgcgatcttatggttcgcggtgcttaaatctggtgttcacgcaacattggcaggtgtagtgattggttttgctatcccactaaagggaaagcagggcgaacattctccacttaaacatatggagcacgcgcttcacccatacgtggcatttggtattctgcctctattcgcatttgccaatgcggggatttcgttagaaggcgtatcgatgtcaggtctaacttcaatgctgccactcggtattgctttgggtctactggttggtaagcctctaggtatctttacctttagctgggcagcggtaaaaatgggcgttgctaagttacctgaaggcgttaacttcaagcatatctttgcggtatctgtgttgtgtggtattggctttacaatgtctatcttcatttcctctttagcgttcggaaatgtaagtcctgaatttgatacctatgctcgactcggtatcttaatgggttcgacgacagcagcattacttggctatgccttgctgcacttttctttgcctaagaaagcgcaagcgtaagataaaaatgcgctattttgtaaagcctcccactcgggaggcttttttatacccatagttcagtacatcagcgacttaatagcgacactttcgtattgagcggatgtctagaccatggagatgaacggaatcatcgaaaaaggtaggttggtagatctgcggcgaaaaaaagcccagccgaaaatttgactgggcggatacaaacataggagttaataagaaaaaagcagcaacgtaacaattagatggaaacaagtttgacggccagtgaaacttaaaatgccctagttgttacatttattcagaccgagccttttccaaacagttccattttctttcaaaaaaattcgatttaattctttctgcccgcttgtatcgtaaagaagtaagagaagaggcgaacagcgtaaccaacttaatggcggtttgaaactcgatagccctcttttctatagtagctataaacttaaattgcatttcaaacccgcacctcctgctccgaccgcccaacgacattgctagcgtttcaaatacgatgg

SEQ ID NO: 13176 - protein, 383 aa, Vibrio alginolyticus
MNDVIRDFFKMESAGGILLVIAAAIAMTIANSPLGETYQSVLHTYVFGMSVSHWINDGLMAVFFLLIGLEVKRELLEGALKSKETAIFPAIAAVGGMLAPALIYVAFNANDPEAISGWAIPAATDIAFALGIIALLGKRVPVSLKVFLLALAIIDDLGVVVIIALFYTGDLSTMALLVGFIMTGVLFMLNAKEVTKLTPYMIVGAILWFAVLKSGVHATLAGVVIGFAIPLKGKQGEHSPLKHMEHALHPYVAFGILPLFAFANAGISLEGVSMSGLTSMLPLGIALGLLVGKPLGIFTFSWAAVKMGVAKLPEGVNFKHIFAVSVLCGIGFTMSIFISSLAFGNVSPEFDTYARLGILMGSTTAALLGYALLHFSLPKKAQA

SEQ ID NO: 13177 - DNA, 1359 bp, Wolinella succinogenes; identical to SEQ ID NO: 727
  CDS (1)..(1359)

SEQ ID NO: 13178 - protein, 452 aa, Wolinella succinogenes; identical to SEQ ID NO: 728

SEQ ID NO: 13179 - DNA, 1359 bp, Porphyromonas gingivalis
  CDS (1)..(1359)
atgaaacagacttttcgctttatcaaaccaattgaacggattactcacctgaagccgaatgctacgatgatgttgttcttggcttcggtgttggcagtcatcatggctaatagttcgttgagtactatctatcatgaaattttagagtaccctatcaatcttacgatcggaggtcatgaggtcttttctcatcatggagagaccatgaccttgctccagtttgtgaatgatgtgctgatggtcattttcttccttgctgtcggtttggagatcaagcaggagattttggtcggcgaattgtcttctttcaagaaagctatgctccccattgtaggagccataggagggatgatcgtccctgtccttttcttcctgctggttgttcatgaaggccctggtgcaagaggtgctgccatccctatgtctacggatatagcttttgccttggcggccttggctgttttgggaagtcgggttccggcaagcctcaaggtattcctgacggctttggctgttgccgacgatataggtggtattatcgttattgcgctcttctatagttcccatatcaacatcgggatgttggccattgccttcggtatcctattcatcatgtatttgatggggcgtatgcatgtgagcaacttagggctttacttcgtctgtactttctttgtttggctctttttcctacagagcggtatccataccacaatagccggtgtgctggcagctttcatgattccggcccgtcctggactacatgccaagaatcttcgtgccgagatgcgttcccttttcgaggcaatgcccaatgacaagatacgacaatcaggtagctctctgatcttgagccataaccaaatcaacgtaatcaactccatgcgtaagattgcgcgtaaggctataagtcctatgcagctcatggaagagtatctcagcccgatagtaggctacttcgtcttgcctctctttgcctttgccaatgctggcatcacgctcggaggagtcacggcagatgccttgtggggcgtgccgatggctgtattcttgggcttgtttgtcggcaaacctttgggtatttactttttcacctatggttttgtcaagatgaggctctgcccttggcctgaaggaatgagccgcctcaacctgatggcagtctccttatttggaggtatcggttttactgtttccctctttatcgctaccctttcttacgccggagccgagcatttgctcttcctcaacgaggccaagctcggtatcttcgttgcttcgattttcgctgctctggtcggtatcgttacattgcgatatgagctgaatctggaaagcgccaaggcgcaaaagagttga

SEQ ID NO: 13180 - protein, 452 aa, Porphyromonas gingivalis; identical to SEQ ID NO: 726

SEQ ID NO: 13181 - DNA, 1167 bp, Photorhabdus luminescens
  CDS (1)..(1167)
atgacagcaattattcgtcaattcctgaaattagaagcggctggagggcttcttcttatcatcactgccattattgcgttgataatggcaaactcgccattacagggtatttatcagcaatttcttaatatttcggtggcagtacaattcgctgcactggagatcaataagcctttgttgttgtggattaatgacggcttgatggcggtcttctttttgattgttggtttggaagtaaaacgggaactgttggaaggctctttggcagggcgtgataaggcactatttccggtgatagcggcgataggtggtatggtcgctccggcactaatatatctactctttaatggcaatgatgagtttacccgtcagggttgggctattcctgcggcaaccgatattgcttttgccttgggtgtgatggcgctattgtctaagcgagtaccaacagaactcaaggttttcttgttggcacttgcgattattgatgatctgggcgttatcgtgattatcgctctgttttataccaaaacggtttctcttgtggcgcttggattgtcagcggcaatgattgctttgctggtttggatgaattggcgcggtgtcgaaaaaacatcggcttatttggctgttggcgctatcctttgggtttgcatcttgaaatcgggtgttcatgcaacactcgccggcgtcattgttggttttctgattcctctgcgtggccagaatggtcattcaccatctgaattacttgagcacggtttgcatccttgggtggcgtatcttattttgccattatttgcatttgccaatgcaggtgtagccctgaatggcgttacgttaaatggtttgaccgatatattgccgttaggtattgctgtggctctgtttcttggtaaaccattgggcatttttctttttagctatatttctattcagatcggatttgctaaattgccacagcagattaatcttaaacagatatttgcggtttctgttctttgtggaattggctttactatgtctatctttatttcaggattggcttttgaaggggtggatgaatctttcagtgtctattcccgtcttggcattctgatgggttcaaccatcgctgcgtttatggggtatggcttgttacgaatggtcttaccaaagaaaaagtga

SEQ ID NO: 13182 - protein, 388 aa, Photorhabdus luminescens; identical to SEQ ID NO: 724

SEQ ID NO: 13183 - DNA, 441 bp, Rickettsia sibirica; identical to SEQ ID NO: 677
  CDS (1)..(441)

SEQ ID NO: 13184 - protein, 146 aa, Rickettsia sibirica; identical to SEQ ID NO: 678

SEQ ID NO: 13185 - DNA, 1323 bp, Rhodopirellula baltica
  CDS (1)..(1323)
atgaatcacatcgaaactagactcccgctaccgattcaacctattgatcggtggctacgtccgtttgcacgcttcttacacatcgaggcaaccagcgggctggtgctgattttgtgcacggtggtcgccctcgtcgcggccaactcttcttgggcagatagctatctagcgttttggcataccgatctgacgattgccgtcggtgacatcgtctttcatcactcactgcatcacgtcatcaacgatggattgatggcggtgtttttctttgtgattggtctggaagtcaaacgtgaactcgcccatgggtcgctatcggatttgaaacaggccactctgccgattgccgcggcgatcggtgggatgatcgtgccggccacgctttatctatccatgcagtacggccagcccggggtgcagggatggggcattccaatggcgactgacatcgccttcgtcgtgggatgcctggcgatccttggttctcgcgtaccgcacagccttcgagtgcttctgctttcgctcgccatcgtggatgacattggcgcaatattggtgatcgcaatcggctacaccgaatcgctggacggtcgctacttgtttctcgcagcggtcgcggtcggcgcagtccatttcctttcgcgaatcggagtgcgtcgtttcccaccgtacgtgatcgtcggcgttctcgcttggattgcgctccacgaatctggcattcacgcgacactgatcggcgtgatcctcggactgatgactcctgccacgccgacattggtgcccgagcgttttcgcgaatacttgcacgaaaaggagcacgaatttcaaccgaaggagtggagtcggcggctacaccgcgctgaggtggttcgagaagttcagcagctcacgcgagaaacagtttcaccgctggagtacttggaggtaacactgcacccttggaccgcctatgtgatcatgcccgtcttcgcgctcgcgaatgcgggagtgttgattgaaccggccaacctgagtgactccgttgcaatcgcggtcgtgatcggtctggtcgtcggcaagccacttggaattgcgctgttcagttggttggtgattcgattgggcgtggcacgtttgccgagcggtttgaactggccaattttgatgtcgggaagtttccttgccggtatcggattcacgatggcattgttcatcgacgggttggcattcggagccgatgggctcgatactgccaagactggcgtgctggtcgggtccgcaatcagcgcaatcgctgggatgggactgctgctgtggactctgcccaaaccaactcgtcaatga

SEQ ID NO: 13186 - protein, 440 aa, Rhodopirellula baltica; identical to SEQ ID NO: 722

SEQ ID NO: 13187 - DNA, 1335 bp, Helicobacter hepaticus; identical to SEQ ID NO: 719
  CDS (1)..(1335)

SEQ ID NO: 13188 - protein, 444 aa, Helicobacter hepaticus; identical to SEQ ID NO: 720

SEQ ID NO: 13189 - DNA, 1383 bp, Helicobacter hepaticus
  CDS (1)..(1383)
atgcttgtagcgaactcatcgtatgcagatatgtattttactttttttcatagcgaatttggtgcattttttagtgattcgcattttaaggtaagtttgcaggattttatcaatgatgtattaatgtcatttttctttttgctcgtgggtttggaaatgaaacgcgaaatgctctatggggagctggctgggtttaaaaaagtaagtttttcttttctcgcagcatttggaggcattatatgtccagtaatgatttattcatattttaactctggcacagcatatgaaagtggttttggtgtcgcaatgagcacagatacagcctttgcacttgggcttataatgcttcttggagatagagtgcctaagattttgaagatttttcttgtaacacttgctgtagctgatgatttaggggctatttctgtaattgcaattttttattctgataatattaatatgcaatggatttatgcttctttaatccttgttgcagtacttatttatcttaattatcgtgatactaaatatctttcactatattttttggcgggtattttgttgtggttttgtgtgcaccatagcgggattcacgtaacaattgcagcagttattttggcaatggcgattcccgggcgcacacgcgtaaataaaaaatattttatcaatatgcttaaagaatttgaaagaatgaaagtagccacgaatgattggaatgatgtagtctatgcacgtgaatcggagaaggtgggtttttggagaggaagctttaagaatattagaagttttatatttggaaatcaagatgtggaaaaaaagattgatatggcaaaaacttcccaactcgtgcatatgttggatactataggcacatattctcgttatgcacaaaatccgcttatacgtcttgaaattgctctgcaacccatttgcgcttatttttttgttcctctttttgcttttgctaatgcaggtgtaacacttgaaggcaatattgatataagtttaaatagtgttatgcttgggacaattttaggcttagtagtgggcaaacctgtaggtgtattacttttttgttttttaggagagaagttaaatcttgctactcgtccaaaagatttaaattatttgcatattttatctgtgggtatgatttcaggcattggctttacaatgtctatgtttgtggcaaatcttgcctataaagatgatataatgagtattgatatgtctaaaatttctattcttgtagcatcttcaatagcagctgttcttgggcttttggtggtttatcttagcacaattaagcaggataatcagcttgagaatataaatgaagaagatgagattcaaaagcttaaggaaacacaaagtatcatttga

SEQ ID NO: 13190 - protein, 460 aa, Helicobacter hepaticus; identical to SEQ ID NO: 718

SEQ ID NO: 13191 - DNA, 1185 bp, Haemophilus ducreyi; identical to SEQ ID NO: 715
  CDS (1)..(1185)

SEQ ID NO: 13192 - protein, 394 aa, Haemophilus ducreyi; identical to SEQ ID NO: 716

SEQ ID NO: 13193 - DNA, 1197 bp, Bordetella bronchiseptica
  CDS (1)..(1197)
atgcccacgactcctacccgcgctccatccctcctgcaggctttcctgcgctccgaagccctgggcggctatgtgctgatgatcgccgccgtcctggccctgatcgtggccaattcgccgctggcgccagcctatttccagttgctgggcaccaagctgggctatgcatcggaagccttcaccctcaaggagtcggtgctgcactggatcaacgacggcctgatggcggtgttcttcctgctggtcggcctggaaatcaagcgcgagatgctcgacggccagttgcggggcgtgtcgcgcatcgtgctgcccggcgtggcggcggccggcggcatgctgatgccggccctcgtctatctcctggtcaaccagggcgacccggcggggctgcgcggctgggccatcccggcggccaccgatatcgccttcgcgctcggcatcctggcgctgctgggcagccgcgttcccacgtcgctgaagatcttcctgaccgccctggccattctcgatgacctgggcgccatcgccatcatcgcggtgttctataccgccgagctcaatacctccgcgctggccgcggccggcggcttgctggcggcgctgtgcgtgctgaaccgcctgcgcgtgctgcgcctggcgccctatctgctggtgggcgcgctgctgtggtatttcgtcctgaaatccggcgtgcacgccacgctggccggggtggcgctggcgctggccattccgctgcgccgccaggatccgcgccagccgggcgccgagcattcgcccctgcatgcgctggagcacgccctgcaccgtcccgtggccctgctgatcgttcctgttttcggattcgccaacgccggcgtatcgttcgacggcatgggcatcgacagcctgaccgcgcccatcccgctgggcatcgcactgggcctgttcctgggcaagcagctgggcgtgttcggctttgcctggctggccatccggaccgggctggccagcatgccgcgccatgcctcgttcgcgcagctctatggcgttgcgctgctgtgcggcatcggtttcaccatgagcctgttcatcggcgcgctggccttcgacgacgcggccaccatcgacgccaccaagatcggcgtgctgaccggctcgctggtgtcggccgtgctgggctacgcgctgctgcgcgtgctgccgccggccgactga

SEQ ID NO: 13194 - protein, 398 aa, Bordetella bronchiseptica; identical to SEQ ID NO: 714

SEQ ID NO: 13195 - DNA, 1401 bp, Streptomyces avermitilis
  CDS (1)..(1401)
atggccgccccccgcaccagcacccgcaagttcctcggacggctctcgctgcccgagcggaacttcgtcgcggaggcgctgcgcaccgagaccgtcggcggcgtcctgctcctcctcgccgcgatcaccgcgctgatctgggcgaacgtacccgcgctgcaccacagctacgagagcgtcagccacttccacttcggccccgcccccctcggcctggacctctccgtccagcactgggccgccgacgggctgctcgcggtcttcttcttcgtcgccggcatcgaactcaagcgcgagctggtcgcaggggacctcaaggaccccaaggcggccgcgctccccgtggccgccgccctgtgcggcatggccgtacccgcgctcgtctacaccctcaccaacctcaccggtggcggctccctccgcggctgggcggtacccacggccaccgacatcgccttcgcgctggccgtcctcgcggtcatcgggacctcgctcccgtccgcgctgcgcgccttcctgctcaccctcgccgtcgtcgacgacctcttcgcgatcctgatcatcgcggtcttcttcaccgccgacctgaacttcgccgccctcgccggcgccgtgatcggcctcgccgtcttctggctgctgctgcgcaagggcgtacgcggctggtacgtgtacgtgccgctcgcgctcgtcatctgggggctgatgtacaacagcggcatccacgccaccatcgccggtgtggcgatgggactgatgctgcgctgccaccgccaccagggtgaggagcacgctcccggtgagcacatcgagcatcttgtacgccccctgtcggccggcctggccgtgcccctgttcgccctgttcagcgcgggtgtcgtgatctccgggggtgcgctcggggacgtgttcaccaggccggagaccctcggggtggtcctcgggctcgtcgtcggcaaggcgatcggcatcttcggcggaacgtggctgacggcccgcttcacccgcgcgtcgctcagcgacgacctcgcctggcccgacgtcttcgcggtggcgtcgctggccggcatcggcttcaccgtctccctgctcatcggcgaactcgcgttcgacggtgatccggtgctgaccgacgaggtcaaggccgccgtcctcaccggttcccttctggcggcgctgatcgcgacgacgctgctgaagctgcgcaacgccaagtaccgtgccctgtgcgaggacgaggagcgcgacgaggacagcgacggcatccccgacatctacgagcaggacaacccggcgtaccacctgcgcatggccgagatctacgagcgcaaggccgccgagcaccgaaggcttgccgaagtgacgggcggggcaggcgcggagaacgatggtccggcatga

SEQ ID NO: 13196 - protein, 466 aa, Streptomyces avermitilis; identical to SEQ ID NO: 712

SEQ ID NO: 13197 - DNA, 1158 bp, Tropheryma whipplei
  CDS (1)..(1158)
atgagcattattagatctgagcgatattcggcaatttttcttctttgctcggcagcgctagcaattatatttgctaatgttcttgacccggacacatggcatgccgtgcacagcgctgtaagcgaataccacatctttggactgataaccccccatgacatagttgcagatttccttcttgcagttttcttctttgctgttgcaattgagctaaaacacgagcttgtaaagggcgagctgagtagcttttccaaagcaataatccctggggtgtgtgcagcaggtgggatactcgttccaatatctatttatttgtccgttgcaagtgttttgccaaacggatggcctgttccgacggccacagatgttgcattttctcttggcattttggctatttttggctcttcacttccttctaaggtgcgaatattcttattggctcttgctgtcttggatgatctggccggaatagtgataattgccacggcatttagcgtctcgataagttactggtggattattgttgcgtgcattacagttgggctttttgggttttgcagctataggctagccagatgcaagacctcaaagacatttctgatcatccctgcaatgttgctttgtgcgctcgcggcatgggtttctgtttaccagtccggtattcatgcgactatcgctggcgttatgcttggcatcatgctcaatcgtaaacagggtgcggctattgaacacgctcttgagccgtatataaacgggattattctgcccgcgtttgcttttcttgctgcaatggttcgggtaccacatttacctctggatgagataagtccggcgctatggggaattctgcttggtctgttatttggcaaactcctcggaataagcgtttttggcataatagccctgaagttcttcagaaaaaagagtatttcattcttcaacttgcttgtggtaagtgctcttggcggaattggatttacggtgtctttgctcatgaacgagctagcttttttgggaacccctgttcatgaacagggggttattgccgttttgattggttcgcttttgtctgccatattggcaattattctcatgaggtgttataaaggccgtaaatctaagtcattgccaggtacaaagggccgggtcagccattga

SEQ ID NO: 13198 - protein, 385 aa, Tropheryma whipplei; identical to SEQ ID NO: 710

SEQ ID NO: 13199 - DNA, 1176 bp, Pseudomonas syringae
  CDS (1)..(1176)
atgactcaagtcccaaaccgggaaacgccccgtggcgttgccattcttacccgttttctcgcctccgaatcagcgggcggcatcgtgctgatggccgcagcgctggccgcactgatcgtcgccaactcgcccttgtccgcgggctacttctcgacgctgcacagcgtctggctggggctgtcggtcgagttgtggatcaacgacgggctgatggcgatcttctttctgatggtcggtttggagatcaagcgcgaagtgctggccggtggcctggcaacctgggggcaacgcgccctgcccggctttgcagcccttggcggcatgctggtgcccgcgctgatctacatcgcgatcaactggggcaacccgcagaccctgagcggctgggcgatcccggcggccaccgacatcgccttcgccctcggcgtgctgtcgctgctgggcaatcgcgtgccgacctcgctaaaagtcttcctcgccgcgctggcgattctcgatgacctgggggctgtgaccatcatcgcgtttttctacagctccgggcttaatctgccgatgctggccgccgcgttcgtgaccctcgccgtgttggtcgcgctgaaccgcctgaacatccgtcgtctgctgccgtatttgctgctcggtgcgctgctgtggttcttcgtcctgcagtcgggcgtgcacgcgacgctggccggtgtcgcgctggcgctgtgtatcccgatgggcaagcccgaggaagaagcacgctcgccgctgctgttgctggaagaaaaaatgcattactgggtcgcgtttgccgtggtaccgatctttggctttgccaatgccggcgtatcgctttccggcattaccctggcaaacctgatcgacccggtgccgctgggcgttgcattgggcctgtttgtgggcaagcagatcggcgtgtttctcgccgcagtgctggccatccgcgcagggctcgccgtgctgccggagggcagcaactgggtgcagctgtacggcgtggcgatcctgtgtggcatcggcttcaccatgagcctgttcatcggcaacctggcattccccggctcgcagcacctgatcgacgaagtcaaagtcggtgtgctgatcggctcggggcttgcggcggttgccggcatagtgctgctgcgcagccgtttcagccggcactga

SEQ ID NO: 13200 - protein, 391 aa, Pseudomonas syringae; identical to SEQ ID NO: 708

SEQ ID NO: 13201 - DNA, 1179 bp, Pseudomonas syringae
  CDS (1)..(1179)
atgcacaaccccaccccccgtaccgaatccccgaacgcgctggcgttcatcaagcgctttttcgccgccgaagccgctggcggtctgattttgatggcggctgcactggctgccctgatcgtcgccaattcgccgttggctgacagctattttgcagcgctgcacaccgtgctcgccggcatgtcggtagagcactggatcaacgacggcctgatggcaatcttcttcatgctggtgggccttgagatcaaacgcgaaatgctggcaggccagcttgcgtcctggagtcagcgcgccttgccgggctttgcggcgctgggtggcatggtggtgccggcgttgatctacgtggcattcaactggggccagccagaaaccatcggcggttgggccatcccggctgcgaccgacatcgcctttgccctgggtgtgctttctctgctcggcaaacgcgtaccgttgtccctgaaaatcttcctgtcggcattggcgattctcgatgacctcggcgcggtattgatcatcgcgctgttctacaccagtgatctgtccatccccatgctgctggcggcgctgggctccatcgccgtactcgtggcgctgaaccgtctgggcgttaaaaagctgttgccgtacctgctcatcggcgcgctgctatggtttttcatgctccagtccggcattcacgccacccttgcaggtgtggccctggcgctgtgcattccgctcggcaaagctgatgaagaagccagctcgccactgcttcatctggaagagaaactgcacccgtgggtcgcttttgctgtggtaccgatcttcgggttcgccaatgcgggcgtgtcgctggccggtatcaccgtcgacaaactggtagacccggtgccgctgggcgtcgcgctggggttgttgatcggcaaacaggtcggcatcttcgcccttgcggcactggccatccgcgccggcctggcacgcttgcctgacggcagtaattggggtcagctttacggcgtcgcggcactgtgcgggatcggtttcaccatgagcctgttcatcggcgcactggccttcccgggcgcgccggcactggtggacgaggtcaaggtgggcgtgttgatcgggtcggtgttttcggcgttgttgggggtggtggtgttgcgcaggtttggggcgcgggggtga

SEQ ID NO: 13202 - protein, 392 aa, Pseudomonas syringae; identical to SEQ ID NO: 706

SEQ ID NO: 13203 - DNA, 1362 bp, Pseudomonas putida
  CDS (1)..(1362)
atgcataaacaagaattacctcgcgcccagaaactggccgagcgcgccttcgccaaccttgaacgctttttgcacattgaagcggtcagcggcatcgttctgttgattgccgcagtcgctgccctgatctgggcgaattccccggctgccgacagttatgaagccctttggcataccccgttgacgttcggcgtgggctcgcatgtctattcgcagtccctgcatttctggatcaatgatggcctgatgaccatctttttcctggtcgtgggcatggagatccgccgcgagatccacgaaggtgcactgtccagcctgcgtcaagccacgcttcccatggcagccgctgtcggcggcgtagcggtacccgcactcctctacctgagttttggtcacgcgccagcagaccaacaaggttgggccgtgccaacggcgacggatatcgcctttgcggtgggcgtattggccctgctcggcaagtcgatcccgtccaacgtacgtgtattcctcctcgccctggcaatcatcgatgacatcatcgcagtcctgatcatcgcgttcttctactcaggcggccttgattacaccggcttcggcgttgcagtgatcggcctgctaatggtgatcgggcttcagaagatcggagtgggttcagcctacgcctatgtcattcccggtgcgatcgtctggctgggcatcttgttgaccggcgcccacccgaccctcgcaggcgtcgtgctgggcctgatgacacctgtcaccgcaatgccgatgcgtgagcgcccactggacgccattacccgcttcaccggcgaattgctggggcgcgccaaagcgcctgagcaagatgccagcgacctcatggacccgttgaaacgactgcgcctggcccagcgcgaactgctgccgccggtagtgcgcatgcaaggcaccctgcacccctgggtagccttcggcatcatgccggtgtttgccttggccaacgccggggtcagcctttcgggcgtcgacctgtccgcagaaggcccccagtgggtcatgatcgccgtcgctgtcgccctggttgcaggaaagcccttgggcatcgtcagcgtcagttggctgatggtccgcctgggctggtgcgtgcttcccgccgaggtcaactggcgtagcatcatgctggtcgggctgctggccggcatcggtttcaccatgtcgatcttcatcgccaacctcgcgttcgtcgaccctggctcacttggggccgcgaaactcggtgtgctatccgcgtcgttgatcgcagccgtgctggggttgacctggggggtgtggagcatgcgcagcgcagcgtctgctaccaaagccggttcgcccacctag

SEQ ID NO: 13204 - protein, 453 aa, Pseudomonas putida; identical to SEQ ID NO: 704

SEQ ID NO: 13205 - DNA, 1194 bp, Pseudomonas putida
  CDS (1)..(1194)
atggagggcctacagcccgtgcgtagcctgtttacccgtttcttccagctcgaagccgccagtggcctgctgttgatcgccgccgccgttctggccctgatcatcaacaactcgccactgtcctacctgtacggcggcttgctcgaggtacccgtcgccgtccaggtcggcgcgctgaacatcgccaagccattgctactgtggatcaacgacggcctgatggccctgttcttcctgctcatcggcctggaggtcaaacgcgaggtggtcgacggtcacctgtccaagccctcacaagtgattctgcctgccaccgcagccgtgggcggcatggtggtgccagcgctgatctactggttcatcaaccgtgacaaccctgcagccgtggcaggctgggcgatccctaccgccaccgacatcgccttcgccctcggcgtcctggccctgctcggcaagcgcgtaccagtgtcactgaagttgttcctgatgaccctggcgatcatcgacgacctgggtgcgatcattgtcatcgccctgttctactccggcaccctgtcgagtgtgtcgctgctgctggctgcggcctgtctgctggtgctggtggcgatgaaccggcttggcgtgatcaagcttggcccctacatgatcgttggcctgatcctgtgggtttgtgtgctcaagagtggcgtgcatgccaccttggccggtgtcgcgctggccttttgcatcccgctgcgtacacgcaatgctgaatcgtcgccgctgctggcgctggaacatgccctgcacccctgggtggcctatgccatcctgccaattttcgcctttgccaatgccggcgtttcgctggcaggcatgaccgtagacagcttcacccaccccgtgccgatgggcatcacgatcggcctgttgctgggcaagaccgtgggggttttcggcctgacctgggtggcggtcaagctgcgcctagccgcgctgcctgcgggcgctggttgggggcaaattctgggggtggcgatactctgcggcattggctttaccatgagcctgttcgtaggctcgctcgccttcgccccgggtagcagtgagtacgccggcatggaccgcatgggcattcttactggttcgttctttgctgcggtgatcggctacgccgtcaccgcaatggccagccgcaaaaccagcattgcctga

SEQ ID NO: 13206 - protein, 397 aa, Pseudomonas putida; identical to SEQ ID NO: 702

SEQ ID NO: 13207 - DNA, 1320 bp, Bacteroides thetaiotaomicron; identical to SEQ ID NO: 699
  CDS (1)..(1320)

SEQ ID NO: 13208 - protein, 439 aa, Bacteroides thetaiotaomicron; identical to SEQ ID NO: 700

SEQ ID NO: 13209 - DNA, 1191 bp, Wigglesworthia glossinidia brevipalpis; identical to SEQ ID NO: 697
  CDS (1)..(1191)

SEQ ID NO: 13210 - protein, 396 aa, Wigglesworthia glossinidia brevipalpis; identical to SEQ ID NO: 698

SEQ ID NO: 13211 - DNA, 1344 bp, Vibrio vulnificus; identical to SEQ ID NO: 695
  CDS (1)..(1344)

SEQ ID NO: 13212 - protein, 447 aa, Vibrio vulnificus; identical to SEQ ID NO: 696

SEQ ID NO: 13213 - DNA, 1170 bp, Vibrio vulnificus
  CDS (1)..(1170)
atgaacgatgtcattcgtgactttttcaaaatggaatctgctggtggcattttgcttgtgatcgctgccgcgatcgcaatggtgattgcaaactcgcctctcaatgaaagttaccaagcggttttgcatacttatgtatttggcatgtcagtatctcactggatcaatgatggcctaatggcaattttcttcttgctgatcggcttggaagtcaagcgtgaattattagaaggcgcattgaaatcgcgtgaaacggcgatcttcccagcgattgccgcagtgggtggtatgttggcgccagcgcttatctatgttgctttcaatggaaacgatccggaagcgattaaaggttgggcaattccagcagcgaccgatattgcatttgctttgggtatcatggcgctgctaggtaagcgcgttcctgtcagtcttaaagtgttccttttggcattagcgatcatcgatgacttgggcgtcgttgtgattattgcgctcttctacagtggcgatttgtcgacacttgcgttgacggttggattcgcgatgacgggtgtcttgttcatgctaaacgctaagaatgtgacaaagttaatttggtatatcgttgtcggctttatcttgtgggttgcggtactgaaatccggagtccatgcaaccttggcaggtgtcgtgattggtttctctatcccattacagggtaaaaaaggtgagcactctccgttgaaacacatggaacatgcgcttcacccatatgttgcctttgctatcttacctgtctttgcctttgctaacgctggtatctcgcttgaaggggtgtctctttctggcttgacttccatgttgccgctgggtatcgcgctaggactattggttggtaaaccactgggtatctttacgtttagctgggcagcggtgaagtttggtgtggctaaattgcctgaaggtgtgaacttcaagcatatctttgccgtgtcagtgctctgtggtatcggtttcaccatgtcgatctttatttcatcgctggctttcggtggtgcaaatccagacttcgatacttattcacgactaggtatcttaatgggatcgacgacagcggcagtgcttggttatttcttactgcatgtatcgctgccaaagacagcggcggaaagtgagaaagcaatcagctaa

SEQ ID NO: 13214 - protein, 389 aa, Vibrio vulnificus; identical to SEQ ID NO: 694

SEQ ID NO: 13215 - DNA, 1170 bp, Shewanella oneidensis; identical to SEQ ID NO: 691
  CDS (1)..(1170)

SEQ ID NO: 13216 - protein, 389 aa, Shewanella oneidensis; identical to SEQ ID NO: 692

SEQ ID NO: 13217 - DNA, 1167 bp, Escherichia coli O6
  CDS (1)..(1167)
atgaaacatctgcatcgattctttagcagtgatgcctcgggaggcattattctcattattgccgctgtattagcgatgattatggccaacagcggtgcaaccagtggatggtatcacgactttcttgagacgccggttcagctccgggttgggacacttgagatcaacaagaacatgctgctatggatcaatgacgctctgatggcggtatttttcctgttggttggtctggaagttaaacgcgagctgatgcaaggttcgctggccagtctgcgccaggcggcatttcctgttattgccgcaatcggcgggatgattgtcccggcattgctctatctggcttttaactatgccgatccgattacccgcgaaggctgggcaatcccggcggcgactgacattgcctttgcacttggtgtgttggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgtggtattgaatctgtgtggtgtacgccgcacgggcgtttatattctggttggcgtggtgctgtggacagcggtgttgaaatcgggggttcacgcaaccctggctggcgtcattgtcggcttctttattcctttgaaagagaagcatgggcgctctccggctaaacgtctggagcatgttttgcatccatgggtggcgtatctgattttgccgctgtttgcatttgctaatgctggcgtttcactgcaaggtgtcacgctggaaggtttgacctccatcctgccattagggatcatcgctggtttgctgattggcaagccactgggtattagtctgttctgctggttggcgctgcgtttgaaattggcacatctgccagagggaacgacttaccagcaaattatggcggttggtatcctgtgcggtatcggttttactatgtctatctttattgccagcctggcatttggtagcgtagatccagaactgattaactgggcaaaattaggtatccttgtcggttcaatttcttcggcggtaattggatatagctggttacgcgttcgtttacgtccatcagtttga

SEQ ID NO: 13218 - protein, 388 aa, Escherichia coli O6; identical to SEQ ID NO: 690

SEQ ID NO: 13219 - DNA, 1182 bp, Brucella suis; identical to SEQ ID NO: 687
  CDS (1)..(1182)

SEQ ID NO: 13220 - protein, 393 aa, Brucella suis; identical to SEQ ID NO: 688

SEQ ID NO: 13221 - DNA, 1419 bp, Bifidobacterium longum
  CDS (1)..(1419)
atggccacgaccgccggcgcgaagaagggactttggtccaccatcaggcgaatcgccgcctcagaccgtatttccggactcatcatgcttggcttcgcgctcaccggcctggtgctcgcgaatctgcccgccaccgcgcatgcgttcgagaccgtagcggaaacgcatctgttcatcccctacaccaatctcgacctgcctattggccactgggcccaggatggtctgcttaccatcttcttcctgaccgtgggcctcgaactgaagcaggaactcaccaccggctcgcttgccaatccgaaagcggccgccgtgccgatgctgtgcgcggtgggcggcatgatcgccccgcccatcctgttcctggccgtcacggcattgttctctcagatcgggcctggtgaacccggcacgctgattctgaccaccaccggcagcagcatcccgttctcggagatgtcgcacggctgggcagtgcccaccgccacggatatcgcgttctcgctggccgtgctcgccctgttcgccaaggccctgcccggttcgatccgcgcgttcctgatgacgcttgccaccgtcgacgacctgctggccattattctgatcgccgtattcttctcctcgattaacgcctggtattggttcatcggcatcgccgtatgcgccgccatctgggcatacctcgtacgactgaaaaaagtgccgtggatcgcggttggcatcgtcggtatcctcgcttggatcatgatgttcgaggcaggcgtgcaccccacactggccggcgtgctggttggcctgctgaccccctctcgtgaaatgcacggcgaactctcgccgcgtgccgaacgctatgccaacaagctccagccattctccgcactgctggccctgcccatcttcgccttgttcgccaccggcgtacacttcgagtcgatgagcccgctattgttggcctcgccgctggtcatcgcactgattgtggctttggtggtcggcaaacctctgggtatcatcaccaccgcatggctgtccacgcatgtgggcgggctcaagatggccaaggggctgcgtgtgcgcgacatgattcctgctgccgtcgcttgcggcattggcttcactgtgtccttcctcatcgcttcgctggcgtacaagaacgcggaactttccgctgaggcgcgcttcggcgtgctggtggcctccctgatcgccgccgcgatttccggtgtgctgctgagccgtcagtccaagcgattcgagaagaccgcagccgcagcagcggctgatgaggaggatgacgaatcgattgatggtgatggcatcgggcagccaagccacaccacagagcccaccacgcccacggaacaccccggcaccctcgccgacggcaccgccagtgtggaaatcgacttccgccactga

SEQ ID NO: 13222 - protein, 472 aa, Bifidobacterium longum; identical to SEQ ID NO: 686

SEQ ID NO: 13223 - DNA, 1167 bp, Salmonella typhimurium; identical to SEQ ID NO: 683
  CDS (1)..(1167)

SEQ ID NO: 13224 - protein, 388 aa, Salmonella typhimurium; identical to SEQ ID NO: 684

SEQ ID NO: 13225 - DNA, 1891 bp, Gamma
  CDS (406)..(1590)
gaattcagggcgtttcaccgcttcggtgttgatggacgccttgtctgccccggccagcagcaatttgcggatgtcgtcaagcgcgcgcacgccgccgccgacagtaagcggcatgaagcactgctcggccacgcgcgccaccacgtcgtaaagcgtcgcgcggttgtccgacgatgccgaaatatcgaggaagcatagctcatctgcaccctgtgcatcgtagattttagcctgttccaccgggtcgcccgcatcgcgcaggcctacaaaattcacgcctttgaccacgcggccatccttcacatcgaggcaggggataattcgggttttaagcatcggttttgattacattctggtcgtttatggggtaaaagccttttaatactgctacgaaggcttgtcaccatgataaatacaccggatccctccaaacgcgcattgattctgcgcctgcttgagcggttcatacaaacggaatcctccggcggcgtgattatgatcattttcgcggcgctcgccatgattgccgccaattcggcgctcgccggctggtatggcgcgtttgtagatgcgccaatcacgcttggcagcatcaccgagcccgtaaacggctgggtgaaggacgtgctgatggtgctgtttttcctcactgtcggcatggagctgaaacgcgagatggcggaagggttgctggcgcagaaaggccaggtgtttatgccgctgcttgccgccattggcggcatggctgttccggcgttattattctatgcgctcaatcattccaatcccgaaaccgtcaagggctgggctatcccttccgctaccgacatcgcattcgctttatgcatcctgatgatgtttggcaagtccgtgcccgcttccgccaaaatcctgctgcttgccatcgccattttcgacgatctgggcgcgattatcatcatcgccctgttctacaacaccaaaatcgccgtggttcccctgctcttcaccgcaggcggcgctggcctgctggcactgctcaaccgctgcaagatttccgccattacgccctatatcctcaccggaatttatttgtggttctgcctgcatgaagcgggcatccacacaacgattgcaggtgtggctgtcggcatggccatccccatgcgcgaccgcaaacattccagcaacagcccgcttaacaaatgcatgcatttcctgcatccgtgggtgagtttcggcgtgctgcccatttttgccttcgtgagcgccggggttaacttcgcggatatgcatctatcggaattgtttgaaccgcttccccttggcatcgcactcggcctgttcgtgggcaagcagatcggcatattcggcatgattttcctgctggtaaaggcagggctggcgaaactccccgaaggcacgggtttcggccatgtctacgccgtctccatcatcgcaggcatcggcttcacgatgagcctgttcatcagcctgctcgcctttcccggccaccatctgcaggaagtggccaaaatcggcgtgattgcggggtcgctgctttcgacgctttatggtgggttagtgttgttctgcgtgagcaaacgctagcttttccgcatgtttcattgtatcacgcgcgcctatggcaccgcgtaatcttatatcgcttgaagacgtcaccctcactttcgggggtaagcctctgtttgagcagatacggctcaacatcaacgatggcgacaaaatctgccttgtcggccgcaatggtgctggcaaaaccacgctgatgcgcatcctgatgaacgagttggaacttgacggcggcaagcgctccgccgtgcccggcattaccatcggctaccttgcccagaaggtgttttaccaacatacgcacaccgtgcgcgaattc

SEQ ID NO: 13226 - protein, 394 aa, Gamma; identical to SEQ ID NO: 676

SEQ ID NO: 13227 - DNA, 1443 bp, Streptomyces antibioticus
  CDS (1)..(1443)
atggccgcgccccgcaccccgaacaccgcccgcaaggttctcggacgcctgtccctgcccgagcggaccttcgtcgcggacgcgctgcgcaccgagaccgtcggcggtgtcctgcttctcgtcgccacggtgacggcgctggtctgggcgaacatccccgcactgcagcacagctacgaggcggtcagccacttccacttcggcccgagcgccctcggcctgaacctgtccgtggcccactgggccgccgacggcctcctcgccgtcttcttcttcgtcgccggcatcgagctcaagcgcgagctggtcgccggggacctgcgcgaccccagggcggcggtgctgcccgtggtggccgcgctgtgcgggatggccgtaccggcgctcgtctacaccctcaccaacctcaccggacacggctccacccagggctgggcggtgcccaccgccaccgacatcgccttcgcgctcgccgtcctcgcggtcatcggcacctcgctgcccagcgccctgcgcgccttcctgctcaccctcgcggtcgtcgacgacctgttcgcgatcctgatcatcgcgatcttcttcaccgagcggatcaacttcgcggcgctcggcggggccgtcgccgggctggcggtcttctggctgctgctgcgcaagggcgtacgcggctggtacgtgtacgtgccgctggccgtcgtcgtctgggcgctgatgtacaacagcggcgtgcacgccaccatcgcgggcgtggcgatgggcctgatgctgcgctgcaccacccgtgagggtgaggagcactcgccgggcgagcacatcgagcacctggtgcggccgctgtcggccgggctcgccgtaccgctgttcgcgctgttcagcgccggggtggtggtctccggcggggcgctcggggatgtgttcaccgagccggagacgcttggggtggtgctcgggctggtcgtgggcaagacgctcggcatcttcggcagcacctggctgacggcccgcttcacccacgcggagctcagcgaggacctggaatgggccgacatcttcgcggtggcctccctcgccggaatcggcttcaccgtctcgctgctcatcggcgagctggccttcgcgggcgacacgctgctgaccgacgaggtgaaggcggccgtcctcaccggatcgctgatcgcggccctgtgtgccacggtgctgctgaagatacgcaacgcccgctatcgcgggctgtgcgaggacgaggagcgcgacgaggaccgggacggcattccggacgtctacgagcaggacgacccggcctaccacctgcggatggcggacatcttcgagcgcaaggccgccgagcaccgccgcatcgccgccgagaaggccgccgcggcgcgccacgggggtgcggaagtgccgggcggggcaggcgaggaggacggtcgtccggcatga

SEQ ID NO: 13228 - protein, 480 aa, Streptomyces antibioticus; identical to SEQ ID NO: 674

SEQ ID NO: 13229 - DNA, 1197 bp, Rhizobium loti
  CDS (1)..(1197)
atgcaggatttgaagcagcggccggtttccgtctttcgcgaattcctcgacagcgaggcggccggcggtatcatcctgatggtggcggcggcactcgccttgatcgtcgccaactcaccgctcgccgaaacctatttctccgttctccatgcctatctcggcccgctcagcgtctcgcattgggtcaatgacgggctgatggcggtgttcttcctgcttgtcgggctggagatcaagcgcgagatgctggacggccagctgtcgacctggccacgccgcgtcctgcccggcatcgcggcggccggcggcatgctggttccggcgctggtctatgtcttcatcaaccgcaacaattcagccgcactctcgggctgggcgatcccgaccgccaccgacatcgccttcgcgctcggcgtgctgtcgctgctcggcagccgcgtgccggcttcgctgaaagtcttcctgaccgcgctcgccatcatcgacgacctcggcgccgtcatcatcatcgccatcttctatacgagcggcctgtcgctggcctatctcggtgccgccttcgccgtcattgcagcgcttgtcgtgctcaaccgcatgcgggtgatgacgctgctgccctatctcgtgctcggcgccatcctgtgggtgctggttctcaagtcgggcgtccacgccacgcttgccggcgttgcgctggcgctgaccattccgctcgagcgctctgccggggtcggccacgatctcgatcattcgccgctgcaccggctcgagcatggcctgcacaaaatcgtgccctttttcgtcatcccgatcttcggcttcgccaatgccggcgtttcgctcgccggcctcagtcttggcgcgctgatcgagccgctgacgctgggcgtcgccgccggccttgttgtcggcaagctcgtcggcgtgttcggctcttcggcgcttgccataaggctcggcctggccgacctgccggcccataccggctggtcacatatgatcggcatctcgctgctctgcggcatcggcttcaccatgagcctgttcatcggcctgctcgccttcgccagcgatgtggctctgcaggacgcggtcaaggtcggcatcctcgccggctccttcgtcgccgccatactcggcgccgccgtgctgctgatggcgccggctgcgggtgttgcggaagaagagacggagtag

SEQ ID NO: 13230 - protein, 398 aa, Rhizobium loti; identical to SEQ ID NO: 682

SEQ ID NO: 13231 - DNA, 1140 bp, Pasteurella multocida
  CDS (1)..(1140)
atgttaacaccaattcaaaactttctgaaacaagaagcggcaggtggtattctgctgttcatttttgcaaccttagccattattttagccaataccccattaagttatttatactttgattttttgcaaacaccagtgagtgtccaaattggtgcattcatcatcaataaaccgcttttaatgtgggtcaacgatggtcttatggccgtgtttttcatgctcgtcggaatggaagttaaacgtgaattactagaaggctcgttatccagttatcaacgtgctgtttttcccgccattgcggcaacaggcggtatggttgttcctgcaattgtctttcttgtgtttaacgcaacacatcctgaatttcaagagggatgggcgatcccgatggcaacggatatcgcttttgcccttggcgtcatcgccttattaggtaaacgtgttccactcgcgctgaaaattttcttgttggcactggcgattattgatgacttaggggcgattgttgttattgcgctatttttctctcatgatttaagtccacaagcctttatcttcgcggggattgctgtggcaattttgatcacaatgaaccgtttaaaaattactgcactctcggcttacggcattgtcggtattattctttgggcatccgtactcaaatcaggtgtacacgccactttggcgggagtgattatcggtttttgtatcccattaaacggtaagaaaggcgagcgcccactagatgactttgaacatactttatcaccttggagtgcctttgcgattctcccactgtttgctttctgtaatgctggggtttcattaattggtatgggaatggataacttaacctctacgttaccaatggggattgcccttggcttactcttaggtaaacctctggggattttctcattctgttttgtggcagtaaaattaggcattgctaagctgtctgaaggcattaatttcaaacaaatttttgctgtgtctgtactctgtggaattggatttaccatgtccatgttccttgctggtctcgcctttggtggagaaagtgatagcgaaaatgtcactgcactcgcccgtttaggtattctgattggttctggtttctccgcggtgttaggttattga

SEQ ID NO: 13232 - protein, 379 aa, Pasteurella multocida; identical to SEQ ID NO: 680

SEQ ID NO: 13233 - DNA, 1425 bp, Streptomyces coelicolor
  CDS (1)..(1425)
atgaccgcgccccgcaccccccgcaaagccttcggacggctgtccctgccggagcgcacctacctcgcggacgcgctgcgcaccgagaccgtcggcggcgtcctgctgctcgtcgccgcgatcgccgccctggtgtgggcgaacataccggcgctgcacgacagctacgagagcgtcagccacttccacttcggtcccgcggccctcggtctgaacctgtcggtcgcacactgggccgccgacgggcttctggcgatcttcttcttcgtcgccggcatcgaactcaaacgcgaactggtcgccggtgatctgaaggaccccaaggccgccgcgctcccggtggtggcggcgctgtgcggcatggtcgtaccggcggtcgtctacaccgtcaccagcaccgcgggcggcggctccctgtccggctgggccgtgccgaccgccaccgacatcgccttcgcgctcgccgtactcgccgtcatcggcacgtcgctgccgagcgcgctgcgcgccttcctgctgacgctcgccgtcgtcgacgacctgttcgccatcctgatcatcgcggtcttcttcaccgagaccctgaacttcgccgcgctgggcggcgcggtcgtcggcctcgcggtcttctggctgctgctgcgcaagggggtgcgcggctggtacgtgtacgtgccgctcggcctggtgatctgggccctcatgtacaacagcggcgtccacgccaccatcgccggcgtcgcgatgggcctgatgctgcgctgccaccggcgcgagggcgaggaccactcccccggcgagcacatcgaacacctggtgcgcccgctgtcggcgggcctggccgtgccgctgttcgcgctgttcagcgcgggtgtggccatcaccggcggggcgctggccgacgtgttcaccaagccggagaccctcggtgtcgtactcgggctcgtcgtcggcaagacgctgggcatcttcggcggcacctggctgacctcgcgcttcaccagggcttcgctcagcgacgacctccagtgggccgacgtgttcgcggtggcgaccctggccggcatcgggttcaccgtctcgctgctgatcggcgagctggccttcgaggacgacgcggcgatgacgagcgaggtcaaggccgccgtcctgaccggctcgctgatcgcggcggccctggccacggtgctgctgaagatacggaacgcgaagtaccgggggatggtcgcggaggaggagcgcgacgacgacctcagcggtgtccccgacatctacgaggaggacgaccccgcgtaccacctgcgggtggccgccatctacgagaagaaggccgccgagcaccgccggatcgccgaggagatggagtcggcgcggcttgccgaagtggcgggcggggcaggcgatgagggcgacggtccggcatga

SEQ ID NO: 13234 - protein, 474 aa, Streptomyces coelicolor; identical to SEQ ID NO: 660

SEQ ID NO: 13235 - DNA, 1233 bp, Streptomyces coelicolor
  CDS (1)..(1233)
atgtctgctccctcgcggatcactgctgccctgcgctcagacgcggtcggtggctctctgctgatcggcgccgccgtcatcgcgctcatctgggcgaactcgcccctgtcccactcctacgaggccctgcgctcgttcaccttcggcccttccgccctccacctgaacctgtccgtggagacgtgggcggcggacgggctgctggcggtgttcttcttcatcgtcggcaacgagctgaagcaggaactcgtccacggcgagctgcgcgacccacgccgcgcggccctgccgatcgccgccgcgctcggcggcgtcgccgtgcccgccctggtcttcctggccttcaccctcggctccggcggggaggcggccggaggctggggcatcccgatggctaccggcatcgccttcgccgtggccgtcctggcggtggtcggccggcacctgccgacgccgctgcggaccttcctgctcaccctggccaccgtggacgacatgtccgcggtcctggtcatcgccgtcgcctgcaccagcggcatcaacttcaccgccctcgccttggctgccgtcggcctggccgtgttcggctacttgcagaacgggtccgggcgggcggtggcccgggtgcgcgcgatggtcccggcgtggctgctgttcgtgccgctggccgcggtcgtctgggcgctgatgcacgcctgcggtgtacacgcgaccatcgccggggtcgtcatgggcctgttgatgcgcacccgcccccagggggcggagcgggtgtcgccctcgcaccgcgcggaggaggtcttgcgcccgttctccgccgggatcgcactgccgctcttcgcgctgatgtcagccggcgtctccctggccggggcgggaggcttcgtcacctccgccatcacctggaacgtcctcgccggcctgctcgtgggcaaggtcgtcgggatcttcggcggcacctggccgaccagccgcctcaccagcgcccacctcaacccgctgctcggctgggccgacatcgccgggatcgccgtgctgggcgggatcggcttcacggtctccctgccgatcgccgaactctcctccaccagccaggcgcatctcaccgacgccaagggcgccatcctcctggcctccaccaccgcggccctgctcgccgcgctcctgctgggccgccgcagccgccaccaccagcgcctcgcccgccaggccgcgcagcaggcgacgacgtga

SEQ ID NO: 13236 - protein, 410 aa, Streptomyces coelicolor; identical to SEQ ID NO: 658

SEQ ID NO: 13237 - DNA, 26 bp, Primer
atgaaacatctgcatcgattctttag

SEQ ID NO: 13238 - DNA, 25 bp, Primer
ttaaactgatggacgcaaacgaacg

SEQ ID NO: 13239 - DNA, 1017 bp, Saccharomyces cerevisiae
  CDS (1)..(1017)
atgaatagcgtaaaaagagtaaagctaaattcaaaaatgtccaaacaaatatgcacgcattccggatcttttcacgcggacgagtcgttggcggtatacatgttaaggctactacccgaatttaaagatgctaagttggttagatcaagaaatcccaaggactgggaggctagtgacattctagtggatgtaggagctcagtatgacggcgtgaaattttttgaccaccaccagcgtggatttttcgaaactttcaacgagaaatacaagactaagctctcaagtgctggtctgatcttcaaacactacggtcgtgacattatcaaaacaattttgaacaacaaggttagcagctctgatttagatctgctctatgacaaggtatacaaacaatttgtcgaggcactggatgcaaacgacaacggtattagcaagtacacgattcctaaggattccaacttggaaccgaatttcagggataacgccatcagcattcccgggattatttcaggtatgaatcctaactggaacgaagacacttccgatgagtcttttgacagatgctttgctcgcgcaagtgagtttatcggtggggtctttgtcacattggtaagaggctacggtcaatcgtggttgccagccaaggcccttgtggcgcaagccattgatgaaagaatggatgttgataagagtggcaaaatcattgtcttgccccaattctgtccatggaaggagcatctatacgagctggaaagagagaagaacattgaaaagcaaatcgagtttgttctcttcacagactcttctggtgcctggagggtatctactgtaccaatcaactccacctccttccagtttaggagaggtttgccggagccattaagaggcctcagagacgaagagctgagcaccaagagcggtgtgccaggatgtatcttcattcatgcagcaggtttcattggaggtgccaagtccaaagaggctgtatatgagctggctaagatgtctttggcctag

SEQ ID NO: 13240 - protein, 338 aa, Saccharomyces cerevisiae
MNSVKRVKLNSKMSKQICTHSGSFHADESLAVYMLRLLPEFKDAKLVRSRNPKDWEASDILVDVGAQYDGVKFFDHHQRGFFETFNEKYKTKLSSAGLIFKHYGRDIIKTILNNKVSSSDLDLLYDKVYKQFVEALDANDNGISKYTIPKDSNLEPNFRDNAISIPGIISGMNPNWNEDTSDESFDRCFARASEFIGGVFVTLVRGYGQSWLPAKALVAQAIDERMDVDKSGKIIVLPQFCPWKEHLYELEREKNIEKQIEFVLFTDSSGAWRVSTVPINSTSFQFRRGLPEPLRGLRDEELSTKSGVPGCIFIHAAGFIGGAKSKEAVYELAKMSLA

SEQ ID NO: 13241 - DNA, 903 bp, Chlamydophila pneumoniae, Chlamydia pneumoniae
  CDS (1)..(903)
atggaggattggctaaggaggatagtaggtatgcagattccaagaagcattggtactcacgatggttctttccatgcggatgaggtcacagcgtgtgctctccttattattttcgatcttgtggatgaaaataaaattatacgctctcgagatcctgtcgtattatcgaaatgtgaatatgtttgtgatgtcggtggtgtttattctatagaaaacaagcgttttgatcatcatcaagtctcttatgatggatcttggagtagtgcaggtatgattctgcattatcttaaagagtttggttatatggattgtgaagaatatcatttccttaacaacactttggtacatggtgtggatgaacaagataatggcagattcttctctaaggagggattttgttcgttttctgatattattaaaatttataatcctcgcgaggaagaagaaactaattcggatgcggatttttcttgtgctttgcattttaccatcgactttttgtgtcggctaaggaagaagtttcagtatgatcgagtttgtagggggattgtcagagaagccatggaaaccgaggatatgtgtttatattttgatcgtcctttagcatggcaagaaaatttcttttttttagggggagagaagcaccctgcagcttttgtttgttttccttcctgcgatcaatggattttacgagggattcctccgaatttagatcgccgtatggaagttcgtgttcctttccctgagaattgggcaggtttgttaggtaaagagttgtccaaagtatcagggattcctggggctgtgttctgccataaaggtcttttcctttctgtatggacaaatagagaaagttgccaacgtgctttgcggttaacgttacaagatcgagggatcatatga

SEQ ID NO: 13242 - protein, 300 aa, Chlamydophila pneumoniae, Chlamydia pneumoniae
MEDWLRRIVGMQIPRSIGTHDGSFHADEVTACALLIIFDLVDENKIIRSRDPVVLSKCEYVCDVGGVYSIENKRFDHHQVSYDGSWSSAGMILHYLKEFGYMDCEEYHFLNNTLVHGVDEQDNGRFFSKEGFCSFSDIIKIYNPREEEETNSDADFSCALHFTIDFLCRLRKKFQYDRVCRGIVREAMETEDMCLYFDRPLAWQENFFFLGGEKHPAAFVCFPSCDQWILRGIPPNLDRRMEVRVPFPENWAGLLGKELSKVSGIPGAVFCHKGLFLSVWTNRESCQRALRLTLQDRGII

SEQ ID NO: 13243 - DNA, 948 bp, Agrobacterium tumefaciens
  CDS (1)..(948)
atgacccccgacttcctcgtcacccattccggcggctttcacgccgacgaactgctgtccagcgtcgtgttgacacggctttttccgcaggcccggctcgtccgcagcagagcccccgaatggataacgcctgatgcagaccgcatcatctacgacgtgggcggcgcttatgacgccgaaaaatgcattttcgatcaccatcagcgtggtgcgccgctgcgcgaggacggtcagccctatagttcgttcggcctgatctggaagcatttcggacgcgactaccttgccacatcaggcattcctgaagatcatgtcgaaactctgcacgcgtctttcgatgcaggatttgtattgccggtggatctggtcgataacggcgccctcagcccctccattgccggaccacttgccacgctcacgctgcccgtcctgctggagactttaaagcctgtcttcgatgacaccgatcccgaagcggacgatcgcggttttatagccgcgctggcagtcgcgcgcagcttcgtcgaggcgaaactggccacaggcgctgccaaattgcgcgccgaagcactggtgcagaaggcgatcgccgatactggcgaagggcatatccttgagctgccgatgggcatgccatttcggtccgccatcgtaaaagccggcgccgaccacctgctctttgtcgtccatccccgggacaacgactggtgccttaccggcatccgccgcgcggatgaaggttttgaactgcgagccgacctgccagcggcctgggccggcctgacgggcaaagagttggaagcggtttgtggcgtcgaaggcgcgagcttctgccacaatggccgctttatcgccgcagccaaaacccgcgaggcgattttgaccatggcggaactggcagtgaaagaggctctcgcctccgcgcaaacaacagcggcgaagcaataa

SEQ ID NO: 13244 - protein, 315 aa, Agrobacterium tumefaciens
MTPDFLVTHSGGFHADELLSSVVLTRLFPQARLVRSRAPEWITPDADRIIYDVGGAYDAEKCIFDHHQRGAPLREDGQPYSSFGLIWKHFGRDYLATSGIPEDHVETLHASFDAGFVLPVDLVDNGALSPSIAGPLATLTLPVLLETLKPVFDDTDPEADDRGFIAALAVARSFVEAKLATGAAKLRAEALVQKAIADTGEGHILELPMGMPFRSAIVKAGADHLLFVVHPRDNDWCLTGIRRADEGFELRADLPAAWAGLTGKELEAVCGVEGASFCHNGRFIAAAKTREAILTMAELAVKEALASAQTTAAKQ

SEQ ID NO: 13245 - DNA, 876 bp, Chlamydia muridarum, Chlamydia trachomatis MoPn
  CDS (1)..(876)
atgagaatgcaaattccaagaagtgttggcacacatgacggttcttttcacgcagatgaagtgacggcttgcgctttgttgattatgtttgaccttgttgacaaggacaaaattattcgcaccagagattctgaaaaattagcgcaatgcgagtatgtttgtgatgtaggggggcggtactctatagcggataagcgttttgatcatcatcaggtgtcttatactggttcatggagtagtgcagggatggttcttgattatttgcatcatctaggatcccttccgcatgaagagtacgaatatctcaatagcacattagtgcatggtgtagatgaacaggataacggccgttttttctctaaggaaggattttgctctttctctgatattattaaaatttataatcccctggaagagggagggaacactgataaggaatttttctttgctttgcattttgcgatagatctgcttactcgtttacgggaaaagtttcgttatgatcgtatttgtcgtgacgttgttaagcaagtaatggaaaaagaagatgtctgtttgcgctttgatcgtccattagcttggcaagaaaattttttctccttaggaggagaaaatcatccggcggcttttgttagtttcccctgttcagatcaatggattttgagaggaattcctcctactttggatcgtcgaatggaggtgcggattccttttccagaggattgggcagggttgcttggggatcaattggttaaggctacagggattcctggagcgattttttgccataaagggttattcctctctgtttgggatagtcgggaaagttgcgaagaagcactgaatttggtgttaaaacagcagggggtagtatga

SEQ ID NO: 13246 - protein, 291 aa, Chlamydia muridarum, Chlamydia trachomatis MoPn
MRMQIPRSVGTHDGSFHADEVTACALLIMFDLVDKDKIIRTRDSEKLAQCEYVCDVGGRYSIADKRFDHHQVSYTGSWSSAGMVLDYLHHLGSLPHEEYEYLNSTLVHGVDEQDNGRFFSKEGFCSFSDIIKIYNPLEEGGNTDKEFFFALHFAIDLLTRLREKFRYDRICRDVVKQVMEKEDVCLRFDRPLAWQENFFSLGGENHPAAFVSFPCSDQWILRGIPPTLDRRMEVRIPFPEDWAGLLGDQLVKATGIPGAIFCHKGLFLSVWDSRESCEEALNLVLKQQGVV

SEQ ID NO: 13247 - DNA, 876 bp, Chlamydia trachomatis
  CDS (1)..(876)
atgagaatgcaaattccaagaagtgttggcacacatgatggttcttttcacgcagatgaagtgacggcttgcgctttattgatcatgtttgatcttgttgatgagaacaaaatcgttcgtaccagagatccccaaaagttggcgcaatgtgagtacgtctgtgatgtaggaggccgctactctacagagcataagcgtttcgatcaccaccaagtttcttacacaggatcttggagtagcgcagggatggttctggattatttgcatggtctgggatttctttctcacgatgagtacgagtatctgaataacacgttagtacatggtgtagatgagcaagataatggacgttttttttctaaagaaggcttctgttctttctctgatattatcaaaatctacaatcctttggaagaaggaggaaatacagacaaagaatttttctttgctttacggtttgcaatcgatttactaactcgtttgcgagagaagttctgttatgatcgtgtgtgtcgtgatattgtgaaacaagtcatggaaaaggaaagtgtttgtttgcgatttgatcgtccgttagcatggcaggagaatttcttctctttgggaggagaaagtcatccggcagcttttgtcagtttcccttgctcggatcaatggattttgcgaggcattccacctactttggatcgccggatggaagtccggattcctttccctgaggagtgggcaggattgcttggagatcagttggttcaagctacgggaattcctggtgctattttttgtcacaaaggactatttctttctgtatgggatagtcaagagagttgtgaagaagcactgaatttagtgttaaaacagcagagattagtatga

SEQ ID NO: 13248 - protein, 291 aa, Chlamydia trachomatis
MRMQIPRSVGTHDGSFHADEVTACALLIMFDLVDENKIVRTRDPQKLAQCEYVCDVGGRYSTEHKRFDHHQVSYTGSWSSAGMVLDYLHGLGFLSHDEYEYLNNTLVHGVDEQDNGRFFSKEGFCSFSDIIKIYNPLEEGGNTDKEFFFALRFAIDLLTRLREKFCYDRVCRDIVKQVMEKESVCLRFDRPLAWQENFFSLGGESHPAAFVSFPCSDQWILRGIPPTLDRRMEVRIPFPEEWAGLLGDQLVQATGIPGAIFCHKGLFLSVWDSQESCEEALNLVLKQQRLV

SEQ ID NO: 13249 - DNA, 1023 bp, Caenorhabditis elegans
  CDS (1)..(1023)
atgacatcgctcattggtactcactccggaaaattccattgcgatgaggcttttgcttgtttcatgctgaaacaattgccacaattcaaggatcattcgattttaagaacccgtgacgctgctcaactggagaagtgtgatattatcgtcgatgtcggtggaatctttgatcattcaaaacaacgatacgatcatcatcaacgtggattcactgataccatgcgtactctagagaagcttaactttgatacaaaactaagctctgcaggattagtttacgctcactacgggagagaagtcatcaatcagatccttggtggaaatgtgtcatcctcgatgattgatctattctatcatcgtctctacgagcaattcgttgaatcaatcgacgccattgataacgggatttctcaatacgacggagttccaagatatcattcatcaggaaatctttcatcgcgtactggtcaattcaattcccattggaatgaacctgagaatgatgctgatgaacgattccaacaagcaatgcaattcatcggtgaagagttttcacgatcagtgaagtacttggcaaatgtttggtggccagctagagagatcatcgaagctgctgtggataaacgatttgaaattgatgcatctggaaggatcattcttatcgagaacggtggatgcccgtggaaagaacactttttcgacattgaagtagagaagaatattgccgacgataatatcacttacattctgttctcggattctaccaatgcttcgtggcgcgttcaagcaatcccagtcgacaaaatgtcatcattcgagaatcgcatgccacttccagctgcttggcgtggtctccgtgatgacgatctttcgaaggaaagtggaatcccaggcggagtctttgtccacatttccggattcattggaggaaatctgactcgtgaaggagcaattgccatggcacggaaagctctcgaaataggagaagagaatccagtgaaaaaagctaaattgggtaattag

SEQ ID NO: 13250 - protein, 340 aa, Caenorhabditis elegans
MTSLIGTHSGKFHCDEAFACFMLKQLPQFKDHSILRTRDAAQLEKCDIIVDVGGIFDHSKQRYDHHQRGFTDTMRTLEKLNFDTKLSSAGLVYAHYGREVINQILGGNVSSSMIDLFYHRLYEQFVESIDAIDNGISQYDGVPRYHSSGNLSSRTGQFNSHWNEPENDADERFQQAMQFIGEEFSRSVKYLANVWWPAREIIEAAVDKRFEIDASGRIILIENGGCPWKEHFFDIEVEKNIADDNITYILFSDSTNASWRVQAIPVDKMSSFENRMPLPAAWRGLRDDDLSKESGIPGGVFVHISGFIGGNLTREGAIAMARKALEIGEENPVKKAKLGN

SEQ ID NO: 13251 - DNA, 1228 bp, Arabidopsis thaliana (mouse-ear cress)
  CDS (30)..(1094)
agaagagcttcttcttctctctcttagccatgtttgggtcaagaggtctctgttgcagcagaatctggaatcgttctctgtttctcaaacgttcttcaaacttccgagctagtttctctacgaaacgtgttgggacccataatggaacattccactgcgacgaagctttagcttgcttcatccttcgtcgttccaatagattctccgatgctcaaatcgtccgaaccagagatcatcaggttttggagaagcttgatgcggcacttgatgttggaggtgtgtatgatcctcagagtgaacgttatgaccatcaccagaaaggatttagtgaagtgtttggccttgggtttaatactaaactcagtagtgctgggcttgtctataagcattatggattggaaataatttccaaggagcttcaacttgagcagagacatcctgatgtgtttcgattgtttctagctgtgtacaaaaacttcattgaggcagtagatgctttagacaatggtatccatcaatatgatactgaccaacctccaagatatgtaaacaatactagcctggggcataggattggaagattgaacttagactggattgaacctgatcagtctagtgccaaagaagatgaagcctttcatcgggcaatggagcttgctggctctgagttcttggagtgtgttcattttcacgcgaaatcgtggttaccagctcggtcaattgttatggagtgtcttgcaaaacggtatgatatagactccagtggagaaattatgaagctcagtaaacaatgcccatggaaactccatatattcgagctcgaggaagaaatgaagattgatcctccaataaaatatgttctttaccaggatgatagaagcgaaaactggagaatacaagcagtttcggtttcaccagagaggtttgagagccgtaaagctttaccattagcatggagaggtttagaaaaggagaagctctcagaggaaagctcaattccacgctgtgtttttgtgcatatgagtggtttcattggtgcaaaccaaacctatgaaggtgccttagcaatggcaagagcttctttgatggcttagagtcactgcataaccaaacatcggtttcttttggtttggaccggttcctaatcctatacatcgaatttaaatggtcactaaagttacattgtatttagattttgattaatacttaatattcaaaagtttccttt

SEQ ID NO: 13252 - protein, 354 aa, Arabidopsis thaliana (mouse-ear cress)
MFGSRGLCCSRIWNRSLFLKRSSNFRASFSTKRVGTHNGTFHCDEALACFILRRSNRFSDAQIVRTRDHQVLEKLDAALDVGGVYDPQSERYDHHQKGFSEVFGLGFNTKLSSAGLVYKHYGLEIISKELQLEQRHPDVFRLFLAVYKNFIEAVDALDNGIHQYDTDQPPRYVNNTSLGHRIGRLNLDWIEPDQSSAKEDEAFHRAMELAGSEFLECVHFHAKSWLPARSIVMECLAKRYDIDSSGEIMKLSKQCPWKLHIFELEEEMKIDPPIKYVLYQDDRSENWRIQAVSVSPERFESRKALPLAWRGLEKEKLSEESSIPRCVFVHMSGFIGANQTYEGALAMARASLMA

SEQ ID NO: 13253 - DNA, 975 bp, Schizosaccharomyces pombe
  CDS (1)..(975)
atgaataatttagttaaaattgctactcatagtggtacttttcatgcagatgaggccttggctgtttacatgcttcgccgtttagatagattctccggtgcccaaattgtgcgcagccgtgatcctcaagttttagactcatgcgacattattgtagatgttggaggaaagtacgatggtattaaatattttgaccatcatcaacgtgaattcaatgatactttttcacccaaatacagcactcgtctttctagtgccggtttgatctacaaacattttggtcgtgaagttattcacgctgtccttccacagttgaaaataaacgagcaggatcttgaaacactttatgaaaaagtttatcaatcattcgttgaaggtcttgatgctaatgacaatggaatttctgcttatccggctggcctaaagcctagcttcaaagccgctatgagtctacctgagatggtttcaagtttccttcctgcatggaattcggaaaagcaagatgaccaaacttaccttgaatgttttcaaaaggcctcggatttaatgggtacatggtttgttcgatctgtagaacattatgctttatcatggttaccagctaaaactctcgctcgagaagcaattttgaaggctaaagattctcctattttgatcgtagatcagttttttccctggaagggtcatttatttgatattgaaaaagaacttggcattgagaaccaatttaaatacgctatctactctgatgggaaagcttggagagttcaggctgtttctattgatcccacttcttttacttgtcgcttaccactaccagaaccatggagaggaattcgtgatgaaaagctttctgagttaactggcattccaggttgcatctttgttcatgcttccggtttcattggtggtaatcaaacttttgagggtgctctggaaatggctaggaaagctttagattttccacaaaattaa

SEQ ID NO: 13254 - protein, 324 aa, Schizosaccharomyces pombe
MNNLVKIATHSGTFHADEALAVYMLRRLDRFSGAQIVRSRDPQVLDSCDIIVDVGGKYDGIKYFDHHQREFNDTFSPKYSTRLSSAGLIYKHFGREVIHAVLPQLKINEQDLETLYEKVYQSFVEGLDANDNGISAYPAGLKPSFKAAMSLPEMVSSFLPAWNSEKQDDQTYLECFQKASDLMGTWFVRSVEHYALSWLPAKTLAREAILKAKDSPILIVDQFFPWKGHLFDIEKELGIENQFKYAIYSDGKAWRVQAVSIDPTSFTCRLPLPEPWRGIRDEKLSELTGIPGCIFVHASGFIGGNQTFEGALEMARKALDFPQN

SEQ ID NO: 13255 - DNA, 1086 bp, Giardia lamblia ATCC 50803
  CDS (1)..(1086)
atgattgacacctcgaagctcaaattcgtggcctccacgtcaagcatagtttcatctgactcccctaagcagggttcaggcacaccatttaaaattattgccacccatgacggtaaatttcactgggacgaatgtcttgcggtttggttcattaagcagcttccagattatattgacgcacgcatcatgcgtacgcgcgaccctgaagagctagagtttgctaccatcacagtggatgtgggggatgtttacgatagcgagaagctgtgcttcgatcatcacatgaagggcttccaggtgttcttttcagatgcgtacaaagacatatgtttaagttctgcaggactaatatatgtgcactatggaagaagtattctaaagcagctcttcccgcgtttagacgggcccacagagcttgagtttctctatcactatgtgtatgacaactatatccgcgtggttgacgctgtggacaacggggtagagagtcactataacactgatgggtctgagcctatttgccgatggactgaccccacatctatgagtgcacgaatcactcgcatttatgagattgccggtgatgagggttttggaacagcttacaagatggctggacaggacttcatggagtggatacagaccgtagtaataacttacttgcccgcgcgcagagagcttgttagagctattgagcaagcacataagcttcaccccagtggtcgcatcattgagctctctagcccggggccatatcaacaatttattcattcggtggaacatgatctatctctatgcaaagacgggcctggcggtgacactatcctgtttctcatacatccagacgactaccaagctggctaccgtattaggaccgtttcgacacagaagggctcatttgcattcaggctgggactcccggaggcctggcgcgggctgagggacgaagcgcttcagaatgtcagcgggtaccagggcatgtcttttgttcataagagcggtttccttgggggcgcaaaggaccgtgacacggcactggctgtcgtgacacgcattgtagaggactttgaggcccgcaatttctaa

SEQ ID NO: 13256 - protein, 361 aa, Giardia lamblia ATCC 50803
MIDTSKLKFVASTSSIVSSDSPKQGSGTPFKIIATHDGKFHWDECLAVWFIKQLPDYIDARIMRTRDPEELEFATITVDVGDVYDSEKLCFDHHMKGFQVFFSDAYKDICLSSAGLIYVHYGRSILKQLFPRLDGPTELEFLYHYVYDNYIRVVDAVDNGVESHYNTDGSEPICRWTDPTSMSARITRIYEIAGDEGFGTAYKMAGQDFMEWIQTVVITYLPARRELVRAIEQAHKLHPSGRIIELSSPGPYQQFIHSVEHDLSLCKDGPGGDTILFLIHPDDYQAGYRIRTVSTQKGSFAFRLGLPEAWRGLRDEALQNVSGYQGMSFVHKSGFLGGAKDRDTALAVVTRIVEDFEARNF

SEQ ID NO: 13257 - DNA, 1107 bp, Plasmodium yoelii yoelii
  CDS (1)..(1107)
atgaaacttctaacatcgaaatatcctaaaatatcaaaagatatttttcagaggaataatattatcctaagaaaaaagaacgaaacaagtaattttaagaaattattgtgcaggtcttttatattttattcagcaatgcaaaaagtaattgggactcattcaggacgttttcatactgatgagatattagcatcagtgatgttaaaatttttacctgaatataaagatgcaaaaattatcagaacccgggatcaagaacttttagataaatgtgatattgttgtagatgtaggagggatatatgatcatgaaaaaaagagatatgatcatcatcaaagagaatttaatgatggcttagatgaaaatcataatataagactaagtagtgcagggttaatttataaacattatggaaaagacgtattaaggaaaggatttaatataactgatgaaaataaagtaaatatattatatgataaaatatatactgtattaatagaatcgatagatgcacttgataatgggattaatcaatatgaaggagaagcaaaatatcaaataaatacaaccttacaacatcgagtaaatagatttaatccaaattttttggaagacgatgttgatgaaaatgaacgttttatgttagcttcaaatgttgtaaaagatgaatttagtagttttgtaaattattattctaatgtttggtatgaagctaaaactataactttagaagctgtgaaaaatagatataattttcataaatcaggtagagttatatttttacaaaaacattgcccatattcggatcatatatataatatagaaaaagagctaaatattaaagatcaaattttattttgtatttacaaagatagatataacaattgcaggtgtggtacaatttcaaaagaaaacgaaggttttaatcttagacttccatttccccctagttttagaggtttaaaaaatgaagctttagttaaagaatcaaatatcgaaggcttaacatttgttcattattctggctttactagtgctggtgataatattgaatgtttggttaaattggttgaggctactttaaaagaaaatggtatttcttattaa

SEQ ID NO: 13258 - protein, 368 aa, Plasmodium yoelii yoelii
MKLLTSKYPKISKDIFQRNNIILRKKNETSNFKKLLCRSFIFYSAMQKVIGTHSGRFHTDEILASVMLKFLPEYKDAKIIRTRDQELLDKCDIVVDVGGIYDHEKKRYDHHQREFNDGLDENHNIRLSSAGLIYKHYGKDVLRKGFNITDENKVNILYDKIYTVLIESIDALDNGINQYEGEAKYQINTTLQHRVNRFNPNFLEDDVDENERFMLASNVVKDEFSSFVNYYSNVWYEAKTITLEAVKNRYNFHKSGRVIFLQKHCPYSDHIYNIEKELNIKDQILFCIYKDRYNNCRCGTISKENEGFNLRLPFPPSFRGLKNEALVKESNIEGLTFVHYSGFTSAGDNIECLVKLVEATLKENGISY

SEQ ID NO: 13259 - DNA, 1068 bp, Neurospora crassa
  CDS (1)..(1068)
atggccgaaaacgcagcgaagcgcatcaagaccgatggcggtgccctgaccatcggcacccacaacggccacttccacgccgacgaggctctggccgtccacatgcttcgccagcatgttcccaaatacaccggcgcccgcctggttcgcacccgcgaccctgcactacttgagacctgcgacatcgtcgtcgatgttggtggcgagtacgagcccgcccgtgaccgctacgaccaccaccagcgcaccttcaccaccaccttccccgaccaccagacaaagctcagcagcgccggtctcgtctacatgcactttggcaagggtatcatctcgcgcagcctgcccgacgcccctgcggaggacaacgacaaggttggcttgatctggaacaagttgtacgacagcttcgtcgaggccctcgacgctcacgacaacggcatcagcgtctacgattccgatgctctcaaggctgccggcatcgagaagcgcttctctaacggcggtttcaccctcggtgccatggtcggccgcttcaatggcaactggaacgataccgccccctcggaccctgtggctgcccaggcggaggaagatggcaggttcgagcaggccagtcagcgtatcggtgaggagttcgaccgcgctctcgactactacaccaaggcttggcttccggccagggatgtcgtcgagacggcctacaaggcccgcaaagagtacgatgcagagggtagaatccttgtcttgaagggtcagtcggccccttggaaggatcatctctacaccctggaagaggaagagggagagcgtgtccagaaggttctctatgtcctgtaccccgagaagcctacacccgacgccaagtggagagtgcagtgcgtgccggagactggcgactccttccagagccgcaagcccctgcccgaggcttggagaggcttccgcgatgagaagctcgatgagatcacgcaaatccagggcggcgttttcgttcatgcggcaggtttcattggaggcaacaagaccttcgatggtgccttggccatggcgaagaaggccttggagtag

SEQ ID NO: 13260 - protein, 355 aa, Neurospora crassa
MAENAAKRIKTDGGALTIGTHNGHFHADEALAVHMLRQHVPKYTGARLVRTRDPALLETCDIVVDVGGEYEPARDRYDHHQRTFTTTFPDHQTKLSSAGLVYMHFGKGIISRSLPDAPAEDNDKVGLIWNKLYDSFVEALDAHDNGISVYDSDALKAAGIEKRFSNGGFTLGAMVGRFNGNWNDTAPSDPVAAQAEEDGRFEQASQRIGEEFDRALDYYTKAWLPARDVVETAYKARKEYDAEGRILVLKGQSAPWKDHLYTLEEEEGERVQKVLYVLYPEKPTPDAKWRVQCVPETGDSFQSRKPLPEAWRGFRDEKLDEITQIQGGVFVHAAGFIGGNKTFDGALAMAKKALE

SEQ ID NO: 13261 - DNA, 879 bp, Chlamydophila caviae
  CDS (1)..(879)
atgggaaatatgcgaattccaagaagcgttggtacccacgacggttcttttcatgctgatgaggttacagcgtgtgccttgcttattttgtttgatcttgttgatgaagggaagatcatccgtacacgaaatcctgagaaactcgcagaatgcgagtatgtatgcgatgtcgggggtatctattctttagaggagaaaagatttgaccatcaccaagtttcctacgagggaccttggagtagtgcaggcatgatattaaattatctgaaagaacaaagactgatgagtttggaagagtatcattttctaaatcagacgttaattcatggtgttgatgaacaagacaatggaaggtttttttcaaaagaaggcttctgttctttttccgatatcattaaaatatacaatcctgaagaaggcaagaattcttcggatgcagacttctttttcgccctaaaatttactatggatttactgaagcgtttgagaagtaagttccgctatgatcgcatgtgtagagatgttgtcagatctgccatggaaaaagatgagttctgtttgtttttcgaccgtcctttagcatggcaagagaatttcttttttttaggaggagagcagcataccgcagcgtttgtctgtttcccagcctgtgatcaatggattcttagaggcattccgcctaccttggatagacgcatggaagtgcgtgttcccttcccagaaagttgggcaggacttcttggtaaagatctcgaagaggtcagtgggattcctggagctattttttgccataaggggctctttctatccgtttgggatagcaaagaacattgtcgacgtgccttgcaattggtattagaaaatcgaggattagtgtga

SEQ ID NO: 13262 - protein, 292 aa, Chlamydophila caviae
MGNMRIPRSVGTHDGSFHADEVTACALLILFDLVDEGKIIRTRNPEKLAECEYVCDVGGIYSLEEKRFDHHQVSYEGPWSSAGMILNYLKEQRLMSLEEYHFLNQTLIHGVDEQDNGRFFSKEGFCSFSDIIKIYNPEEGKNSSDADFFFALKFTMDLLKRLRSKFRYDRMCRDVVRSAMEKDEFCLFFDRPLAWQENFFFLGGEQHTAAFVCFPACDQWILRGIPPTLDRRMEVRVPFPESWAGLLGKDLEEVSGIPGAIFCHKGLFLSVWDSKEHCRRALQLVLENRGLV

SEQ ID NO: 13263 - DNA, 936 bp, Encephalitozoon cuniculi
  CDS (1)..(936)
atgattcttgttacacatgatggcaaatttcatttggatgaagtaatggcaactgctgtgttgcttaagatatatccagattcggaaatagtcagaacaagaagctctgccgtcgtacgaagcggggacatagtctatgacgtcgggagatcgtttgatccagaggccaatagatacgaccaccatcaggaatcatttaacgagacctttagtccaaagcacaagataaagctaagtagttctggcctgatatacaaatactacggcgaaaagtttctagagaaatacgggctgaatagaacagatgaatgctttccaagggtgctcgaagaggtctatacggcctattttatgtctgcggatgcaatcgacaatggatacgaaattttcggagaaatcgttccaagatcgctctcacacgtcgtcgagtcgtttaatgccctggacttctccgatagcgataggcaaaacaaaaggtttctggaggcggtgcaatttgtttccaaagatttggataacttcataagcgcaatagttaacagatgggttccaagctacaagtatcttaacaaattaatcgccgaggtgaacggagatattctatacgttgacaggtactgttttgtcgacgtaattcctgagatagagaagaaatacaagaaagatgtcaagtttgtcttgaataggaaggagagttctgtaagtattctaacagttcctaaagataggaagcgttttgaatcaaaagtccctctaaagaaagaatggagaggtcttgctgggggaaagctggagacagtgtctgggattgacgggtgtaattttgtgcatgcttctggatttgtaggctccaacaagaccattgagggagccatggaaatgtgtagaatatccatagaggcttattgtaaagaagccaaagatggcagtggttaa

SEQ ID NO: 13264 - protein, 311 aa, Encephalitozoon cuniculi
MILVTHDGKFHLDEVMATAVLLKIYPDSEIVRTRSSAVVRSGDIVYDVGRSFDPEANRYDHHQESFNETFSPKHKIKLSSSGLIYKYYGEKFLEKYGLNRTDECFPRVLEEVYTAYFMSADAIDNGYEIFGEIVPRSLSHVVESFNALDFSDSDRQNKRFLEAVQFVSKDLDNFISAIVNRWVPSYKYLNKLIAEVNGDILYVDRYCFVDVIPEIEKKYKKDVKFVLNRKESSVSILTVPKDRKRFESKVPLKKEWRGLAGGKLETVSGIDGCNFVHASGFVGSNKTIEGAMEMCRISIEAYCKEAKDGSG

SEQ ID NO: 13265 - DNA, 918 bp, Encephalitozoon cuniculi
  CDS (1)..(918)
atgaagttgataacacacaatgaaagatttcactatgacgaagtccttgcatcttgcatacttctccggatatatccagatgccgagatagtgaggacaagggacaagaccctcatcgactcgggtgatattgtctacgatgttggtggagtgttcgatcctggactgggaaggtttgatcaccaccagaggacgttcttcgaaacgttttcgccgaagtacagcgtcaagctcagcagcagcggactcatcttcaaatactttcacaggaaactcttgtcgctgtacgggatagagagctccagtagaacatacgatcttgtggtggacaagatctactctgagtttttcttgtatgcggatgccatagacaatgggcaggatatatatggggagataaagcctcggagcattgcagacctagtcaatctgttcaatgtagatgggtctgggagagatgcagaaaccgaggggttctatgaggcactaaggattgtggataaggatcttgacaactacatgaagaggatcaagctgtggactgacaattacgaacacatggaaaataagataaaggaaacaagtgggccgattcttgtgctagacaagcactatagcacggacttggtcctggagattgaagcccagaatgggaaggacttcaagttcatggtgtttccccatagaggtgcatacagagtaattgctattccaaaacataagggaacattcgaaacaaaaaatcccctcagaaaggagtggcgtggacttgtgaacgaagagctggtggaggcgtctggaatagagggctgtacctttgtccactcctccgggtttatgggaattaacagtacactagagaatgcactgaaaatgtgcacagagtctcttccggatgatgaagatccacgccaataa

SEQ ID NO: 13266 - protein, 305 aa, Encephalitozoon cuniculi
MKLITHNERFHYDEVLASCILLRIYPDAEIVRTRDKTLIDSGDIVYDVGGVFDPGLGRFDHHQRTFFETFSPKYSVKLSSSGLIFKYFHRKLLSLYGIESSSRTYDLVVDKIYSEFFLYADAIDNGQDIYGEIKPRSIADLVNLFNVDGSGRDAETEGFYEALRIVDKDLDNYMKRIKLWTDNYEHMENKIKETSGPILVLDKHYSTDLVLEIEAQNGKDFKFMVFPHRGAYRVIAIPKHKGTFETKNPLRKEWRGLVNEELVEASGIEGCTFVHSSGFMGINSTLENALKMCTESLPDDEDPRQ

SEQ ID NO: 13267 - DNA, 1317 bp, Arabidopsis thaliana
  CDS (44)..(1084)
ggccttgttccaagttcgtcttcctcctctcgtagcagcagtaatggctccttcaagcgtcgttagggtttactctaccgctacctctccttctccttctgaaatttccgtcaagaaagttggtactcataatggaagctttcactgcgacgaagctctcggctgtttcatgattcgcctcgtcgataaattctccggcgctgatatcgtccgttctcgtgaccctaagatattggcagaacttgatgcagtgcttgatgttggaggtgtttatgatccggagcatgaccgttatgatcatcaccagaaaggttttgaagaggtttttggacatggcttcaacactaagctcagtagtgctggtcttgtttacaagcattttggaaaggagatcatagctaaggaacttaatgtcgaacaagatcaccctgatgttcttcggttgtttttagctgtctacaagagcttcatggaggcaattgatgctgtggacaatggaataaaccggtatgatactgatcagcctccacgatatgtgaacaacacacatctgtctccaagggttggaagattaaatctggattggattgaccctgaccagtcacaagaaaaggagaatgaagctttccaacgtgcagtggctctagctggaaaagagttcctcgaaagtgttcagttccatgcaagatcgtggttaccggctcgatcaattgtgatgcagtgtcttgaagaaagattcaagacagaccccagcggtgagatcatgatattggatagattttgcccttggaagcttcatttgttcgagcttgagcaagaaatgaagatcgagcctctcatcaaatacgtcatttaccaggacgagagagcaaagcagtggagagttcaagcagtggcggtcgcaccagacaggtttgagaaccgaaagcctctccctgagaaatggagaggccttagggatgaggaactctcgaaagctgctgagattcccggttgtgtctttgtccacatgagtggctttatcggcggaaaccaatcctatgacggcgctctatccatggctcaaaccgcactcactctctgagcatcaaaagaatcatttacccattactcatagagagagaccgagagttttgatattgccattatcttctgcaatttctgtttcattgagtcttctcgtgacaaaaaatttaagaactagatttgtagtctcaagctgattagatcatattatatgtttgcttcctcttgtccgttttcacctttggagtagatttgtagtagagagcgtaaacaatattagctgaaaaccat

SEQ ID NO: 13268 - protein, 346 aa, Arabidopsis thaliana
MAPSSVVRVYSTATSPSPSEISVKKVGTHNGSFHCDEALGCFMIRLVDKFSGADIVRSRDPKILAELDAVLDVGGVYDPEHDRYDHHQKGFEEVFGHGFNTKLSSAGLVYKHFGKEIIAKELNVEQDHPDVLRLFLAVYKSFMEAIDAVDNGINRYDTDQPPRYVNNTHLSPRVGRLNLDWIDPDQSQEKENEAFQRAVALAGKEFLESVQFHARSWLPARSIVMQCLEERFKTDPSGEIMILDRFCPWKLHLFELEQEMKIEPLIKYVIYQDERAKQWRVQAVAVAPDRFENRKPLPEKWRGLRDEELSKAAEIPGCVFVHMSGFIGGNQSYDGALSMAQTALTL

SEQ ID NO: 13269 - DNA, 1179 bp, Drosophila melanogaster
  CDS (151)..(1098)
cgaaattaattgaaatatctgggcttaactgaatgttttgaagcaggaaaactatctataatgactggagttaccccaccaaaacgctctcccctttggatcggcacacacagcggcacttttcactgcgacgagttggtcgcatgttttatgctcaagcaattggatgagtacaaaaacgcagagattttccgcagtcgggacaacaaggctttgaaggagaagtgcgatataattgtcgacgtgggcggcgtttatgatcatgccaagaaattgtacgatcaccaccaaataaccttcaaggagacttttagttccgttcgcccagatgtaagcgaggactacaacgttgtcaggctaagcagtgctggactggtctactgtcactatggcgagcgtgttatacagagcatcctgcagcgcgaaaagggaattaaactctcaccggaaaacctgcaaacggcctttattcagatctataggaattttatcaacgaactggacgcaattgataatggagtgcccatgttcgagggcgttgagcctatatacaaaatctccactcatctatctgcccgcattgccaaactgaatccgtcctggcaggaaactggcgtagacatcgaagaccgattcagacaggcgatggatactgcaggtcgtgagtttgtggacaacgttgtggaggtatcatgttcctggattccagcccgggatcacgtacgagaggctcttaaaaatgccaagaacgtccatcccaccggcgagattcttgtgttgaagaatttctgcccctggaagtctcatctgttcgatcttgaaaaggagtacaaggtggagggtgtgcccaagctggtcgtcttcaacagcggcaatagttggcgagtggccggagttccagtgacgcctggcagctatctgggccgcaaatttctgcccactccttggcgcggactgatggacgatgaactatgcgataaggcgagcatcaaagatctcgaattcatccatcacacaggatttattggcggggcaaaaaccgaggaggctgccatgttgttggccaagaaatccaccgagtggacagaagagcaataatataatacgacttaaagttatgcttttgaaattgaaaaacaataattagatcgcatttaattctggtgttattacgcattt

SEQ ID NO: 13270 - protein, 315 aa, Drosophila melanogaster
MLKQLDEYKNAEIFRSRDNKALKEKCDIIVDVGGVYDHAKKLYDHHQITFKETFSSVRPDVSEDYNVVRLSSAGLVYCHYGERVIQSILQREKGIKLSPENLQTAFIQIYRNFINELDAIDNGVPMFEGVEPIYKISTHLSARIAKLNPSWQETGVDIEDRFRQAMDTAGREFVDNVVEVSCSWIPARDHVREALKNAKNVHPTGEILVLKNFCPWKSHLFDLEKEYKVEGVPKLVVFNSGNSWRVAGVPVTPGSYLGRKFLPTPWRGLMDDELCDKASIKDLEFIHHTGFIGGAKTEEAAMLLAKKSTEWTEEQ

SEQ ID NO: 13271 - DNA, 1552 bp, Mus musculus
  CDS (380)..(1522)
tgagggaaacttcggagggaaccagctactagatggttcgattagtctttcgcccctatacccaggtcggacgaccgatttgcacgtcaggaccgctacggacctccaccagagtttcctctggcttcgccctgcccaggcatagttcaccatctttcgggtcctaacgcgtacgctcgtgctccacctccccggcgcggcgggcgagacgggccggtggtgcgccctcggcggactggagaggcctcgggatcccacctcgggcccccgggcggggcccttcaccttcattgcgccacggcggctttcggacgagcccctgactcgcgcacgcgttagactccttggtccgggtcgaccttcccttggagggaactatatgggtagacgtttcctgcgtggtatcttaacattgccgctccggtcagttctccaagcccagcaccgcatgcttggctcagagcaggatccgcccgctaaaagacctcgcaacaacctcatggcaccgccccgaatcgggacgcacaacggcaccttccactgcgatgaagctctggcttgcgcgttgctccgcctcctgcccgagtacgcgaacgcagagattgtgcggactcgggatcctgaaaagttggcttcgtgtgacatcgtggtggatgtgggcggtgagtacaacccccagagtcaccgttatgatcatcaccagaggacttttacagaaaccatgagttcactgtgccctggaaagccatggcagaccaagctgagcagtgcgggacttgtctatttgcacttcggacgtaagctcctggcccagttgctgggcactagtgaagaggacagcgtggtggataccatctatgacaagatgtatgagaactttgtggaagaggtggatgcggtggacaatgggatctctcagtgggcagagggggagcctcggtatgccatgaccaccacactgagtgcccgggttgctcggcttaatcccacctggaaccagcccaaccaagacactgaggcagggttcaggcgagcaatggacctggtacaagaggagtttctgcaaagactaaacttctaccagcacagctggctgccagcccgggccttagtagaggaggcactggcccagagattcaaggtagattcaagtggggaaatagtggaactcgcaaaaggtggatgcccttggaaggagcatctataccacctagaatctgagctgtcccccaaagtggccattacctttgttatctacactgaccaggctggacagtggcgagtccagtgcgtacccaaggagcctcactcattccaaagccggctacccttgcccgagccatggagaggacttcgggataaggccctggaccaagtcagtgggatccctggttgcatcttcgtccatgccagtggcttcattggtgggcaccacactcgagagggtgccctgaacatggcccgtgccacccttgcccagcgcccagcacctgtgcctcttgcaaatgctgtagtccaataaaacgtattcacctctaaaaaaaaaaaaaaa

SEQ ID NO: 13272 - protein, 380 aa, Mus musculus
MGRRFLRGILTLPLRSVLQAQHRMLGSEQDPPAKRPRNNLMAPPRIGTHNGTFHCDEALACALLRLLPEYANAEIVRTRDPEKLASCDIVVDVGGEYNPQSHRYDHHQRTFTETMSSLCPGKPWQTKLSSAGLVYLHFGRKLLAQLLGTSEEDSVVDTIYDKMYENFVEEVDAVDNGISQWAEGEPRYAMTTTLSARVARLNPTWNQPNQDTEAGFRRAMDLVQEEFLQRLNFYQHSWLPARALVEEALAQRFKVDSSGEIVELAKGGCPWKEHLYHLESELSPKVAITFVIYTDQAGQWRVQCVPKEPHSFQSRLPLPEPWRGLRDKALDQVSGIPGCIFVHASGFIGGHHTREGALNMARATLAQRPAPVPLANAVVQ

SEQ ID NO: 13273 - DNA, 1233 bp, Ashbya gossypii
  CDS (1)..(1233)
atgcggatgtcacgtggcgcgcacgcgttgctacttgggcgcatcgcaacaaccactactcccacaaaggtacagggggcatcgccgatgcagattggactggcccgaccggcaactgcagtcgcatggttcgctccacggacgaggatacgctcgttggtaaatcctggttttcttgcagaaaaatttgcgggccatcgcactgttagccatctccgactcctcgccacgatgtccaagaagctcaagatgaccccgttcaagcaaatctgtacgcactcgggctcgttccacgctgacgaggcgctcgcagtgtacatgctgcgcctactgcctgagggtaaagacgccaagctcgtgcggtcgcgcgacccggccaagtgggaggagtcctgtatcgtggtggacgtcagtggcaagtacgacggcgtcaagtacttcgaccaccaccagcgcgagttcttcgagacgttcagcgaccagtacaaaaccaagctctcgagcgccggcctggtgtacaagcactttggacggcagatcgtgcgcgcgctgtgccctgagatcagcgacgaggacaccgagctgctctacgagaaggtgtaccgcgacttcgtcgaggccctggatgccaacgacaacggcatcagcaactttgacgccgaggagctcggcgtgcgcccgcgcttccacgacaagaacatctccatcccgggcatcgtcgccaagatgaaccccgactggaacgaagagaccagcgacgcccgcttcgacgagtgcttccttaccgcctcggcctttgtcggcgactgcttcgcgcgcgtcgtgcgcggctatggccgcgcgtggctacccgccaaggacattgtccgcgccggcgtgcgcgaccgcgccgccgtcgaccccagcggccgcatcgtcgtcctcgagcgcttctgtccctggaaagagcacctctacgacgtcgagcgtgagctcggcctcgtcggcgaggtcctcttcgtgctgttcgccgactcctctggttcctggcgcgtctccaccgtcccgcagtcggctacctccttccgcttccgccacggtctgccagagccttggcgcggcctgcgtgacgatgccctctccgaggcgaccggcgtccccggctgcatcttcgtccacgccgcgggcttcatcggcggcgcgcgcacccgcgacgctgcccttgcgctcgcccggctgagcctccccgcctag

SEQ ID NO: 13274 - protein, 410 aa, Ashbya gossypii
MRMSRGAHALLLGRIATTTTPTKVQGASPMQIGLARPATAVAWFAPRTRIRSLVNPGFLAEKFAGHRTVSHLRLLATMSKKLKMTPFKQICTHSGSFHADEALAVYMLRLLPEGKDAKLVRSRDPAKWEESCIVVDVSGKYDGVKYFDHHQREFFETFSDQYKTKLSSAGLVYKHFGRQIVRALCPEISDEDTELLYEKVYRDFVEALDANDNGISNFDAEELGVRPRFHDKNISIPGIVAKMNPDWNEETSDARFDECFLTASAFVGDCFARVVRGYGRAWLPAKDIVRAGVRDRAAVDPSGRIVVLERFCPWKEHLYDVERELGLVGEVLFVLFADSSGSWRVSTVPQSATSFRFRHGLPEPWRGLRDDALSEATGVPGCIFVHAAGFIGGARTRDAALALARLSLPA

SEQ ID NO: 13275 - DNA, 1368 bp, Oryza sativa
  CDS (60)..(1118)
ggcagcgagccgtcacgttcattccccgcgtgcgatcccaaaccctaaaccctctccccatggccgccgccgcctcgcccaagcgcttgagggtctactcgtccgtctcgggcgacggccgctccgcgaacggcgcggggagcggcaagcgcgtggggacccacaacggcagcttccactgcgacgaggcgctcgggtgctacctcatccgcctcacctcccagttcgccggcgccgacgtcgtccgcacccgcgacccccagatcctcgatactctggatgctgtgcttgatgttggtggtgtctatgatcccagccggcatcgctacgatcatcaccagaagggctttaatgaggtctttggacatggctttaacacaaaacttagcagtgccgggcttgtttacaagcactttggtaaggagataattgcaaaggagcttgaagttagtgaagaccatgaagatgttcatcggttgtatcttgcaatatataaaagctttgttgaggcgcttgatgcagtcgacaacggaatcaatcaatatgacacagaccaacccccaaagtatgtgaacaacacacacttgtcttcacgcgttgggcgtcttaatccagactggaccgatccagaccagtcacctgagaaggaaaatgctgcatttcaacaggcaatgatgcttgctggaagtgaatttatggagagtgttcgctttcatgttaagtcatggttacctgcgagatctattgtcttggagtgtttgttgtcaagaggaaaggttgatccaagtgaagaaattatggttttggatagattctgcccatggaaacttcatctgtttgagcttgaagaggagctgaagattgatcccctcacgaagtatgtgttgtaccaggatgagaggagcaaaagttggagagtacaagctgttggcgttgctccggatagatttgagagccgaaagcctctgccggaaaagtggaggggcttgagagatgatgaactgtcaaacgatattggcattccaggatgtgtctttgttcatatgagcggcttcattggcggcaataagacgtatgagggagcgttggaaatggcaagagctgctatcaagtgttgactcaacgttcgacggaggcttcaatcagtaacgcactgtcacccatgagctgcagtaacacagttaaccagttgaacttcatgttattattgactcgtaattgacatttgagtactcatgttccttgcgtaaaacatccttagctgacaggagaggccagttgcctttttaatctcgaacgacgagtttatgattacattttataaagattagaaaagatgatgggacatatccatttgtcgtggtaagc

SEQ ID NO: 13276 - protein, 352 aa, Oryza sativa
MAAAASPKRLRVYSSVSGDGRSANGAGSGKRVGTHNGSFHCDEALGCYLIRLTSQFAGADVVRTRDPQILDTLDAVLDVGGVYDPSRHRYDHHQKGFNEVFGHGFNTKLSSAGLVYKHFGKEIIAKELEVSEDHEDVHRLYLAIYKSFVEALDAVDNGINQYDTDQPPKYVNNTHLSSRVGRLNPDWTDPDQSPEKENAAFQQAMMLAGSEFMESVRFHVKSWLPARSIVLECLLSRGKVDPSEEIMVLDRFCPWKLHLFELEEELKIDPLTKYVLYQDERSKSWRVQAVGVAPDRFESRKPLPEKWRGLRDDELSNDIGIPGCVFVHMSGFIGGNKTYEGALEMARAAIKC

SEQ ID NO: 13277 - DNA, 873 bp, Parachlamydia sp
  CDS (1)..(873)
atgcagaaaaacccaagaagctgtggcacgcatgatggaacatttcatgcagatgaagttaccgcatgtgctttgttaatgctttttgatttgattgatgaaaataagatcattcgcacacgtgatttacaaattttaaatacatgcgaatatatttgtgatgtaggaggtatttatgatccttctcaaaaaatttttgatcatcatcaagtagattatcaagggcctatgagtagtgcgggaatgattctcaaatatttaaagcatcttgaacgattgaaacccaatgaatacgagctttttaacgcatctttagtcatgggaatagacgctcatgataatggaagagatcctttgattcctggatattgctcaatttctcacattgtttctaatttcacgcctattcattacgattgtgctcatgaagagcaagatcaagcttttcataaagctctaaaatttgtttatgaacatttagatcgtttatgggaacgatttaaatatactcaatcttgccgtgaaattattgctgaatgcatgaataaatcaaaagaatgtttaatgtttgatcaaaatttgccttggcttgaaattttctttgagttgaaaggagaagagcatccggcattatttgtaattatgccttcaggtcctcattggaagttaagaggaattcctccttcttaccaagatcgaatgaaagttcgtttaccacaacccaaagaatgggctgggttattagaggaagacctaaaaagggtttcgggtattccgggtgcagttttttgccataaagggcgttttatatcggtttgggaaacaaaagaagatgcattgaaagctttagattacaccttaaagtatacttag

SEQ ID NO: 13278 - protein, 290 aa, Parachlamydia sp
MQKNPRSCGTHDGTFHADEVTACALLMLFDLIDENKIIRTRDLQILNTCEYICDVGGIYDPSQKIFDHHQVDYQGPMSSAGMILKYLKHLERLKPNEYELFNASLVMGIDAHDNGRDPLIPGYCSISHIVSNFTPIHYDCAHEEQDQAFHKALKFVYEHLDRLWERFKYTQSCREIIAECMNKSKECLMFDQNLPWLEIFFELKGEEHPALFVIMPSGPHWKLRGIPPSYQDRMKVRLPQPKEWAGLLEEDLKRVSGIPGAVFCHKGRFISVWETKEDALKALDYTLKYT

SEQ ID NO: 13279 - DNA, 26 bp, Primer
atgaatagcgtaaaaagagtaaagct

SEQ ID NO: 13280 - DNA, 23 bp, Primer
ctaggccaaagacatcttagcca

SEQ ID NO: 13281 - DNA, 474 bp, Saccharomyces cerevisiae
  CDS (1)..(474)
atgatagaggcgttggaaatagttctattgctcgttatacaatcacttcaatatatctgtcgcacatgcatagcttttttgctaataccattcttaggcctgtatgcattcgatctcttcctatacgtttatcggatgatactttatctgtcacaaatgttcaattacaagagaaaactaggacgttctaaaacaaataataggccgcatagtcccaggctacataagatatacagtagtggggattgcatggataccttaattggccaagtaagggatttgagagtatttttgttatccacgatccacagccactctaaaagattcttttctacgagatttcagacaaaatcaggcattaactctgctattgacgcgaatgatgttgaaacaacatctgacgtatctagttttacaaatttacatttaacaaggtcatcggaagaaggttattatatcgcaggatcgatataa

SEQ ID NO: 13282 - protein, 157 aa, Saccharomyces cerevisiae
MIEALEIVLLLVIQSLQYICRTCIAFLLIPFLGLYAFDLFLYVYRMILYLSQMFNYKRKLGRSKTNNRPHSPRLHKIYSSGDCMDTLIGQVRDLRVFLLSTIHSHSKRFFSTRFQTKSGINSAIDANDVETTSDVSSFTNLHLTRSSEEGYYIAGSI

SEQ ID NO: 13283 - DNA, 25 bp, Primer
atgatagaggcgttggaaatagttc

SEQ ID NO: 13284 - DNA, 26 bp, Primer
ttatatcgatcctgcgatataataac

SEQ ID NO: 13285 - DNA, 603 bp, Saccharomyces cerevisiae
  CDS (1)..(603)
atggcttggactagtacattaccagcgcatctactgaacctgatcaaaaactccaaatatgttcacgtggccacctgttctaaagactgcatcccttcagtggcattgatgaactatatctatgtgccaggtgaaaaactgttcggtcaaacagataataagaatgactacattatatttgtttctcctcaggacacacaaaagttttacaacatcaaggagaaccctaaggtcgccctgttgtttcacgattggatcatcgcgaataatttgtcagtgggcaaggaaagcatctctgggactccgacgccgacttctattcctcatgaagagcaacgtcaaagcgagcttttaaatttgttacaggagttaaatcaagccgaattgaaccaaatgagcgcatctattggtggcgaaaccgaaattgtcaatcctgaaagtgaagaatccaagtactataaagatttaatactaaaggctaatcctgatgcgaaagcttttatatttgaaaagaacaccgccgttgttaaagttagaattgataatgctagggtatccaataatgagaacagaacaatgtttctaagtaaagggaagagttaa

SEQ ID NO: 13286 - protein, 200 aa, Saccharomyces cerevisiae
MAWTSTLPAHLLNLIKNSKYVHVATCSKDCIPSVALMNYIYVPGEKLFGQTDNKNDYIIFVSPQDTQKFYNIKENPKVALLFHDWIIANNLSVGKESISGTPTPTSIPHEEQRQSELLNLLQELNQAELNQMSASIGGETEIVNPESEESKYYKDLILKANPDAKAFIFEKNTAVVKVRIDNARVSNNENRTMFLSKGKS

SEQ ID NO: 13287 - DNA, 615 bp, Saccharomyces cerevisiae
  CDS (1)..(615)
atgaaactcaatgaacaaataccaaaagacctgttacgcctgattaaaagttccaagtatgttcatgtggcgacatgctcgtcaaattgtataccatctgtttcgttgatgcattacatatttgtttcatccgcggaaactttccataaacatgagtatagtatagaaatagattgtaatgactatattatattcacagtgttcgagaaatcagtaacctttcgtaatgtcatgagcaacccaaacgttgcattgctatttcacgattggatcacagctaaaaatttaactcttcgaaaaaaaagcgtccatagtaaagatgatttttcatttgttgagtcagagtctacaaaatttaacaactttttacgagatttgaaccaaagtgaattgaatcaagtgagcgctactatcaatggtattgctgatattgtgaaccctaatagtgaagaatctacttattataggcggttgttattaacagtcaatccagacgcagatatttttatactaggagaagatacagccataataaaggtaaatatacaaaaaataaaagtctctgacatggaaaataatacttctacatacggccaaacagtacaaccagtttaa

SEQ ID NO: 13288 - protein, 204 aa, Saccharomyces cerevisiae
MKLNEQIPKDLLRLIKSSKYVHVATCSSNCIPSVSLMHYIFVSSAETFHKHEYSIEIDCNDYIIFTVFEKSVTFRNVMSNPNVALLFHDWITAKNLTLRKKSVHSKDDFSFVESESTKFNNFLRDLNQSELNQVSATINGIADIVNPNSEESTYYRRLLLTVNPDADIFILGEDTAIIKVNIQKIKVSDMENNTSTYGQTVQPV

SEQ ID NO: 13289 - DNA, 573 bp, Schizosaccharomyces pombe
  CDS (1)..(573)
atggcctcaaaagtcgattcatctcatgagttccccagccaaatcaagagatgcttgtcctcatccaaatatattcaactagctacttgctttcatgatcagcctcactcttctttgatgacatttacctatttacctgcaggaagcgctgccccttacgaagtggaggattgcattattttgtcaacaggagaaaacagtaaaaaatattttaacatcagttcgaatcctcgagtatcattactagttcatgactggaccactaatcgtcaagaaacagatcctgatgcctcctcattgtacaccttactttataaaatgaatcaggctcagttctcgaatacatcagtgaccttgaatggccttgctaccgttcttccaaagaatagcaaagaagaggaattctttagagaaaagcatttaaacactaatgacaagggtaatacgaaacaatacgtggagggtgaggatatgagaattatcaagataaagttggaaagtgcgagaatttgtgatcagagactcaacaacgtccaaaaatggaatgcaagaggagatgagactccattttga

SEQ ID NO: 13290 - protein, 190 aa, Schizosaccharomyces pombe
MASKVDSSHEFPSQIKRCLSSSKYIQLATCFHDQPHSSLMTFTYLPAGSAAPYEVEDCIILSTGENSKKYFNISSNPRVSLLVHDWTTNRQETDPDASSLYTLLYKMNQAQFSNTSVTLNGLATVLPKNSKEEEFFREKHLNTNDKGNTKQYVEGEDMRIIKIKLESARICDQRLNNVQKWNARGDETPF

SEQ ID NO: 13291 - DNA, 669 bp, Cochliobolus heterostrophus
  CDS (1)..(669)
atgctacagcttcatcttgcaacatgctcggataacattcctcatgtttccctcatgaactacacatatctacctaacacgccttactcttcaagtccaatcattatcatgacaacaccggcatcatcccgcaagactcagaatctggaatcgaactcgcttgtgtctctattggtgcacgactggatatctcatcggccacccactctaagtcagccaggccgctccccttcaccaacccgcccagcaccccggtctggatcactggccgagcttcttctcggcatgaacacagcctcattgagtcgaatcagcactactatcaatggcgttgctgagatggttccctctgggtcggagcaagagacatggtacaaggctcaacatgttgcaaacaatacctttagcgatggtacagaggacatctattcgacttcgccaggcggagagggcttgtggggtagtggcgggctaggcaatggagctgcaagtggagacgcgccaagagagggtaatgcaggggcacaatgctatctggacggagaagaagtcagggttgtcattgtaaagatccgtgacggaagaattgcagactggaaaggccaagtgcgagattggagattgtcagaaggcacccaaggtgctctacccaatggaacggcagattga

SEQ ID NO: 13292 - protein, 222 aa, Cochliobolus heterostrophus
MLQLHLATCSDNIPHVSLMNYTYLPNTPYSSSPIIIMTTPASSRKTQNLESNSLVSLLVHDWISHRPPTLSQPGRSPSPTRPAPRSGSLAELLLGMNTASLSRISTTINGVAEMVPSGSEQETWYKAQHVANNTFSDGTEDIYSTSPGGEGLWGSGGLGNGAASGDAPREGNAGAQCYLDGEEVRVVIVKIRDGRIADWKGQVRDWRLSEGTQGALPNGTAD

SEQ ID NO: 13293 - DNA, 789 bp, Neurospora crassa
  CDS (1)..(789)
atgaaccaacagatacccctcaactacgaggcctcagccggcaacacccacatgcgcatcaccagcgagctcccgcccgaagtcgtccaatgtctcgagaacgcgcgcttcctccacctagccacttgcgtcgacaacatgcctcacgtctcgctcatgaactacacctacctcccctcttcgccctattccgactctcccatcattgtcatgaccaccaaccccgccagcaagaagatgaacaacctggttgcgaacccgaacgtttctctgctagttcacgattgggtctcccaccgcccctccacctcccaccagcgtcgtccctccagcggttctcccggtccctcggaacaccgctcctcttctctcgcggcccttctcttcaacctcaataccagcgccgtctcctccatcagcgcgaccatcaacgggtccgcccggctcgtcgaccgcggctccgaggaggagcgcttctatcgggagaagcatctggagaacaacacatttgacagcgacccgcagccgtcgtcgattttgagcagcattcgaaggggcagcaccgcgggccagccgacatcaatgtcgcgaggtgggcaaggtgcgggggaagaaggagattatggtagggagagatatgtggcggatgaggaagtgagagtggtggtggtggggatccgggatgtccggattgcggattggaaggggacggtgcaggattgggttattgcgccgccggagggaaggagtgaggggacgaatgagactttggtgaatggtattcggtag

SEQ ID NO: 13294 - protein, 262 aa, Neurospora crassa
MNQQIPLNYEASAGNTHMRITSELPPEVVQCLENARFLHLATCVDNMPHVSLMNYTYLPSSPYSDSPIIVMTTNPASKKMNNLVANPNVSLLVHDWVSHRPSTSHQRRPSSGSPGPSEHRSSSLAALLFNLNTSAVSSISATINGSARLVDRGSEEERFYREKHLENNTFDSDPQPSSILSSIRRGSTAGQPTSMSRGGQGAGEEGDYGRERYVADEEVRVVVVGIRDVRIADWKGTVQDWVIAPPEGRSEGTNETLVNGIR

SEQ ID NO: 13295 - DNA, 621 bp, Leptosphaeria maculans
  CDS (1)..(621)
atgaattatacctatctgcccagcacgccgtattgtcagacaccaataatcattatgacaacgccagcgtcaagtcggaagacaagaaaccttgagtcgaatacccttgtctcactcttagttcatgactggatctcgcaccgacccccgactttgaaccagcctggccgatcaccatcacctgcccgaccatctccacgctcaggctcgctcgctgaactgcttctcggcatgaacactgcatctcttagcaggattagtactacaatcaacggtattgctgaattcgtaccctccggttccgaacaagaaatttggtacaaatcgcaacatttagcgaacaacaccttcggtcctagtggcgaggatctgtactcgaactcctcagccgaaggaggcctgtggagcggaattagcttgaataacaacgagatcattgctgcggatggggaaggaaacgatgatagtggcacgaagtcttatgtggatggagctgaaaacagagttgtcattgttcgagtaacaggcggcaggatagcagactggaaaggtcaagtcagagactggacagtgacggcaagcagatctcatgggccagtgaacggcgatattggaatctga

SEQ ID NO: 13296 - protein, 206 aa, Leptosphaeria maculans
MNYTYLPSTPYCQTPIIIMTTPASSRKTRNLESNTLVSLLVHDWISHRPPTLNQPGRSPSPARPSPRSGSLAELLLGMNTASLSRISTTINGIAEFVPSGSEQEIWYKSQHLANNTFGPSGEDLYSNSSAEGGLWSGISLNNNEIIAADGEGNDDSGTKSYVDGAENRVVIVRVTGGRIADWKGQVRDWTVTASRSHGPVNGDIGI

SEQ ID NO: 13297 - DNA, 612 bp, Phaeosphaeria nodorum
  CDS (1)..(612)
atgaactacacctacctccccagcaccccatactcccaatcacctacgatcatcatgacaaccccacccacgtcccgcaagacgctgaacctcgagtccaatcctctggtctcgctactggtacacgattggatttcacatcgcccacccactctgagccagccagctcgttcgccctctccaactcatcccgccccacgctctggttcactggctgaacttctcctgggtattaatactgcatcactcagtaggattagcaccaccatcaatggcacagcagagcttgttccatccggctccgcagaagagagttggtacaaggcccagcacttggcaaacaacacgtttgggtcgagcggagaggattcgtacgcgagctctcctgctgggggtgggttgtggggaggaggaggcctgattttggagtcagatcgaaatcgagaagcaggagaaggtgatggcgggaccaaatgctacgtcgagggaaaagaggtgagggtggtagttgtaagcattcgcgatggcagaatagcagactggcaaggtcaagtcagagattggcgtctcattgaggaccattcgacagcttccaatggtgtctctacatga

SEQ ID NO: 13298 - protein, 203 aa, Phaeosphaeria nodorum
MNYTYLPSTPYSQSPTIIMTTPPTSRKTLNLESNPLVSLLVHDWISHRPPTLSQPARSPSPTHPAPRSGSLAELLLGINTASLSRISTTINGTAELVPSGSAEESWYKAQHLANNTFGSSGEDSYASSPAGGGLWGGGGLILESDRNREAGEGDGGTKCYVEGKEVRVVVVSIRDGRIADWQGQVRDWRLIEDHSTASNGVST

SEQ ID NO: 13299 - DNA, 576 bp, Ashbya gossypii
  CDS (1)..(576)
atgaactctttaccagaccatatcctgcacctattgaagacatcgaagtatgttcacctggcgactgcatcatctgatggtgtaccttctgtatccttgatgaactacgcctacctcgcaccggagagctccgagacagaaggggacacgcactacatagtatttgcgacatctgctgtcactgagaaatacaagaatatcaccaccaatccaaatgtttccttattgatacatgactgggtcactgctaagaagctatccttgagaaagaatagcacgtctgcttcgctctcagggggcgcgggttcggaggctgagaaagctccgagccgtcttctgaatatattacaagagttaaatcagtcgaagctttctcagatgagtgctactcttaaagggcttgcagaggttatcgattcttcctctccagatttcgtgttataccgggatgccttgctcaaggctaatcctgatgccaagtgcttcgtcctgggggacgatgtggttatagtcaaggcccaaattactggtgccaaggtttccgataccagcaataacactgctatctactattag

SEQ ID NO: 13300 - protein, 191 aa, Ashbya gossypii
MNSLPDHILHLLKTSKYVHLATASSDGVPSVSLMNYAYLAPESSETEGDTHYIVFATSAVTEKYKNITTNPNVSLLIHDWVTAKKLSLRKNSTSASLSGGAGSEAEKAPSRLLNILQELNQSKLSQMSATLKGLAEVIDSSSPDFVLYRDALLKANPDAKCFVLGDDVVIVKAQITGAKVSDTSNNTAIYY

SEQ ID NO: 13301 - DNA, 24 bp, Primer
atggcttggactagtacattacca

SEQ ID NO: 13302 - DNA, 26 bp, Primer
ttaactcttccctttacttagaaaca

SEQ ID NO: 13303 - DNA, 1452 bp, Escherichia coli K12
  CDS (484)..(1383)
ggtgatttccgggaacaatttaatgataaacttcatggcggcaatggttcgttggcaagccttaagcgacttgtatagggaaaaatacagcagcccacacctgcggctgcatccaggcgcggaagtataccactaacatcgctttgctgtgcacatcaccttaccattgcgcgttatttgctatttgccctgagtccgttaccatgacggggcgaaaaatattgagagtcagacattcattatgccgaagaaaaatgaggcgcccgccagctttgaaaaggcgctgagcgagctggaacagattgtaacccgtctggaaagtggcgacctgccgctggaagaggcgctgaacgagttcgaacgcggcgtgcagctggcacgtcaggggcaggccaaattacaacaagccgaacagcgcgtacaaattctgctgtctgacaatgaagacgcctctctaaccccttttacaccggacaatgagtaatggactttccgcagcaactcgaagcctgcgttaagcaggccaaccaggcgctgagccgttttatcgccccactgccctttcagaacactcccgtggtcgaaaccatgcagtatggcgcattattaggtggtaagcgcctgcgacctttcctggtttatgccaccggtcatatgttcggcgttagcacaaacacgctggacgcacccgctgccgccgttgagtgtatccacgcttactcattaattcatgatgatttaccggcaatggatgatgacgatctgcgtcgcggtttgccaacctgccatgtgaagtttggcgaagcaaacgcgattctcgctggcgacgctttacaaacgctggcgttctcgattttaagcgatgccgatatgccggaagtgtcggaccgcgacagaatttcgatgatttctgaactggcgagcgccagtggtattgccggaatgtgcggtggtcaggcattagatttagacgcggaaggcaaacacgtacctctggacgcgcttgagcgtattcatcgtcataaaaccggcgcattgattcgcgccgccgttcgccttggtgcattaagcgccggagataaaggacgtcgtgctctgccggtactcgacaagtatgcagagagcatcggccttgccttccaggttcaggatgacatcctggatgtggtgggagatactgcaacgttgggaaaacgccagggtgccgaccagcaacttggtaaaagtacctaccctgcacttctgggtcttgagcaagcccggaagaaagcccgggatctgatcgacgatgcccgtcagtcgctgaaacaactggctgaacagtcactcgatacctcggcactggaagcgctagcggactacatcatccagcgtaataaataaacaataagtattaataggcccctgatgagttttgatattgccaaatacccgaccctggcactggtcgac

SEQ ID NO: 13304 - protein, 299 aa, Escherichia coli K12
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 13305 - DNA, 1816 bp, Oryza sativa (japonica cultivar-group)
  CDS (246)..(1457)
gtgagccgccacttccttccttccaaaaaggaagaggggaaaaaaaatctatagccaccaaattgagcaagattctcacacgaaaccaatcacaagctagcattcgtttaatttcttggctgctattgtccggggaagaggttcttggtgtccaaagaatttgtcggttctagggagctccaagttgctgtagcttcatttcttggttctttgggttcttggattggcggtactgattgtgggagatgttgtctgtgagctgcccgagagtgtacatgagcaggaaggcgctggatttcggtcagctggcctcctgccggtgccgttgggctggccggtccggcatgcgggtggcgccgaggcggcgcatgccatgtgtttgtttcgtggcctcaccgagccagccaggccttgctgcagttgatgtgccagcagaggcgatttctagtgcgagaacaacaacaatgatccctgagcgaatttctgtttcttcacttttggaggttgtctccgacgacctgctgaaactcaacaataatctgaaatcgcttgttggtgcagaaaatccagttttagtttctgcggcagaacaaattttcggtgctggtggaaaaaggttaagaccagcattagtttttctggtgtccagagcaactgctgaattagctggtttgttggagcttactacagagcatcaacgcctggcagagatcatagagatgattcacacagcaagtttaatacatgatgatgtcatagatgatagtggcatgaggagagggaaagaaactattcatcagctatatggaacacgggtggccgtacttgctggtgattttatgtttgcacaatcttcttggttcctagcgaacttagaaaacatcgaagttattaagctcatcagccaggtgatcaaggactttgccagtggtgagataaaacaagcatctactctttttgactgcgacgtcacccttgatgattacttgctcaagagctattataaaaccgcttcgttgctcgcctcaagcacaagatctgctgcaatattcagtggtgtaagcaccactatatgcgaacaaatgtatgaatacggcaggaatctcgggctctcgttccaggtagtagatgatattcttgactttacccaatcagctgagcaacttgggaaaccagcagggagtgacttagcaaagggaaacctgacagctccagtcatattcgctttgcaagatgaacccaaactaagggagataatcgattctgagttcagtgaaagtgattcattggctactgcaatcgacttggttcacagaagtggtggaataagaagggcgcaggagcttgcaaaggagaaaggtgacttggctctccaaaatttgcagtgccttcccaagagccagttcagaagtacccttgagaacgtggtgaaatataatcttcagaggattgactgatggattcacttgattcctctgaatcacttgatttctctgaatataagatgctcgcacccatgtgggttagtagctcccaaagaagttcatcttgctagaataatgtcgatcttgggaagatgattacaagcagcaactttttgttgtggatccaccaccaacatgtatcatagcatcctattttgcagtttatgtaactacaaggcagataaaggaactaaggaagcatagtgtatatttcatagtagtttcggcttcttgatacacgaaatagtatttttttcccctcccctttctgccatttcatttgtcattggagaacgactatgaattaattaacatgattatactttatagcc

SEQ ID NO: 13306 - protein, 403 aa, Oryza sativa (japonica cultivar-group)
MLSVSCPRVYMSRKALDFGQLASCRCRWAGRSGMRVAPRRRMPCVCFVASPSQPGLAAVDVPAEAISSARTTTMIPERISVSSLLEVVSDDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLLASSTRSAAIFSGVSTTICEQMYEYGRNLGLSFQVVDDILDFTQSAEQLGKPAGSDLAKGNLTAPVIFALQDEPKLREIIDSEFSESDSLATAIDLVHRSGGIRRAQELAKEKGDLALQNLQCLPKSQFRSTLENVVKYNLQRID

SEQ ID NO: 13307 - DNA, 909 bp, Erwinia uredovora
  CDS (1)..(909)
atgacggtctgcgcaaaaaaacacgttcatctcactcgcgatgctgcggagcagttactggctgatattgatcgacgccttgatcagttattgcccgtggagggagaacgggatgttgtgggtgccgcgatgcgtgaaggtgcgctggcaccgggaaaacgtattcgccccatgttgctgttgctgaccgcccgcgatctgggttgcgctgtcagccatgacggattactggatttggcctgtgcggtggaaatggtccacgcggcttcgctgatccttgacgatatgccctgcatggacgatgcgaagctgcggcgcggacgccctaccattcattctcattacggagagcatgtggcaatactggcggcggttgccttgctgagtaaagcctttggcgtaattgccgatgcagatggcctcacgccgctggcaaaaaatcgggcggtttctgaactgtcaaacgccatcggcatgcaaggattggttcagggtcagttcaaggatctgtctgaaggggataagccgcgcagcgctgaagctattttgatgacgaatcactttaaaaccagcacgctgttttgtgcctccatgcagatggcctcgattgttgcgaatgcctccagcgaagcgcgtgattgcctgcatcgtttttcacttgatcttggtcaggcatttcaactgctggacgatttgaccgatggcatgaccgacaccggtaaggatagcaatcaggacgccggtaaatcgacgctggtcaatctgttaggcccgagggcggttgaagaacgtctgagacaacatcttcagcttgccagtgagcatctctctgcggcctgccaacacgggcacgccactcaacattttattcaggcctggtttgacaaaaaactcgctgccgtcagttaa

SEQ ID NO: 13308 - protein, 302 aa, Erwinia uredovora
MTVCAKKHVHLTRDAAEQLLADIDRRLDQLLPVEGERDVVGAAMREGALAPGKRIRPMLLLLTARDLGCAVSHDGLLDLACAVEMVHAASLILDDMPCMDDAKLRRGRPTIHSHYGEHVAILAAVALLSKAFGVIADADGLTPLAKNRAVSELSNAIGMQGLVQGQFKDLSEGDKPRSAEAILMTNHFKTSTLFCASMQMASIVANASSEARDCLHRFSLDLGQAFQLLDDLTDGMTDTGKDSNQDAGKSTLVNLLGPRAVEERLRQHLQLASEHLSAACQHGHATQHFIQAWFDKKLAAVS

SEQ ID NO: 13309 - DNA, 993 bp, Sulfolobus acidocaldarius
  CDS (1)..(993)
atgagttactttgacaactattttaatgagattgttaattctgtaaacgacattattaagagctatatatctggagatgttcctaaactatatgaagcctcatatcatttgtttacatctggaggtaagaggttaagaccattaatcttaactatatcatcagatttattcggaggacagagagaaagagcttattatgcaggtgcagctattgaagttcttcatacttttacgcttgtgcatgatgatattatggatcaagataatatcagaagagggttacccacagtccacgtgaaatacggcttacccttagcaatattagctggggatttactacatgcaaaggcttttcagctcttaacccaggctcttagaggtttgccaagtgaaaccataattaaggctttcgatattttcactcgttcaataataattatatccgaaggacaggcagtagatatggaatttgaggacagaattgatataaaggagcaggaataccttgacatgatctcacgtaagacagctgcattattctcggcatcctcaagtataggcgcacttattgctggtgctaatgataatgatgtaagactgatgtctgatttcggtacgaatctaggtattgcatttcagattgttgacgatatcttaggtctaacagcagacgaaaaggaacttggaaagcctgtttttagtgatattagggagggtaaaaagactatacttgtaataaaaacactggagctttgtaaagaggacgagaagaagattgtcctaaaggcgttaggtaataagtcagcctcaaaagaagaattaatgagctcagcagatataattaagaaatactctttagattatgcatacaatttagcagagaaatattataaaaatgctatagactctttaaatcaagtctcctctaagagtgatatacctggaaaggctttaaaatatctagctgaatttacgataagaaggagaaaataa

SEQ ID NO: 13310 - protein, 330 aa, Sulfolobus acidocaldarius
MSYFDNYFNEIVNSVNDIIKSYISGDVPKLYEASYHLFTSGGKRLRPLILTISSDLFGGQRERAYYAGAAIEVLHTFTLVHDDIMDQDNIRRGLPTVHVKYGLPLAILAGDLLHAKAFQLLTQALRGLPSETIIKAFDIFTRSIIIISEGQAVDMEFEDRIDIKEQEYLDMISRKTAALFSASSSIGALIAGANDNDVRLMSDFGTNLGIAFQIVDDILGLTADEKELGKPVFSDIREGKKTILVIKTLELCKEDEKKIVLKALGNKSASKEELMSSADIIKKYSLDYAYNLAEKYYKNAIDSLNQVSSKSDIPGKALKYLAEFTIRRRK

SEQ ID NO: 13311 - DNA, 819 bp, Bacillus subtilis
  CDS (1)..(819)
atgacaaataaattaacgagctttctggcggaccggaaaaaaacaattgaaaatcagctttctgtctatacagaaaagcttgatatgccggactcattaaagaaatctatgctatattctctacaggccggcggaaagcggttgcggcctctgattgtactggctgttttaaatgcatatggaaaaagcgaaaaagacggcattccggtgggctgtgctgtcgaaatgattcacacgtattcgttaattcatgatgatcttccatgcatggatgatgacgatttgcgccgcgggaagccgacaaaccataaagtgtttggtgaagcgacggcagtattagcgggtgacgggctgctcacagaaagctttaagctgattacctcccacgtgtcagacgaggtgtcagcagaaaagcgcctgcggcttgtgaatgaactgatttcagcggcaggcaccgaaggcatggtcggtgggcaagtagctgatatggaagcgggaaaccgacaagtcacgcttgaagagctcgaatccattcatgaacggaaaacttccaagctccttggcttttgtgtaatcgccggtgctattttggctgatgcgcctgaggaagacattgaaacactgcgtaccttcagcagccacattggaatcggatttcaaatcagagacgatattttagatttagaaggcagtgaagagaaaatcggcaaacgtgtcggctcggataccacaaatgacaaatcgacatacccgtcgcttctttcattggaaggggccaaacataaattggatgttcatataaaagaggcgaacgattga

SEQ ID NO: 13312 - protein, 272 aa, Bacillus subtilis
MTNKLTSFLADRKKTIENQLSVYTEKLDMPDSLKKSMLYSLQAGGKRLRPLIVLAVLNAYGKSEKDGIPVGCAVEMIHTYSLIHDDLPCMDDDDLRRGKPTNHKVFGEATAVLAGDGLLTESFKLITSHVSDEVSAEKRLRLVNELISAAGTEGMVGGQVADMEAGNRQVTLEELESIHERKTSKLLGFCVIAGAILADAPEEDIETLRTFSSHIGIGFQIRDDILDLEGSEEKIGKRVGSDTTNDKSTYPSLLSLEGAKHKLDVHIKEAND

SEQ ID NO: 13313 - DNA, 870 bp, Chlamydophila pneumoniae, Chlamydia pneumoniae
  CDS (1)..(870)
atgttacatgctttagatacgtatcgaccttctatagaaagtgctatagaaaaggctttggaaggatttggtcctataggtcacccgattcgctctcctgtagaatacgctttacagggcggtggaaagcgtttaagacctggtttagtctgcatgatggctcaaggtttgggcttaaatcatgacgttatggactcagctttagctgtagagtttgtccacacttccaccctaattgcggacgatcttccttgcatggacaacgacgatgagcgtaggggacgcccgacggtacataaagctttcgatgaagcaaccgccttactcgcatcttacgccctaattcctgctgcttactcccaccttcgcttaaacgcaaagaagttaaaagaacagggctgtgatcctagagaaatagatatcgcttacaacattatcggagatattacagacaaaaatattggatgttctggggtattaggagggcagtatgatgatatgttcttttctaaccgaggtcaagaacacgtacaatctattatgatcaaaaaaacgggttctctatttgagattgcatgtatttctggttggttatttggtggcggagacccacaatttgcacctataattacaagtttctcaaataattttggcttactttttcaaataaaagatgatttttcagatttacaaaaagactcccaacaaattgggctaaattatgctttactatttggagaaaaggccgctctagagctattagcaagatctcaaaacaattgcttagagctcttggatcgtctcagtgctggtggattaaagaatagttctgaattcgaaacgattatctcgagtttaggatctttttaa

SEQ ID NO: 13314 - protein, 289 aa, Chlamydophila pneumoniae, Chlamydia pneumoniae
MLHALDTYRPSIESAIEKALEGFGPIGHPIRSPVEYALQGGGKRLRPGLVCMMAQGLGLNHDVMDSALAVEFVHTSTLIADDLPCMDNDDERRGRPTVHKAFDEATALLASYALIPAAYSHLRLNAKKLKEQGCDPREIDIAYNIIGDITDKNIGCSGVLGGQYDDMFFSNRGQEHVQSIMIKKTGSLFEIACISGWLFGGGDPQFAPIITSFSNNFGLLFQIKDDFSDLQKDSQQIGLNYALLFGEKAALELLARSQNNCLELLDRLSAGGLKNSSEFETIISSLGSF

SEQ ID NO: 13315 - DNA, 975 bp, Neisseria meningitidis
  CDS (1)..(975)
atgctcgagaatctgccctatttccagcgacatctgcctgaagaccttgccaaagtcaatgaagtcatcaaccgtgcggtgcaatccgatgtcgcactgatttcgcaaatcggtacatatatcatcagcgcgggcggcaaacgcctgcgtccgattatgacgattttggcgggtaaggcggtcggttatgatgacgagaaactgtattcgctggcggcgatggtcgagtttatccacacttccaccctcctgcacgacgatgtcgtcgatgaaagcgatttgcgccgtgggcgggcaacggcaaacaatctgttcggcaatgcggcggctgtgttggttggcgactttttatacacgcgcgcctttcaactgatggttgcctcgggcagtatgcgcgttttggaagtgatggcggatgcaaccaacattattgccgagggcgaagtcatgcagctgatgaacatcggcaatacggacattaccgaagaacaatatatccaagtcatccaatataaaacggcaaaattgtttgaagctgccgctcaagtcggcgcaattttgggcaaggcttcccccgaacacgaacgggcgttgaaagactacggtatgtatgtcggtacggcattccaaattattgacgatgtgctggactattctggcgaaaccgaagaaaccggcaaaaacgtcggcgacgatttggcggaaggaaaaccgactttgcctttgatttatctgatgcgtcagggttccgaacaggttgcgaacgatgtgcgtactgctttggaaaatgcagatcgcagctattttgagaaaatccacgattatgtcgtccgttcggatgcgttggcatattcgataggcgaggcgcgcaaagcagtcgattgtgccgttaccgccttggatgccctgcccgacagcgaagtgaaggatgccatgattcagctggcgaaggaatctttggtcagggtgtcttga

SEQ ID NO: 13316 - protein, 324 aa, Neisseria meningitidis
MLENLPYFQRHLPEDLAKVNEVINRAVQSDVALISQIGTYIISAGGKRLRPIMTILAGKAVGYDDEKLYSLAAMVEFIHTSTLLHDDVVDESDLRRGRATANNLFGNAAAVLVGDFLYTRAFQLMVASGSMRVLEVMADATNIIAEGEVMQLMNIGNTDITEEQYIQVIQYKTAKLFEAAAQVGAILGKASPEHERALKDYGMYVGTAFQIIDDVLDYSGETEETGKNVGDDLAEGKPTLPLIYLMRQGSEQVANDVRTALENADRSYFEKIHDYVVRSDALAYSIGEARKAVDCAVTALDALPDSEVKDAMIQLAKESLVRVS

SEQ ID NO: 13317 - DNA, 885 bp, Vibrio cholerae
  CDS (1)..(885)
atgattgaggcgttatcctcataccaacagcgaaataaccagcaactggatcagtggctgaaccgtattccctttcaaaccttgcctttaatcgaggcgatgcgttacgggctactgctcggcggcaaacgggcacggccatatttggtgtacatcacggggcaaatgctcggctgtgagcttagcgacttagacactcctgcctcagccgtggagtgtattcacgcctattcgctgatccatgatgatttgcccgccatggatgatgatgagctgcgccgcggcaagcccacttgccatatccagtttgatgaggccaccgccattttgaccggcgacgccctgcaaaccttggcgtttactattttggcggaaggcgatctttctgctgcaggcgaaacacagcgcgtcgccatgctccaagctcttgccgaagcttctggcgcacaaggcatgtgccttggtcaagcgttagatctggcggcggaaaatcgcttaatttcgctagaggaattggaaaccattcatcgcaataaaaccggcgctttaatgcgctgcgcgatccgtttaggtgctttagccgcaggtgaaaaaggccgcgccatgctaccgcatcttgatcgctatgcagaagcggttggcctcgcgtttcaggttcaagatgacattctcgatatcattagcgataccgaaacccttggtaaaccacagggttctgaccaagaattaaataaaagtacctaccctgctcttttaggcttagaaggagcacaacaaaaagcacacactctgttacaagaagcgcttctggctttagaagcaattccctacaatacggagcatctggaagagttcgcccgatatgtcgtcgagcgcaagaactaa

SEQ ID NO: 13318 - protein, 294 aa, Vibrio cholerae
MIEALSSYQQRNNQQLDQWLNRIPFQTLPLIEAMRYGLLLGGKRARPYLVYITGQMLGCELSDLDTPASAVECIHAYSLIHDDLPAMDDDELRRGKPTCHIQFDEATAILTGDALQTLAFTILAEGDLSAAGETQRVAMLQALAEASGAQGMCLGQALDLAAENRLISLEELETIHRNKTGALMRCAIRLGALAAGEKGRAMLPHLDRYAEAVGLAFQVQDDILDIISDTETLGKPQGSDQELNKSTYPALLGLEGAQQKAHTLLQEALLALEAIPYNTEHLEEFARYVVERKN

SEQ ID NO: 13319 - DNA, 1047 bp, Vibrio cholerae
  CDS (1)..(1047)
atgatttttagtgtattatgcagcgattccagaagactaaatgccttacacgctcttatttcagccggatttacgatggattttaaagctatccaagcgcttactgccaatgacatggcaaaagtgaacgaaacgattcacgctcaactcaattctgacgtttccctaatcaaccaacttggtttctatatcatcagtggtggtgggaagcgtttacgcccattgctggcggttttatccgccaaagcgctcggttatcaagggtcacatcacacgactgctgctgcgtttattgaattcattcatacggcaaccctgttgcacgatgatgtggtcgatgaatcagacttgcgccgcggtaaagcaaccgccaatgccgcgtttggtaatgccgccagcgtattagtcggtgattttatctacactcgctcgtttcagatgatgacagaattaggatcaatgaagatcctgaaactgatgagtgatgcagtaaacgtgatcgctgaaggtgaagtacagcaattaatgaactgtaacgatcctgataccaccgaagccagctacatgcaggttatttactccaaaactgcacgtctgtttgaagcggcaacccagattggcgctatcctgtgtgatgcttctcctgaagtcgaactggcgatgcaaaactacggtaaatacctaggcacagccttccaactgattgatgatgtgatggattacacttcagatggtgatgagatgggtaaaaacgtcggtgacgatctggcagaaggcaaacctaccctaccactgctttatgcgatgcagcacgggaatcctgagcaagccgcgatgatccgtgaagccatcgagaaagccaatggcatgtcgcgtcttaatgagattctcgcagcgatggagcaaaccggttctttacaatacaccattgaaaaggcgctgcatgaagcggataaagccatcgctgaacttgcgattttgccagaaagcgaatacaaacaagccttgatcacgctcgcccatatggcggtcaatcgcagtaaatag

SEQ ID NO: 13320 - protein, 348 aa, Vibrio cholerae
MIFSVLCSDSRRLNALHALISAGFTMDFKAIQALTANDMAKVNETIHAQLNSDVSLINQLGFYIISGGGKRLRPLLAVLSAKALGYQGSHHTTAAAFIEFIHTATLLHDDVVDESDLRRGKATANAAFGNAASVLVGDFIYTRSFQMMTELGSMKILKLMSDAVNVIAEGEVQQLMNCNDPDTTEASYMQVIYSKTARLFEAATQIGAILCDASPEVELAMQNYGKYLGTAFQLIDDVMDYTSDGDEMGKNVGDDLAEGKPTLPLLYAMQHGNPEQAAMIREAIEKANGMSRLNEILAAMEQTGSLQYTIEKALHEADKAIAELAILPESEYKQALITLAHMAVNRSK

SEQ ID NO: 13321 - DNA, 858 bp, Lactococcus lactis subsp. lactis
  CDS (1)..(858)
atggatacgaagatactaaagttagaagactttttaactgaattttatgaaagcgctgaatttccaactggcttagccgaatcagcaaaatattctttattggcaggcggtaaacgaattcgccccctcctttttttaaacctattagaggcttttgatttagaattgagtaaggctcattatcatgtggcagccgcacttgagatgattcatacgggttctttaatccatgatgacttaccagcaatggataatgatgattatcgtcgagggcagttaactaatcacaagaaatttgacgaggcaactgcaattttagctggtgatactttattttttgaccctttctttatcctttcaactgctgatttatccgcagaaataatagtagcgttgacgcgtgaattggcctttgcttcaggttcttatggaatggttgcgggtcaaatcttggatatggctggtgaaggaaaagagttgacattagctgaaattgagcagattcatcgcttgaaaactgggcgacttttaacttttccttttgtagctgctggaattgttgctcaaaaatcaacggatgaagttgaaaaacttcgtcaagtggggcaaattttgggattggcttttcaaattcgagacgatattttagatgtcacagcaacttttgctgagcttggaaaaacaccaggtaaggatattttagaggagaaatcaacatatgttgctcatttaggacttgagggagcaaaaaaatcactgacaggaaatttgtcagaagttaaaaaattactgacagacttatcagttactgacagctctgaaatttttaaaattattgagcaattggaagtgaaataa

SEQ ID NO: 13322 - protein, 285 aa, Lactococcus lactis subsp. lactis
MDTKILKLEDFLTEFYESAEFPTGLAESAKYSLLAGGKRIRPLLFLNLLEAFDLELSKAHYHVAAALEMIHTGSLIHDDLPAMDNDDYRRGQLTNHKKFDEATAILAGDTLFFDPFFILSTADLSAEIIVALTRELAFASGSYGMVAGQILDMAGEGKELTLAEIEQIHRLKTGRLLTFPFVAAGIVAQKSTDEVEKLRQVGQILGLAFQIRDDILDVTATFAELGKTPGKDILEEKSTYVAHLGLEGAKKSLTGNLSEVKKLLTDLSVTDSSEIFKIIEQLEVK

SEQ ID NO: 13323 - DNA, 882 bp, Staphylococcus aureus
  CDS (1)..(882)
atgacgaatctaccgatgaataaattaatagatgaagtcaataatgaattatcggttgcgataaataaatcagtaatggatactcagctagaagaaagcatgttgtattcattaaatgctggaggtaaacgcatccgaccagttctgttattactcactttagattcactaaataccgagtatgagttaggtgtgaagagcgcaattgcactagaaatgattcatacatattcacttattcatgatgacctaccagcgatggataatgatgattatcgacgagggaaattaacaaatcataaagtatatggtgagtggactgcgatattagcaggtgatgctttattaactaaagcatttgaacttatttcaagtgatgatagattaactgatgaagtaaaaataaaagttctacaacggctgtcaatagcaagtggtcatgttggaatggtcggcggtcaaatgttagatatgcaaagcgaaggccaaccaattgatcttgaaactttggaaatgatacacaaaacaaaaacaggagcattattaacttttgcggttatgagtgcagcagatatcgctaatgtcgatgatgcaactaaagaacatttagaaagttatagttatcatttaggtatgatgttccagattaaagatgatttattagactgctatggtgatgaagcaaagttaggtaaaaaagtgggcagcgatcttgaaaataataaaagtacgtacgtgagtttattagggaaagatggcgcagaagataaattgacttatcatagagacgcagcagtggatgaactaacgcaaattgatgaacaattcaatacaaaacacttattagaaatcgttgatttattttatagcagggatcactaa

SEQ ID NO: 13324 - protein, 293 aa, Staphylococcus aureus
MTNLPMNKLIDEVNNELSVAINKSVMDTQLEESMLYSLNAGGKRIRPVLLLLTLDSLNTEYELGVKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDATKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 13325 - DNA, 882 bp, Listeria monocytogenes
  CDS (1)..(882)
atgcaagatttaaccctttttttagaacaatataaaaaagtgattgatgagtcgctttttaaagaaataaacgagcgaaatatcgaacctagactaaaagagtccatgttatattctattcaagcaggcgggaaacggattcgtccaatgctagttttcgctacgcttcaagctttaaaagtaaatccgcttttaggtgtaaaaaccgcaacagcgttagaaatgattcacacatacagccttattcatgatgatctaccagcaatggataacgatgattatcgtcgaggcaagtggactaatcataaagtttttggcgatgcaactgcgattttggcaggagatgctttactaacgctcgctttttctattttagctgaagacgataatttatcttttgagacacgcattgctttgattaaccaaattagttttagtagcggtgcagaaggaatggttggtggtcaacttgcagacttggaagcggaaaacaaacaagtgacgctagaagagttatcatccattcatgcacgaaaaacgggtgaattattaatttatgctgtaacctctgcagcaaaaattgcggaagctgatccagaacaaacgaaacgcttacgaatttttgcagagaatattgggattggatttcaaattagcgacgatattttagatgtaattggtgatgaaacgaaaatgggtaaaaagacaggggccgacgcttttctgaataaaagtacctatcccggattactcacgcttgatggggcaaaaagggcattaaatgagcatgttacgattgcaaagtcagcgctttcagggcatgatttcgatgatgaaattctcttgaaacttgctgatttaatcgcacttagagaaaattaa

SEQ ID NO: 13326 - protein, 293 aa, Listeria monocytogenes
MQDLTLFLEQYKKVIDESLFKEINERNIEPRLKESMLYSIQAGGKRIRPMLVFATLQALKVNPLLGVKTATALEMIHTYSLIHDDLPAMDNDDYRRGKWTNHKVFGDATAILAGDALLTLAFSILAEDDNLSFETRIALINQISFSSGAEGMVGGQLADLEAENKQVTLEELSSIHARKTGELLIYAVTSAAKIAEADPEQTKRLRIFAENIGIGFQISDDILDVIGDETKMGKKTGADAFLNKSTYPGLLTLDGAKRALNEHVTIAKSALSGHDFDDEILLKLADLIALREN

SEQ ID NO: 13327 - DNA, 1017 bp, Agrobacterium tumefaciens
  CDS (1)..(1017)
atgggcgtcgtcataccgcttgaagaaagcaaaaacaaactcgcatccgtcaagccgcttgtcgacctgacccgtcccgacatggaacgggtgaaccagctcatcctttccagggccggttccgatgtccagatgatacccgaggtggccaaccatcttatctcctccggcggcaaacgcctgcggccgatgctgacgctcgcctcggcctcgatgttcggttatgagggagataaccacatcaagctcgccaccagcgtggagttcatgcatacggcgacgcttctgcacgacgatgtggtggatgaaagcgatctgcgtcgcggcaaatccaccgcccgcaccatctggggcaaccaggcgagcgttctcgtcggcgacttcctgctcggccaggctttccgcatgatggtggatgtcggttcgctggatgcgctggatgtgctctccaccgccgcttccgtcatcgccgagggcgaggtgctgcagctttcggtcgccaagaacatggaaacgaccgaggacgattacctgcaggtgattcgcgccaagacggccgccctctttgccgccgcggccgaagtcggccccattgtcgccaagacggacaaggcgagccgcagcgcgctgaaatcctatggcatgaatctcggcctcgctttccagctggtcgacgacgtgctggactatggcggcaagtccgccgatctcggcaagaacaccggtgacgatttccgcgagggcaagatcacgctgccggtcatcctgtcttatcgccgcggcacgcaggatgagcgcgccttctggcgcaacgccatcgaaaagggcgaaagcagcgacgagaacctggaaaaggctcttggtctgatcaccaagtataacggcttgggcgacacgatcggtcgcgccacacattacggcacgattgcccgtgacgcgcttgcgccgttgccgcagagcccatggaaaaatgcacttctcgaggtcatcgacttctgcatcgagcgtctcaactga

SEQ ID NO: 13328 - protein, 338 aa, Agrobacterium tumefaciens
MGVVIPLEESKNKLASVKPLVDLTRPDMERVNQLILSRAGSDVQMIPEVANHLISSGGKRLRPMLTLASASMFGYEGDNHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKASRSALKSYGMNLGLAFQLVDDVLDYGGKSADLGKNTGDDFREGKITLPVILSYRRGTQDERAFWRNAIEKGESSDENLEKALGLITKYNGLGDTIGRATHYGTIARDALAPLPQSPWKNALLEVIDFCIERLN

SEQ ID NO: 13329 - DNA, 930 bp, Nostoc sp. PCC 7120
  CDS (1)..(930)
atggtagcagctgataacctccggaagatgtcagaggaagccaaatttaatctagtagcttatcttaaagagcggcaaaaactttgtgaagctgctttggatgcagccatacctattatttatccagaaaaaatttatgaatcaatgcgctactctctattagctggaggtaagcgcctgcgtccgattctttgtctggctacctcggaaatgatgggtgggacaatcgaaatagctatgccaacagcttgtgctgtagaaatgatccacaccatgtctttgattcacgacgacttgccagcaatggataacgacgattatcgtcgcggtatgctgacgaatcacaaggtatatggtgaagatattgcgattttggcgggagatggcttattagcctacgcttttgagttcgtagctatccgtactcctgaaagcgtacctagagaccgagtattgcaggtagtagcccgtttaggacgagcattgggagctgctggcttggttgggggtcaagtggttgacttagactcagaaggaaaatcagatacttccttagaaacactcaattttattcataatcacaaaacagcagctcttttagaagcttgtgtagtctgtggcggcattttagctggggcatcatcagaaaatgtacaaagactctcacgatattctcaaaatattgggctagcatttcaaatcattgatgatattcttgatatcacttctactcaagagcaattaggcaagactgcgggtaaagaccttttagcgaagaaagttacctatcctagcctgtggggaattgaacaatcgcgcgtcaaagcccaacagctaattgaggcagcttgtacagaactagaaccatttggagaagatgcacagcccctgaaagcgatcgctcacttcatcactagtcgtaatcactaa

SEQ ID NO: 13330 - protein, 309 aa, Nostoc sp. PCC 7120
MVAADNLRKMSEEAKFNLVAYLKERQKLCEAALDAAIPIIYPEKIYESMRYSLLAGGKRLRPILCLATSEMMGGTIEIAMPTACAVEMIHTMSLIHDDLPAMDNDDYRRGMLTNHKVYGEDIAILAGDGLLAYAFEFVAIRTPESVPRDRVLQVVARLGRALGAAGLVGGQVVDLDSEGKSDTSLETLNFIHNHKTAALLEACVVCGGILAGASSENVQRLSRYSQNIGLAFQIIDDILDITSTQEQLGKTAGKDLLAKKVTYPSLWGIEQSRVKAQQLIEAACTELEPFGEDAQPLKAIAHFITSRNH

SEQ ID NO: 13331 - DNA, 1089 bp, Brucella melitensis
  CDS (1)..(1089)
atgtggtcgaaacgaaaagttggagccttagcccgacctgaccgggcgcacgccgctccaggagaaatggcattgggtgtggttctgaatctcgacggtaaaatgaagcaggaaggatcggtgcagccgctggtcgacctcaccagggccgatatggcgcgcgtgaacgagttgatcctgtcccgcgcggggtccgatgtcgaaatgataccggaggttgccaaccacctcatttcatccggcggcaagcgcctgcgcccgatgatgaccctggcctccgcccgcatgttcggctatgagggcgatggccatgtgcgccttgcaacctcggtcgaattcatgcacacggcgaccctcctgcacgatgatgtggtcgatgaaagcgacctgcgccgcggcaagagcacggcgcgcacgatctggggcaaccaggccagtgttctcgtcggcgatttcctgctgggtcaggcgttcaagatgatggtcgatgtcggctcgctcgatgcgctcgacgtgctggccacctccgcctccatcattgcggaaggcgaggtgatgcagcttgccgcagccaagaacatggaaaccaccgaagacgaatatctggcagtcatcaaggcgaagactgccgcgctcttttcagcggccgcggaagtggggccgatcattgccggcgcgcaacgctccgaccgcgcggccctgcgcgattacggcctcaatctgggccttgctttccagcttgttgacgatgcgcttgattatggcggttcggctgccgatctcggcaagaataccggcgacgatttccgcgaaggcaagatcacgcttcccgtcatcctcagctatcgccgtggcaccgacgaggagcgcgctttctggaaaggggctatcgaaggcggcgcgagcgacgacgcttccttgcagaaggcaatcggcctgatgatgaaacacggcgcgattgccgacacggtgcagcgcgcccgccatttcggcgagatcgcacgcgatgcgctggccccgctcaaggcgtcgccgcaaaaggatgcgctgatcgaggtggtcgatttctgcatcagccgtgtcaattga

SEQ ID NO: 13332 - protein, 362 aa, Brucella melitensis
MWSKRKVGALARPDRAHAAPGEMALGVVLNLDGKMKQEGSVQPLVDLTRADMARVNELILSRAGSDVEMIPEVANHLISSGGKRLRPMMTLASARMFGYEGDGHVRLATSVEFMHTATLLHDDVVDESDLRRGKSTARTIWGNQASVLVGDFLLGQAFKMMVDVGSLDALDVLATSASIIAEGEVMQLAAAKNMETTEDEYLAVIKAKTAALFSAAAEVGPIIAGAQRSDRAALRDYGLNLGLAFQLVDDALDYGGSAADLGKNTGDDFREGKITLPVILSYRRGTDEERAFWKGAIEGGASDDASLQKAIGLMMKHGAIADTVQRARHFGEIARDALAPLKASPQKDALIEVVDFCISRVN

SEQ ID NO: 13333 - DNA, 882 bp, Listeria innocua
  CDS (1)..(882)
atgcaagatttgatgctttttctagatcattataaaaaagtacttgatgagtcgctttttaaagaaataaatatgcgcaatatcgaacctaagttgaaagaatcaatgttatattcagtgcaagctggcggaaaacgaattcgtccaatgcttgtttttgcaacgcttcaagccttaaatattgagccaatgcgcggtttaaaaacagctacggcacttgaaatgattcatacgtacagcttaattcacgatgatttaccagcaatggatgatgatgactatcgacgcgggaaatggacgaaccataaaatatacggtgatgcaacagcaattttagcaggagatgctttgttaacactcgctttttctattttagctgaagatgaaaatctatctttcgaaacgcgtattgctttaattaatcaaattagttatagcagtggagcagaaggcatggtaggtgggcaacaagccgatatggaagctgaaaataaacaagtcacattagaagaactagcatcaatccacgctcgcaaaactggtgaactattaattttcgcagtaacctcagccgcaaaaatcgctgaagcaactccagaacaaacaaaacgattacgaatttttgcagaaaatatcggcattggttttcaaattagcgacgatattttagatgtaattggcgatgaaacaaaaatgggtaaaaagacaggggtcgacgcttttctgaataaaagtacctatcccggattactcacactcgaaggtgctaaacgggcattaaatgagcatgtttcaattgcaaagtcagcgctttcaggacatgatttcgacgatgaaattctccttaaacttgctgatttaatcgcacttagagaaaattaa

SEQ ID NO: 13334 - protein, 293 aa, Listeria innocua
MQDLMLFLDHYKKVLDESLFKEINMRNIEPKLKESMLYSVQAGGKRIRPMLVFATLQALNIEPMRGLKTATALEMIHTYSLIHDDLPAMDDDDYRRGKWTNHKIYGDATAILAGDALLTLAFSILAEDENLSFETRIALINQISYSSGAEGMVGGQQADMEAENKQVTLEELASIHARKTGELLIFAVTSAAKIAEATPEQTKRLRIFAENIGIGFQISDDILDVIGDETKMGKKTGVDAFLNKSTYPGLLTLEGAKRALNEHVSIAKSALSGHDFDDEILLKLADLIALREN

SEQ ID NO: 13335 - DNA, 921 bp, Yersinia pestis
  CDS (1)..(921)
atgtcggatacccatgcacctgttgattttaaacaacaacttgccgctcatcagcagcgagtcaatcaggctctgctggatttcattgctcccctgccgtttggcaacagcaatttaatcgaggccatgcgctatggtgcggtaatcgggggtaagcgtctccgcccctatctggtctatgccacagggcaaatgtttggtttgtcactcgccaacttagacgccccggcggcggcaattgaatgtattcatgcctattcattaatacatgatgatctgcccgccatggacgatgatgatttacgccgtgggcagccgacttgccacgttaagtttggcgaggcccacgctattttggccggtgatgcactgcaaacgctggccttttctattttggctgaagcccccatgcccgatgtcgctgataaagatcgcctatcgatgattatcgagttggctcaagccagtggggctgcggggatgtgtgcgggtcaggcgctagatctggaagcagaaactcgccctgttttattaggtgaccttgagcaaatccaccgtcataaaaccggtgcgttgattcgtgcggcagttcgccttggcgcccaggcagccggtgaagctggccgtaaaacattattgtcactcgatcgttacgccgaggccatcggtttagcctttcaagtccaggacgatattttagacgtcattggcgacacagctacaattggtaaacgtcaaggatcagaccaacaactaggcaaaagtacttatccggcgctacttggtctggattgtgcccaaacaaaagcgatggatctttatcaggaggcactagaggccttggatgaattggcaaaacagtcctataacacggattcattgcaggcattagctcgtttcattattgagcgtaataattaa

SEQ ID NO: 13336 - protein, 306 aa, Yersinia pestis
MSDTHAPVDFKQQLAAHQQRVNQALLDFIAPLPFGNSNLIEAMRYGAVIGGKRLRPYLVYATGQMFGLSLANLDAPAAAIECIHAYSLIHDDLPAMDDDDLRRGQPTCHVKFGEAHAILAGDALQTLAFSILAEAPMPDVADKDRLSMIIELAQASGAAGMCAGQALDLEAETRPVLLGDLEQIHRHKTGALIRAAVRLGAQAAGEAGRKTLLSLDRYAEAIGLAFQVQDDILDVIGDTATIGKRQGSDQQLGKSTYPALLGLDCAQTKAMDLYQEALEALDELAKQSYNTDSLQALARFIIERNN

SEQ ID NO: 13337 - DNA, 1014 bp, Aeropyrum pernix
  CDS (1)..(1014)
atgggtgtcagcgttttgaagtgggatagactgtttgaagcctcgtcgagatactcgatgctcatagaccactatataatggattttatgagcataactcctgacaggcttagcggggcatcgctacacctcattaaggccggcgggaagaggctcagacccctgataacactcttgacggcgaggatgctggggggtctagaggctgaggcccgtgcaatccctcttgcagcatctatagagacggcccacacgttttcgcttatacacgatgacatcatggatagggatgaggtgaggaggggcgtccccacaacccatgtagtctacggcgatgactgggctatactggctggcgacacgctgcacgcggcggccttcaagatgatagccgattctagggagtgggggatgagccatgaacaggcctaccgggccttcaaagttctttctgaggctgctatacagatatccaggggtcaggcgtacgacatgctcttcgaggagacctgggatgttgatgtagccgactacctcaacatggtcaggctcaagactggcgctctcatagaggcggcggcgcgcataggagccgtcgctgcgggggctggcagcgagattgagaagatgatgggtgaggtgggtatgaacgctggcatcgccttccagataagggatgacatactgggcgttataggtgatccaaaggttactggcaagcctgtttacaacgacttgaggagggggaagaagacgctgctggtgatatacgctgtcaagaaggcgggtcggagggagatcgtcgaccttattgggcccaaggcgagtgaggatgatttgaagagggcggcatcgataatagtggactcgggtgccctcgactacgcggagtccagggctaggttctatgttgaaagggctagggacatactatccagggtgccggcagttgacgcggagtcgaaggagcttctcaaccttcttctagactatattgtggagagggagaagtag

SEQ ID NO: 13338 - protein, 337 aa, Aeropyrum pernix
MGVSVLKWDRLFEASSRYSMLIDHYIMDFMSITPDRLSGASLHLIKAGGKRLRPLITLLTARMLGGLEAEARAIPLAASIETAHTFSLIHDDIMDRDEVRRGVPTTHVVYGDDWAILAGDTLHAAAFKMIADSREWGMSHEQAYRAFKVLSEAAIQISRGQAYDMLFEETWDVDVADYLNMVRLKTGALIEAAARIGAVAAGAGSEIEKMMGEVGMNAGIAFQIRDDILGVIGDPKVTGKPVYNDLRRGKKTLLVIYAVKKAGRREIVDLIGPKASEDDLKRAASIIVDSGALDYAESRARFYVERARDILSRVPAVDAESKELLNLLLDYIVEREK

SEQ ID NO: 13339 - DNA, 846 bp, Campylobacter jejuni
  CDS (1)..(846)
atgaatttaaaagaactttttatccatcacttagaaaaaaatctacccaaagttgaaagctttcatccttttttcaatgaagctttagcacttatgttaaaagcaggaggaaagcattttcgcgcacaattgcttttaagcgtagtgcaaagcaataaacctgaacttttaaatcaagctttagatgtagctttagctttggaatttatccatacttattcactcatacacgatgatttacccgctatggataatgcggactttagacgaggaattccaaccttacacaaaagctacgatgaaactacagccatcttagtaggtgatgctttaaataccgaagcttttttagttctaagtcatgctcatttaaaagatgaaatcaaaatcaaactcatcaaaacccttgcctttaatgcaggacttaatggaatggtcataggacaagctattgattgtttttttgaagacaaaagactgagtttaaatgaacttgagtttttgcatacacataaaaccgcaagattgatcgccgcagctttaaaaatgggttgtgaaatttgcgaacttaacaacgaagaaagcaatcaaatttacaaacttggtttaaaactaggactgatttttcaaatcaatgatgatattatcgatgtaactacaagtcaagaacaaagcggaaagcctaccaacaacgatattcataaaaattcttttgtcaatttgcttggacttgaacaagccataaaaacaaaagaaaatcttcttagtgaatgcgaacaagacttagaaaaacttaatgaaaaactcgcacaaatgatacaaaatttaataattcaatacttataa

SEQ ID NO: 13340 - protein, 281 aa, Campylobacter jejuni
MNLKELFIHHLEKNLPKVESFHPFFNEALALMLKAGGKHFRAQLLLSVVQSNKPELLNQALDVALALEFIHTYSLIHDDLPAMDNADFRRGIPTLHKSYDETTAILVGDALNTEAFLVLSHAHLKDEIKIKLIKTLAFNAGLNGMVIGQAIDCFFEDKRLSLNELEFLHTHKTARLIAAALKMGCEICELNNEESNQIYKLGLKLGLIFQINDDIIDVTTSQEQSGKPTNNDIHKNSFVNLLGLEQAIKTKENLLSECEQDLEKLNEKLAQMIQNLIIQYL

SEQ ID NO: 13341 - DNA, 849 bp, Buchnera sp
  CDS (1)..(849)
atgcatttttttcatctatatgagagatacaaacatcgtattaatcaaaaattattttatacattaaatcagttgccttttcaaaaatcaagtcttttaaaagcaatgaaatatagtgtattttcaggtagtaaaagattgcgttcatctttaatatattcaactggagatgtttttaaagttaatattactacattagatgttatatctactgccatcgaatttattcattcatactctttaatacatgatgacttaccctgtatggataatgataattttagaagaggaaagatatcttgtcatgtaaaatacggtgaaagtacttctttacttgctggtgatgctttgcaaagtcttgcgtttaatattctatcaaacagttttatgccaaatgtatctaatttaaaacgtataaaaatgatttctgaattatcttattccattggttcatctgggatgtgcatgggtcaaaatttagatttagaagcagaaaaaaaagatgtaaatttatctgaattagaaataattaatttatataaaacttcttttttaatgcgttctgctgtacgtttagtatatttttcttctaataatttttctaaatctatattatcaatattagatcttttttcgatttctattggtttggcatttcaaattcaggatgatattttagattttaaaaaagatagtgtaaaaacagacaataaaaaaattattaaaaaacatacttatccattaataataggtttagatgaatcaagaaaaaaaataaaacaattacataagaaatcatttttagcattaaatagtttaaaaaaaaaaatttcaataccaacatactag

SEQ ID NO: 13342 - protein, 282 aa, Buchnera sp
MHFFHLYERYKHRINQKLFYTLNQLPFQKSSLLKAMKYSVFSGSKRLRSSLIYSTGDVFKVNITTLDVISTAIEFIHSYSLIHDDLPCMDNDNFRRGKISCHVKYGESTSLLAGDALQSLAFNILSNSFMPNVSNLKRIKMISELSYSIGSSGMCMGQNLDLEAEKKDVNLSELEIINLYKTSFLMRSAVRLVYFSSNNFSKSILSILDLFSISIGLAFQIQDDILDFKKDSVKTDNKKIIKKHTYPLIIGLDESRKKIKQLHKKSFLALNSLKKKISIPTY

SEQ ID NO: 13343 - DNA, 888 bp, Haemophilus influenzae
  CDS (1)..(888)
atgggtcacttttctgaagaattacaacaggttcaaactcgtatcaatcgctttttagaagctcaatttgaaggcattgaaagtcataatgcgcctttgcttgaggcgatgaaatacgcattattacttggcggtaagcgagttcgccctttcttagtttacgcaacaggtcaaatgcttggcgcagagaaacaaaccttagattacgctgctgctgccattgaagccattcacgcctattccttaattcacgatgatttacctgcaatggatgatgacaatttacgccgtggacatcctacttgtcatatccaatttgatgaagctacagctattcttgcgggcgatgcactgcaaagtttcgcatttgaaatattaaccaaaacaccgaatatttctactgaacaaaaactggctttaattcaaattttagcgcaaggcgctggtgtgcaaggaatgtgtttagggcaaagtttagatcttatttctgagcataaacagattagtttaagtgaattagaattaattcatcgtaacaaaacgggtgcattgctaattgccgcattgaaattaggtttcatttgttctccgcattttaccgacaaaaggttagaacaatccttaacacaatatgcggaagccattggtttagcctttcaagttcaagacgatattttagatattgaaggcgatagtgcagaaattggcaaacaggtgggtgccgatcttgatttagataaaagtacatatccaaaattacttggattaagtggtgcaaaacaaaaagcgcaagatctatatcaaagtgcgttgtctgaattagaaaaaattccttttgatacaaccgttcgtgcattagctgaattcattattaccagaaaaagttaa

SEQ ID NO: 13344 - protein, 295 aa, Haemophilus influenzae
MGHFSEELQQVQTRINRFLEAQFEGIESHNAPLLEAMKYALLLGGKRVRPFLVYATGQMLGAEKQTLDYAAAAIEAIHAYSLIHDDLPAMDDDNLRRGHPTCHIQFDEATAILAGDALQSFAFEILTKTPNISTEQKLALIQILAQGAGVQGMCLGQSLDLISEHKQISLSELELIHRNKTGALLIAALKLGFICSPHFTDKRLEQSLTQYAEAIGLAFQVQDDILDIEGDSAEIGKQVGADLDLDKSTYPKLLGLSGAKQKAQDLYQSALSELEKIPFDTTVRALAEFIITRKS

SEQ ID NO: 13345 - DNA, 1080 bp, Mycobacterium tuberculosis
  CDS (1)..(1080)
atgcgcggtaccgacgaaaagtacggactgccaccgcaacccgacagcgaccgtatgacccgtcgcacgcttcccgttttgggactcgcacacgaactcatcacaccgacgctgcgccagatggctgaccgcctcgatccccacatgcggcccgtcgtgtcctaccacctcggctggtctgatgaacgcggccgtccagtgaacaacaactgcggcaaggcaatccgtcctgctttggtgtttgtcgccgccgaagccgccggcgccgacccccactcggcgattcccggagccgtctcggttgaactggtgcacaacttctcgctcgtccatgacgacctcatggaccgcgacgagcaccgtcggcaccggccgacggtgtgggcactgtggggcgatgcgatggcgctattggccggtgatgcgatgctgtcgctggcgcacgaggtcctgctggattgcgattcaccacacgtcggtgcggcgctgcgcgcgatttcggaagccacccgtgagttgatccgtgggcaggccgccgacaccgcgttcgaaagccgaaccgacgtcgcactcgatgagtgtctcaagatggctgaaggcaagaccgcagcactgatggcagccagcgcagaggtcggcgcgttactcgctggcgcaccgcgttcggtgcgagaagcgttggttgcctacggtcgtcacattggacttgccttccaattggtcgacgacctgctcggcatttggggccgtcctgagatcaccggcaagccggtgtactcggaccttcgctcccgcaagaaaactctgcccgttacctggaccgtggcgcacggcggttcggccggccgccgcctcgcagcgtggctggtggacgagacgggcagccagacagcgtccgatgatgagctcgcagcggtcgcagaactgatcgagtgcggtggggggcgcaggtgggcaagcgcggaggcccgccgacacgtaacgcaaggcatcgacatggtggcgcgcatcggcattcccgatcgcccggccgctgagcttcaggatttggctcactacatcgtcgatcgtcaggcgtga

SEQ ID NO: 13346 - protein, 359 aa, Mycobacterium tuberculosis
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFSLVHDDLMDRDEHRRHRPTVWALWGDAMALLAGDAMLSLAHEVLLDCDSPHVGAALRAISEATRELIRGQAADTAFESRTDVALDECLKMAEGKTAALMAASAEVGALLAGAPRSVREALVAYGRHIGLAFQLVDDLLGIWGRPEITGKPVYSDLRSRKKTLPVTWTVAHGGSAGRRLAAWLVDETGSQTASDDELAAVAELIECGGGRRWASAEARRHVTQGIDMVARIGIPDRPAAELQDLAHYIVDRQA

SEQ ID NO: 13347 - DNA, 1041 bp, Pyrococcus abyssi
  CDS (1)..(1041)
atgaaaatgggggttggaaagtacgatgagctatttaataggataaaggagagggctaaactagtcgatgaaaagttattcgagttaattcccgagaaagagcccaaggttctttacgaagcagccagacattacccgcttgcaggtggtaagaggattaggcccttcgtggttttgacggcaacagaagccgttggtggaaatgcattgaaggctatttatccggcagttgccatcgagttgatccataactattccctagtccacgacgacataatggacatggacgagactaggaggggaaagccgaccgtgcacaaggtttggggaataaacatggcgatcttagccggcgacttattattcagcaaggccttcgaggctatatctagggctgaaatttcacctgaaaagaaagctaaagttcttgaaacgatagtcaaggcgtcaaatgagctctgcgaggggcaggccttggacttagaattcgagaacagggaaatggttagcatagaggaatacatgaggatgataagcggaaaaactggagctctctttgatgcctcagctaaagtagggggaatagttggaaccgaaaacgaggaatacatagaggccctgtcgaggtggggaaggaacgttggaatggcgttccagatatgggatgacgtcctagacttgatagccgacgaggagaagcttggaaaaccagtgggtagcgacattaggaagggcaagaagactttgatagttgctcacttcttcgagaacgcggatgagaaagcgaaggagaagttcttaaaggtctttggaaagtacgctggggacgttaaggggaagggaataatagaggaggacgtaaaggcggaggtaatggaggccatagagctactcaaggagcatgggagcatagattatgcgagtagaatagcaagggaactagttgagaaggcaaatgaggctttaaacgttctacccgagagcagggcgagaaaggatttagagttgcttgcgagtttcatggttgagagggagtactga

SEQ ID NO: 13348 - protein, 346 aa, Pyrococcus abyssi
MKMGVGKYDELFNRIKERAKLVDEKLFELIPEKEPKVLYEAARHYPLAGGKRIRPFVVLTATEAVGGNALKAIYPAVAIELIHNYSLVHDDIMDMDETRRGKPTVHKVWGINMAILAGDLLFSKAFEAISRAEISPEKKAKVLETIVKASNELCEGQALDLEFENREMVSIEEYMRMISGKTGALFDASAKVGGIVGTENEEYIEALSRWGRNVGMAFQIWDDVLDLIADEEKLGKPVGSDIRKGKKTLIVAHFFENADEKAKEKFLKVFGKYAGDVKGKGIIEEDVKAEVMEAIELLKEHGSIDYASRIARELVEKANEALNVLPESRARKDLELLASFMVEREY

SEQ ID NO: 13349 - DNA, 969 bp, Pseudomonas aeruginosa
  CDS (1)..(969)
atgcaaccccaggccttctaccgcgtggtggcggaagatttcaccgccgtcgacgggatcatccgtcgccaactcacctcccgcgttcccctggtggaaaagatcggcgactacatcatctccgccggcggcaagcgcctgcgtccgctgctggtcctgctcgccggcaagaccctgggctacaagggcgacgacctctgcctgctggccgccaccatcgaattcctgcacacctccactctgctgcacgacgacgtcgtcgacgcctccggcctgcgccgcggccgctccaccgccaatgccctgtggggcaacgcgccgagcgtgctggtaggcgacttcctttatgcccgctccttcgaaatgatggtcgagctgggttccatgccggtcatgcgcatcatatcccaggccacccgggtgatcgccgagggcgaagtgctgcaattgtccaaggtacgcgacgccagcactaccgaagagacctacatggaagtgatccgcggcaagaccgcgatgcttttcgaggcctcgacccacagcgccgccgcgctgtgccaggccggcgaggaacagtccgaggcactgcgccgcttcggcgactacctgggaatcgccttccagctggtggacgacctgctcgactaccgcggcgacgccgcgaccctcggcaagaacgtcggcgacgacctcgccgaaggcaagcccaccctgccgctgatcgtcaccatgcgcgacggcaccgaggaacaggccgcgctggtacgcaaagccatccagcaaggtggcagccaggacctggagagcgtctgtgccgccgtcgaggcagccggcgccctggactataccgccaacctcgcccgcgactacgccgcccgcgccatcgcctgcctggatacgctgccggacaacgaataccgctccgccctggtcgaactcagcgaattcgctgtcgcccgaacccactga

SEQ ID NO: 13350 - protein, 322 aa, Pseudomonas aeruginosa
MQPQAFYRVVAEDFTAVDGIIRRQLTSRVPLVEKIGDYIISAGGKRLRPLLVLLAGKTLGYKGDDLCLLAATIEFLHTSTLLHDDVVDASGLRRGRSTANALWGNAPSVLVGDFLYARSFEMMVELGSMPVMRIISQATRVIAEGEVLQLSKVRDASTTEETYMEVIRGKTAMLFEASTHSAAALCQAGEEQSEALRRFGDYLGIAFQLVDDLLDYRGDAATLGKNVGDDLAEGKPTLPLIVTMRDGTEEQAALVRKAIQQGGSQDLESVCAAVEAAGALDYTANLARDYAARAIACLDTLPDNEYRSALVELSEFAVARTH

SEQ ID NO: 13351 - DNA, 984 bp, Methanococcus jannaschii
  CDS (1)..(984)
atgaaagaattatttaaaagaggtggaattatgctctttgataaaaatattttacaaaaaattgatgaagaattaaagacttatgtagataaagatgataaactatataacgcgtcaaaacatcttctatttgctggaggaaagagaattaggccatatttaactgtagtaacttatatgttgaagaaagacgatattgaggaggttttgccagccgctgctgcagtagagttaattcacaactacaccttaatacatgatgacattatggacaatgatgatgagaggagaggaaaaccaacagttcatgttgtctatggagagccaatggctatcttagctggagatttattatatgctaaagcttttgaagcagtttcaagaataaaagataataaaaaagctcatgaagttttaaaaatcctatcaaaagcatgtgttgaggtttgtgaagggcaggcaatggacatggaatttgaaaactactatcctacaatggaagaatacttagatatgattagaaaaaagacaggagctttattagaggcttctgtgggaattggggctgttatggctgattgtaatgaagaagaaagggaagcattaaaagagtatgcaaaaagaattggattaacttttcaaatacaggatgatgttttagatttaattggggaccagaaaaagttaggtaagccagttggaagtgatataagagaaggtaaaaagacaataattgttatccacgccctaaaaacattggatgaagataaaaagaaaagattattggaaattttaggaaataaaaatgttaaggatgaagaaattaaagaagcaattgagatattaaagccttcaattgaatatgcaaaagaacttatgaaacaaaaaactgaagaagcaaaagaatatttaaagatattcaataaagacagaaggaaagttttagaggatttggctgattttataatgagtagaatttattaa

SEQ ID NO: 13352 - protein, 327 aa, Methanococcus jannaschii
MKELFKRGGIMLFDKNILQKIDEELKTYVDKDDKLYNASKHLLFAGGKRIRPYLTVVTYMLKKDDIEEVLPAAAAVELIHNYTLIHDDIMDNDDERRGKPTVHVVYGEPMAILAGDLLYAKAFEAVSRIKDNKKAHEVLKILSKACVEVCEGQAMDMEFENYYPTMEEYLDMIRKKTGALLEASVGIGAVMADCNEEEREALKEYAKRIGLTFQIQDDVLDLIGDQKKLGKPVGSDIREGKKTIIVIHALKTLDEDKKKRLLEILGNKNVKDEEIKEAIEILKPSIEYAKELMKQKTEEAKEYLKIFNKDRRKVLEDLADFIMSRIY

SEQ ID NO: 13353 - DNA, 984 bp, Rickettsia prowazekii
  CDS (1)..(984)
atgaatattatagtaaaaatacagcaaaatttaaaagatgaagtaactcagttaaacgatttaattattagttgtttaaaaagtgatgcagaattaatagaaaaggtcggcaaatatttagtagaggcaggtggtaaaagaattcgtccacttttaactataatcacggctaaaatgttcgattataaaggcaataatcatatcaaacttgcaagtgccgtggaattcattcacgccgctactttgcttcatgatgatgtggtagacaacagcactttaagaagatttaaacctacagctaacgttatttggggcagtaaaacaagtattttagttggcgatttcctttttagtcaatcttttaagttaatggttgcttctggctgtattaaagctatgaatgttctagctaaagcttcggttattatttccgaaggtgaggtagtacaattagttaagttaaatgagcgacgtattatcactatagatgaatatcagcaaatagtgaaatctaaaacggctgagctatttggagctgcttgtgaagtcggagctattatagcagagcaggtcgatcgcgtttctaaagatgtgcagaattttggtaggttacttggtacaatatttcaggttatagatgacttacttgattatttaggtagtgataaacaggtaggaaaaaacatcggtgatgatttcttagaaggaaaagtaacattaccactgatttttttatatcataagctagagcaagataagcagctttggctagaaaatatgcttaaatctgataagcgtactaaagatgactttgtaaaaatacgtgacttaatgttaaaacatgcaatttacaatgaaacagttaattatttgagtagcttagaaaacgaagcaaataatttattaaataaaattcccgttcaaaatatttataagtattatttattttcgattattagatttattttataccgttcttattaa

SEQ ID NO: 13354 - protein, 327 aa, Rickettsia prowazekii
MNIIVKIQQNLKDEVTQLNDLIISCLKSDAELIEKVGKYLVEAGGKRIRPLLTIITAKMFDYKGNNHIKLASAVEFIHAATLLHDDVVDNSTLRRFKPTANVIWGSKTSILVGDFLFSQSFKLMVASGCIKAMNVLAKASVIISEGEVVQLVKLNERRIITIDEYQQIVKSKTAELFGAACEVGAIIAEQVDRVSKDVQNFGRLLGTIFQVIDDLLDYLGSDKQVGKNIGDDFLEGKVTLPLIFLYHKLEQDKQLWLENMLKSDKRTKDDFVKIRDLMLKHAIYNETVNYLSSLENEANNLLNKIPVQNIYKYYLFSIIRFILYRSY

SEQ ID NO: 13355 - DNA, 876 bp, Xylella fastidiosa
  CDS (1)..(876)
atgagcgaagcgctgttcacgcgctggcgccaacgcaccgacagctacttagaacgaacgttatccatccccacccaagcgccacagcggctccacgccgcgatgcgatacaccgtactgagtcgcggcaaacgcatccgtcccttactggtttacgctgccggccacctgtttcatgtcgatgaacccctactcgacgtaccggctgcggccgtggaactgatccatgcctattccctggtgcatgatgaccttcccgccatggatgacgacctcttacgccgagggcgtcccaccgtccatatcgccttcgacgaagccactgcaatcctcactggcgacgccttgcagaccctggcgtttgaatgcttagccgatgccccatccgacacctccctgcgtatcgcgtggctacagacattgacacacgccgcaggggttgccggcatgtgtggcggccaggcaatagatattgacgccactggccaatcccagacactcaaagcactggaagccatgcatgcgttgaagagcggcacattgatgcgagccgccgtgagaatgggtgccctggctggcgacccttccgcggaagatctgcactccctggacacctttgcggccacccttggattagcattccaagtgcgtgacgacatcctggatatcgagtccagttccgaacaacttgggaaaacggccggcaaagatgccatacagcagaaatccaccttccccgccctcttgagcgtagaaggtgccaaatgctatctacaagaattggcagaacgcctctacacccaattgcacccttacggcgaacgtgctgcccccctgaccgcactggcacgcttggctgtagaacgtgctcactga

SEQ ID NO: 13356 - protein, 291 aa, Xylella fastidiosa
MSEALFTRWRQRTDSYLERTLSIPTQAPQRLHAAMRYTVLSRGKRIRPLLVYAAGHLFHVDEPLLDVPAAAVELIHAYSLVHDDLPAMDDDLLRRGRPTVHIAFDEATAILTGDALQTLAFECLADAPSDTSLRIAWLQTLTHAAGVAGMCGGQAIDIDATGQSQTLKALEAMHALKSGTLMRAAVRMGALAGDPSAEDLHSLDTFAATLGLAFQVRDDILDIESSSEQLGKTAGKDAIQQKSTFPALLSVEGAKCYLQELAERLYTQLHPYGERAAPLTALARLAVERAH

SEQ ID NO: 13357 - DNA, 885 bp, Caulobacter crescentus
  CDS (1)..(885)
atgagcgaccttgccaagcggatcgtccaagccgccgacatcgtcaccgtggcgctggacgagctgttgccgcgcgccgacggccccgagagccgcctgaccgaagccatgcgctatgcggccctggggcccggcaagcgcctgcggccgttcttcgcgcttgagaccggcaagatgttcgatctgcccgagcggccggtgctgcgcgcggcgtgcgcgctggagtgcatccacgcctacagcctggtgcatgacgacctgcccgcgatggacgatgacgacgtgcgtcgtggtcgcccgaccgtgcacaagcaatacgacgaggccacggccatcctggcgggcgacgccctgcagacggcggccttcgagatcatggcccacccggacacccacgacgacggccatgtccgctcggaactggtgcgcaagctggctatcgcctcgggcgcgcgcggaatgtgcggcggccagatgatcgatctcctgggcgttcgcgacgatctgggcgctgtggcgcgcatgcagcggctgaagaccggcgccctgatcgccttcgccttcgagatcccgctgatcatcgcccgcgccaaggagtccgagcgctcggccctgatggccttcgctcaggacctgggtctggcctaccagatcgtcgacgacatcctcgacgccgagggcgatgaggagaccctgggcaaggccgccggcggcaaggacgccgccaagggcaaggccaactacgtcactttgttggggctggatgcggccaaggagcgcgtgacccttttggccgagcagacgcgttcccatctcgaaatctttggcgaacgggccgaacatctccgcgcgagcgttgatttcgtgctggaccgccgcaactga

SEQ ID NO: 13358 - protein, 294 aa, Caulobacter crescentus
MSDLAKRIVQAADIVTVALDELLPRADGPESRLTEAMRYAALGPGKRLRPFFALETGKMFDLPERPVLRAACALECIHAYSLVHDDLPAMDDDDVRRGRPTVHKQYDEATAILAGDALQTAAFEIMAHPDTHDDGHVRSELVRKLAIASGARGMCGGQMIDLLGVRDDLGAVARMQRLKTGALIAFAFEIPLIIARAKESERSALMAFAQDLGLAYQIVDDILDAEGDEETLGKAAGGKDAAKGKANYVTLLGLDAAKERVTLLAEQTRSHLEIFGERAEHLRASVDFVLDRRN

SEQ ID NO: 13359 - DNA, 870 bp, Clostridium acetobutylicum
  CDS (1)..(870)
atgaacaataaagtaataaagaaagaagtagaggaatatttaagtagatactttgaaggaaaagataactacaataaaagggtatatgaatctatgaactatagcctaaatgcgggtggaaaaagggtaagacctctgcttttattagcttcgtatgccatatataataaagattacaaagaagtaattgacatagcggcagcaattgaaatgatacatacttattcactaatacatgatgatttaccgtgtatggataatgatgatttaagaagaggaagaccaacaaatcataagatttttggctattctattgctcttttagcaggtgacggccttctgaacgaggcaatgaacataatgtttaagtattgtattggaaaaggtgaagaggctcttaaagcttgtttaatgatatctaaggcagcaagttcagatggaatgataggcggtcaagttgtggatatattaagtgaaggaaagaagataaatgaagatgagcttagatatatgcacaaaaaaaagacaggtgagcttataaaggcagctgtagtcagtggagcaatattagggggagctcctttgcatgatgtggagcttttatcgcaatatggtgataaattaggtcttgcttttcaaatagaagatgatatactcgatattattggagatacaaaaatcatgggaaagacatcgaaaagtgatttggaaaatgataaatgtacctatgttactttgtatggaatagataagtgtaagagtatttgcagagagttaacagatgaatgtttagatataataggcaaaatacaaggcaatacggaattgcttaaagaaataacagaacttttattaaagagaaatagataa

SEQ ID NO: 13360 - protein, 289 aa, Clostridium acetobutylicum
MNNKVIKKEVEEYLSRYFEGKDNYNKRVYESMNYSLNAGGKRVRPLLLLASYAIYNKDYKEVIDIAAAIEMIHTYSLIHDDLPCMDNDDLRRGRPTNHKIFGYSIALLAGDGLLNEAMNIMFKYCIGKGEEALKACLMISKAASSDGMIGGQVVDILSEGKKINEDELRYMHKKKTGELIKAAVVSGAILGGAPLHDVELLSQYGDKLGLAFQIEDDILDIIGDTKIMGKTSKSDLENDKCTYVTLYGIDKCKSICRELTDECLDIIGKIQGNTELLKEITELLLKRNR

SEQ ID NO: 13361 - DNA, 972 bp, Escherichia coli
  CDS (1)..(972)
atgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgctttccagatgatgaccagcctcggttcgctcaaagtgctggaagtcatgtcagaagccgtaaacgtcatcgcagaaggtgaagttctgcaactgatgaacgttaacgatccggacatcactgaagaaaactacatgcgcgttatctatagcaaaaccgcgcgtctgtttgaggctgccgcgcagtgttccgggattctggctggctgtacgccggaggaggagaaaggcctgcaggattatgggcgctatctcggcactgctttccagttgatcgacgatttactcgattacaatgccgatggcgaacagttaggtaaaaatgtcggcgacgatctgaacgaaggtaaaccgacgctgccgctgctgcatgcgatgcatcatggcacaccagaacaggcacagatgatccgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccttggcgagaagcactcatcggcctcgcgcacatcgctgttcaacgcgatcgttaa

SEQ ID NO: 13362 - protein, 323 aa, Escherichia coli
MNLEKINELTAQDMAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLEPVLEAMNACGSLEWTRQRAEEEADKAIAALQVLPDTPWREALIGLAHIAVQRDR

SEQ ID NO: 13363 - DNA, 789 bp, Aquifex aeolicus
  CDS (1)..(789)
atggaaaggatagaaacctggaaagaaaaaatagaaaaaagacttaatgaaatcctgaaacccgaaggtccagaagaattaatagaagctatgaagtactatcccttacaaaagggaaagaggataagacccctctttacggttgcggtcgcaagtgctctcggagggaatgaagatgatgctataaccgttggctctggtatagaactcattcacaactactcccttatacacgacgatcttccctgtatggacaacgatgtctggagaagaggcctccctacgtgccacataaagttcggagaagcgatggcactccttgcgggagatgcactcctgacttacacctttgaggtcctatcacaaagggaaaattacaaaaccctttcctgtgaagagatacttgagataaacaaaattatcgctcaaaaggcaggttctaacggaatggtagggggacaggttcttgacataaaggggtatgaggacctctacgaggtcagtgtaaaaaaaacaggggcactctttgaagcttgctttatgtgcggagctgtggtagcgaagagaagggaaaaactcaaggagatggaaagtattggcagaaaagtaggcttactctttcaaatggttgacgactaccttgacaaagatggattttacgagaaactcggagaatgtttaaaagaagaaataaaaaaactatacgaagaactaaaagaaaaagaaattttcaaggaaagccaagaactcagataccttctagaccttatatacaagaggattacctga

SEQ ID NO: 13364 - protein, 262 aa, Aquifex aeolicus
MERIETWKEKIEKRLNEILKPEGPEELIEAMKYYPLQKGKRIRPLFTVAVASALGGNEDDAITVGSGIELIHNYSLIHDDLPCMDNDVWRRGLPTCHIKFGEAMALLAGDALLTYTFEVLSQRENYKTLSCEEILEINKIIAQKAGSNGMVGGQVLDIKGYEDLYEVSVKKTGALFEACFMCGAVVAKRREKLKEMESIGRKVGLLFQMVDDYLDKDGFYEKLGECLKEEIKKLYEELKEKEIFKESQELRYLLDLIYKRIT

SEQ ID NO: 13365 - DNA, 1029 bp, Pyrococcus horikoshii
  CDS (1)..(1029)
atggagaaatatgaagaactatttgcaagaataaaagagaaggctaaactcatcgatgagaagatcttcgagctcatcccggaaaaggatcccagagtcctctatgaggccgcaagacactatcctttagcaggtggaaagagggttagacccttcgttgttctaacgtcaactgaagctgttggcggggatcctctaagggccatctatccagcggtggccattgagctaattcataattactccctggttcacgatgatataatggatatggatgaaaccagaaggggaaagccaactgtgcatagaatttggggtgtaaacatggctattttagcaggagatctgctcttcagtaaagcctttgaagctgtggcaagggcggaaattcctccagaaaagaaagctagagtattagaagttattgtaaaggcgtcaaatgagctctgtgaaggccaagctagagatctagagttcgaaaagaagagcacggtaactatagaagaatacatggaaatgataagcggaaagacgggggcattatttgaagcttcagcaaaagtcggaggcataatcggaacggacaacgaggagtatataaaagccctttcaagttgggggagaaacgttggaattgcattccaaatttgggatgatgttcttgaccttattgccgatgagaaaaagctcggaaagcctgtgggtagtgacatcagaaaggggaagaaaaccctgatagttgcccacttctttgagaacgcagatgaaaaggataagcagaggttcctaaagattttcggaaagtatgctggtgatgttaaggggaggggaattattgaggaagacatcaagtccgatgttatggaagctatcgatctacttaagaagtatgggagcatagattatgcagcggaaattgctaaggatatgattaaaaaggcaaacgaagccctaagaatccttccgaaaagtaaggccagaatggatctagagttgcttgctaaattcattgtagaaagagaatactaa

SEQ ID NO: 13366 - protein, 342 aa, Pyrococcus horikoshii
MEKYEELFARIKEKAKLIDEKIFELIPEKDPRVLYEAARHYPLAGGKRVRPFVVLTSTEAVGGDPLRAIYPAVAIELIHNYSLVHDDIMDMDETRRGKPTVHRIWGVNMAILAGDLLFSKAFEAVARAEIPPEKKARVLEVIVKASNELCEGQARDLEFEKKSTVTIEEYMEMISGKTGALFEASAKVGGIIGTDNEEYIKALSSWGRNVGIAFQIWDDVLDLIADEKKLGKPVGSDIRKGKKTLIVAHFFENADEKDKQRFLKIFGKYAGDVKGRGIIEEDIKSDVMEAIDLLKKYGSIDYAAEIAKDMIKKANEALRILPKSKARMDLELLAKFIVEREY

SEQ ID NO: 13367 - DNA, 876 bp, Chlamydia trachomatis
  CDS (1)..(876)
atggattatttcagcgtttatcgatcgaaagtagaaaaaaagcttcgcgattctttgggagatttcggtaacactcagggtggattaagagacccaatagagtatgcccttttaggaggggggaaacgcgttcgtcccttgcttgttggtttgtttgcggaaggtgtccataaagagcgagatgtcttggataccgccattgctattgagtatatccatacatctacgttaatagccgatgacttgccgtgtatggacgatgatgatatgcgtagaggcaagccttcggttcacaaagcttttgatgaagcttcggctctcctggcttcgtatgctcttattccagctgcttatgcacgaattcgtaagaatgcaaaagcgctaaaagctgtagtttcttgtgaacaagatgtagaagaggcttacgaagatattttggagctgattgagttgcgttttggcgtaggaggaattttaggaggccaatatgaagatatattttttcatgatttctccaaagagaacgtattagggattattaaaaagaaaacgggagctctttttgaaattgcttgcgtatcaggatggttgtttggaggaggagaacgggaaagctccactttagtagctgaatttgctgaacattttgggttacttttccaaatacgtgatgatcttgccgatcttagtcaagatgatcaggaagagaaacatatgaactatgcgttattattcggagaagtggcagcaaaagagttgctagaccattcttttgaatcctgtattaaaaatctccacctattgcaggagaggggattggagtgtttggagccgctagagatgttgtgcaaaaatgtgttttgtggatggaaataa

SEQ ID NO: 13368 - protein, 291 aa, Chlamydia trachomatis
MDYFSVYRSKVEKKLRDSLGDFGNTQGGLRDPIEYALLGGGKRVRPLLVGLFAEGVHKERDVLDTAIAIEYIHTSTLIADDLPCMDDDDMRRGKPSVHKAFDEASALLASYALIPAAYARIRKNAKALKAVVSCEQDVEEAYEDILELIELRFGVGGILGGQYEDIFFHDFSKENVLGIIKKKTGALFEIACVSGWLFGGGERESSTLVAEFAEHFGLLFQIRDDLADLSQDDQEEKHMNYALLFGEVAAKELLDHSFESCIKNLHLLQERGLECLEPLEMLCKNVFCGWK

SEQ ID NO: 13369 - DNA, 894 bp, Campylobacter jejuni
  CDS (1)..(894)
atgcaaaaaatagatgaattaataaaacagtttttacaagagcttggctatgaacctattttaaatatgctttcaaatgtaaaatcaggaaagaaattacgctctaaattattattagctatcgcagatgagagtgagattgcttttaaaatttgtgcggctatagaattgatacatcttgctagtttattacatgatgatattatcgatgagagtgaattaaggcgtggagcaagatctgttaatgctgaatttggtacaaaaaatgctcttatgttgggcgatattttgtattcaaaagccttttatgaattaagcaaaatggatgctagatttgcaagtattatttcagatgctgttgtaaagcttgctataggcgaacttatggatgttgatttgggagagaaatttaatatcaataaagaagcttatttgaaaatgatctataataaaacagctgttttgattgaagcaagtgctagatgcggagctattttggctggattatatgaaaaagattttgcagaatatggtaaaaatttaggacttgcttttcagatgattgatgatattttagatattaagagtgatgaaaaaattcttggaaaacctgctatgaatgattttaaagagggtaaaactaccttgccttatatttatctttatgaaaatttacaagaacaagataggatatatttgcagactttatttaaaaaagatttaaatgaaaatgaaaaagaatggctaaaaactaaatttgaagaacaaaaagctttagaaaaagctattttagaagctaaaacttatgcaaaaaaggctagaaaagcaattgaaaaatatgataataacaagcttaatgatattattaaagctatgatagatagggaattttaa

SEQ ID NO: 13370 - protein, 297 aa, Campylobacter jejuni
MQKIDELIKQFLQELGYEPILNMLSNVKSGKKLRSKLLLAIADESEIAFKICAAIELIHLASLLHDDIIDESELRRGARSVNAEFGTKNALMLGDILYSKAFYELSKMDARFASIISDAVVKLAIGELMDVDLGEKFNINKEAYLKMIYNKTAVLIEASARCGAILAGLYEKDFAEYGKNLGLAFQMIDDILDIKSDEKILGKPAMNDFKEGKTTLPYIYLYENLQEQDRIYLQTLFKKDLNENEKEWLKTKFEEQKALEKAILEAKTYAKKARKAIEKYDNNKLNDIIKAMIDREF

SEQ ID NO: 13371 - DNA, 897 bp, Neisseria meningitidis
  CDS (1)..(897)
atgaatccgacgaatgatttgaaagcgtggcaacagagggcgcaggcacagacagagctgctgctggaacgctttttgccgtctgaaaacgaaatcccgcacacgctgcacgaagcgatgcgttatgcggctttggacggcggcaaacgcctgcggccgatgctggttctggcggcttcggaattgggcgaagccgtgcatgaagcagtaggacaggcaatggcggcaatcgagatgattcacgcctattcgctggttcacgacgatatgccggcgatggacaacgacagcctgcgccggggcaaaccgacctgccatgtgaaatatggcgaagccaccgcgctactgaccggcgatgctttgcagacgcaggcgtttgacgtattgagccgtccgacagaactgcccgccgcacgccagttggcaatgttgtcggtgttggcaaaagcgggcggaagcatgggtatggcgggcggtcaggcaatcgatttggcgaatgtcggcaagcagatggcccaaaccgatttggaacagatgcacagcctgaaaacgggtgcgctaatccgtgccgcggttttattgggggcaatgtcttgcccgaatctgtctgaagacagtctggcggtattggacgattatgcggcaaaactggggctggcgttccaagtcattgacgatgtgttggattgtgaagcggacacggcgactttgggcaagacggcgggcaaagatgccgacaacgacaagccgacttatgtgaaactgatgggcttggaagcggcgcgctcatacgcacacaaactggttgccgaagcggtcgcgctgctcgaacccttcggcgacaaagccctgcgcctgcggcagttggcagaatttgcagtcgcccgcaaatattaa

SEQ ID NO: 13372 - protein, 298 aa, Neisseria meningitidis
MNPTNDLKAWQQRAQAQTELLLERFLPSENEIPHTLHEAMRYAALDGGKRLRPMLVLAASELGEAVHEAVGQAMAAIEMIHAYSLVHDDMPAMDNDSLRRGKPTCHVKYGEATALLTGDALQTQAFDVLSRPTELPAARQLAMLSVLAKAGGSMGMAGGQAIDLANVGKQMAQTDLEQMHSLKTGALIRAAVLLGAMSCPNLSEDSLAVLDDYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 13373 - DNA, 885 bp, Bacillus halodurans
  CDS (1)..(885)
atgagtgtacaactgttacaatttttagatgaaattaaagacatcatcgaagagcggatgcctgcacatattgaacgactaaattctcctgacatgctgaaaaattctatgctttactccttgaaggcaggaggaaaacgaattcgaccagcgctgctattggcaacgatgaaaagttttcaaaaggatatttcacaggggattgaccttgcctgtgcgattgagatgattcatacgtactcgctcattcatgatgacctcccatcgatggatgatgatgatattcgccggggaaaaccgacgaaccataaagtgttcggagaagctcatgccattcttgcaggggatgcattattaacgtacagctttgagattgtggccaaaatgaaaggtgttgacccggccaaaacactctgcttgatcgaagagcttgcaagggctgctggaccagaaggaatggtaggcggacaagtagctgatatcgaaggagaaaatcaaaaactaacggtcgagggacttgaatatatccaccatcataaaacaggggcgcttctctcgttcgccattgttgcaggggcaaggcttgcggatgcatctgaacaagatattgagaacatacgtagattttcaagagaattaggcttactctttcaaataaaagatgatattttagatgttgaaggggatcaagctgccattggtaaaccagttggaagcgatgatggaaatcaaaaaagcacctatccaagcctattaaccctcgaaggggcaaaagagaagcttcacttgcatactttgctggcaaaggaatatttatatagtgttcaaatgaaccatcgcttattagaggaattaacggattatgtcgtgaatcgtaaccattag

SEQ ID NO: 13374 - protein, 294 aa, Bacillus halodurans
MSVQLLQFLDEIKDIIEERMPAHIERLNSPDMLKNSMLYSLKAGGKRIRPALLLATMKSFQKDISQGIDLACAIEMIHTYSLIHDDLPSMDDDDIRRGKPTNHKVFGEAHAILAGDALLTYSFEIVAKMKGVDPAKTLCLIEELARAAGPEGMVGGQVADIEGENQKLTVEGLEYIHHHKTGALLSFAIVAGARLADASEQDIENIRRFSRELGLLFQIKDDILDVEGDQAAIGKPVGSDDGNQKSTYPSLLTLEGAKEKLHLHTLLAKEYLYSVQMNHRLLEELTDYVVNRNH

SEQ ID NO: 13375 - DNA, 1073 bp, Arabidopsis thaliana (mouse-ear cress)
  CDS (30)..(1073)
gaaaaaaacttgagtttagagaaatcaccatgactacactcaatctatcaatttttccatcagttaaaatatccagctccgcatccatacccggattcatcaaaatccaacctttccttctccgtcggaagctctctaccgttttatcggtcaccgccagagacgaaggtatcatccacaaccatttcgatttcacgtcatacatgatcggaaaagctaatgccgtcaatgaagctctcgactccgccgtctcgctccgagaaccaatcaagatccatgaagcgatacgttactcgcttctcgccagaggcaaacgagtgagacccgtgctctgtatcgcagcgtgtgagttagtgggcggcgaagaatccgtggcgttaccggcggcgtgcgccgtggaaatgatccacacaatgtcgttgatccacgacgatcttccatgtatggataacgacgatctccgccgcggaaaaccaacgaaccacaaagttttcggtgaagacgtcgcggttttagccggagacgcgcttatatcgttcgcgtttgagcacttagcaacgtcaacggctgtttctccggctagagttgttcgagcaatcggagagttagcgaaagccattggatcaaaagggctcgtggcgggtcaagtagtggatctaaccagtggaggaatggaccaaaacgacgtcggcttagaggttcttgagtttatccacgttcataaaaccgccgtgttgttagaggcggctacggtgttaggagccatcgttggtggtggttctgatgaagaagttgagaagctgagaagattcgcgagatgcattggattgttgtttcaggtggtggacgatattttggacgtgacgaagtcgtcggaggaattgggaaagaccgccggaaaagatctgattgccgataagctgacgtatccgaaactaatgggtcttgagaaatctaaagactttgcagataagttgttgagcgatgctcacgaacagcttcatgggtttgattcgagtagagttaaacctttactagctttggctaattacattgccaaaagacagaattag

SEQ ID NO: 13376 - protein, 347 aa, Arabidopsis thaliana (mouse-ear cress)
MTTLNLSIFPSVKISSSASIPGFIKIQPFLLRRKLSTVLSVTARDEGIIHNHFDFTSYMIGKANAVNEALDSAVSLREPIKIHEAIRYSLLARGKRVRPVLCIAACELVGGEESVALPAACAVEMIHTMSLIHDDLPCMDNDDLRRGKPTNHKVFGEDVAVLAGDALISFAFEHLATSTAVSPARVVRAIGELAKAIGSKGLVAGQVVDLTSGGMDQNDVGLEVLEFIHVHKTAVLLEAATVLGAIVGGGSDEEVEKLRRFARCIGLLFQVVDDILDVTKSSEELGKTAGKDLIADKLTYPKLMGLEKSKDFADKLLSDAHEQLHGFDSSRVKPLLALANYIAKRQN

SEQ ID NO: 13377 - DNA, 1053 bp, Mycobacterium tuberculosis
  CDS (1)..(1053)
atgggaggcgtattgactctggatgcggcttttctggggagtgtccctgctgaccttgggaaagcattgttagaacgggctcgagcggattgtggccctgtgctgcatcgggccattgagtcgatgcgcgagccgttggcgacgatggcgggatatcaccttggctggtggaacgccgatcgatccacagcggcaggatcgtcgggcaagtattttcgcgccgcccttgtctacgcggcggccgcggcttgcggtggtgatgtcggtgatgctactccggtgtcggcggctgtggagttggtgcacaacttcacgttgttgcatgacgatgtgatggatggggatgcgactcgcaggggacggccgacggtatggagtgtgtggggtgtgggcgtcgcgatcctgttgggagatgcgttgcacgccacggccgttcggatactgaccggcctgaccgacgagtgtgtggcggtcagggcgataaggcgattgcagatgtcgtgcctggacttgtgtatcggccagtttgaggattgtttattggagggacagcccgaagttacagtcgatgactatctgcggatggccgcgggcaagacggccgccctgaccggttgttgttgcgctctgggagctttagtggccaatgcagacgacgcgacgattgctgcgttggagcgttttggccatgagttgggtcttgcgtttcaatgcgtcgacgatctgatcggcatctggggtgaccctggtgtgacgggaaagccggtcggcaacgaccttgcccgacgtaaggcgacactgccagttgttgccgccctgaactcgcgatccgaagcggcgaccgaattggcggccctctatcaagcacctgccgcaatgacagcaagcgatgtcgagcgggctaccgcgcttgtcaaggtggccgggggtggtcatgtggcgcagcgatgcgccgatgaacgcatccaggctgctattgcggcactgcccgatgcggtgcgatccccagacctgatcgcgttgtcgcaactgatatgtcgccgggagtgctga

SEQ ID NO: 13378 - protein, 350 aa, Mycobacterium tuberculosis
MGGVLTLDAAFLGSVPADLGKALLERARADCGPVLHRAIESMREPLATMAGYHLGWWNADRSTAAGSSGKYFRAALVYAAAAACGGDVGDATPVSAAVELVHNFTLLHDDVMDGDATRRGRPTVWSVWGVGVAILLGDALHATAVRILTGLTDECVAVRAIRRLQMSCLDLCIGQFEDCLLEGQPEVTVDDYLRMAAGKTAALTGCCCALGALVANADDATIAALERFGHELGLAFQCVDDLIGIWGDPGVTGKPVGNDLARRKATLPVVAALNSRSEAATELAALYQAPAAMTASDVERATALVKVAGGGHVAQRCADERIQAAIAALPDAVRSPDLIALSQLICRREC

SEQ ID NO: 13379 - DNA, 780 bp, Neisseria meningitidis
  CDS (1)..(780)
atgcgttatgcggctttggacggcggtaagcgtctgcggccgatgctggttctggcagcttcggaattaggcgaagccgtgcatgaagcagtagaacaggcaatggcggcaatcgaaatgatccacgtctattctttggttcacgacgatatgccggcgatggacaacgacagcctgcggcgcggcaaaccgacttgccacatcaaatatggcgaagcgaccgcccttctgaccggcgacgctttgcagacacaggcatttgacgtgttgagccgtccgacagaactgcccgccgcacgccagttggcaatgttgtcggtgttggcgaaagcgggcggcagcaggggtatggcgggcggtcaggcaatcgatttggcgaatgtcggcaaacaaatggttcaagccgatttggaacagatgcacagcctgaaaacgggtgcgctaatccgtgcggcggttttattgggggcgacggcgtgtcctgatctgtcagatgcggaactttccgtattggacgcttacgcggcaaaactggggctggcgttccaagtcattgacgatgtgttggattgtgaagcggacacggcgactttgggcaaaacggcgggcaaagacgcagacaacgacaagccgacttatgtgaaactgatgggcttggaagcggcgcgctcatacgcacacaaactggttgccgaagcggtcgcgctgctcgaacccttcggcgacaaagccctgcgcctgcggcagttggcagaatttgcagtcgcccgcaaatattaa

SEQ ID NO: 13380 - protein, 259 aa, Neisseria meningitidis
MRYAALDGGKRLRPMLVLAASELGEAVHEAVEQAMAAIEMIHVYSLVHDDMPAMDNDSLRRGKPTCHIKYGEATALLTGDALQTQAFDVLSRPTELPAARQLAMLSVLAKAGGSRGMAGGQAIDLANVGKQMVQADLEQMHSLKTGALIRAAVLLGATACPDLSDAELSVLDAYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 13381 - DNA, 888 bp, Pseudomonas aeruginosa
  CDS (1)..(888)
atgatcgcggcctaccaggcgcgctgccaggcgcgcgtcgatgccgccctggacgccctgttcgtcgctccccgcgaagaactgcaacgcctctacgaggccatgcgctacagcgtgatgaacggtggcaagcgggttcgcccgctgctcgcctacgccgcctgcgaggccctcggcggagcgccgcagcgcgccgacgccgcggcctgcgcggtggagctgatccatgcctactcgctggtccacgacgacctgccggcgatggacgacgacgacctgcgccgtggccagccgaccacccaccgggccttcgacgaagccaccgcgatcctcgccgccgacggcttgcaggcgctggccttcgaagtgctcgccgacacccggcgcaatccgcaggaacatgccgtctgtctggaaatgctcacccgcctggcgcgcgccgcaggctccgccggcatggtcggcggccaggcgatcgacctcggctcggtcggcgtggccctcgaccaggcggccctggaagtcatgcaccggcacaagaccggcgcgctgatcgaagccagcgtgcgcctcggcgccctcgccagcggtcgcgccgagcccgcctcgctggccgccctggagcgctacgccgaagcgatcggcctggccttccaggtgcaggacgacatcctcgacgtggaaagcgacaccgccaccctcggcaagacccagggcaaggaccaggcgcacaacaagccgacctatcccgccctgctcggcctggaggccgccaaaggctatgccctggagctgcgcgacctggccctggccgccctcgacggttttccgccgagcgccgacccgctgcgccaactggcccgctacatcgtcgagcgacgcaactga

SEQ ID NO: 13382 - protein, 295 aa, Pseudomonas aeruginosa
MIAAYQARCQARVDAALDALFVAPREELQRLYEAMRYSVMNGGKRVRPLLAYAACEALGGAPQRADAAACAVELIHAYSLVHDDLPAMDDDDLRRGQPTTHRAFDEATAILAADGLQALAFEVLADTRRNPQEHAVCLEMLTRLARAAGSAGMVGGQAIDLGSVGVALDQAALEVMHRHKTGALIEASVRLGALASGRAEPASLAALERYAEAIGLAFQVQDDILDVESDTATLGKTQGKDQAHNKPTYPALLGLEAAKGYALELRDLALAALDGFPPSADPLRQLARYIVERRN

SEQ ID NO: 13383 - DNA, 903 bp, Halobacterium sp. NRC-1
  CDS (1)..(903)
atggagtacgtggaggcgcgccgggccgccatcgagcagcgcatcaccgaggcggtcggcggtgtcgagccgacggagctcggcgaccaactcgaacacgtcgtgttggccggcggcaagcgcgtccgaccgacgctcacggtgctcgtgtgtgaggccgccggcggtgccgtctggacgggggccgccgaagccgccgcggtccgggagaacgcggcgctgtcggccggcggggaggacgcactcgattacgccgtcggcgtcgagttggtgcacaacgcctcgctggtcgtcgacgacatcatcgatcggtcggagctgcgccggggctcggcgagcgcgtgggcggagtacggctacggaccggggatcgtcgcgtccgacggcctgctgggggaggcgttcgcgctgttctcgcgtgacccgcgcgcgatggagtgtgtgaccgattcgctggtggagctcggcgagggggaggccatcgagctcgtggcccggccggagaccgagcgcgagtacatggaactcgcgcgtcggaagaccggagcgctgttccgcgcggcggcggagctgggcgcgatcgcagcggacgccgacgggcgggccgtcgagcgcttcggcgagtacgccgagcgcgtcggcgtggcgttccagatccgggacgacgtgctggacgcgaccgcggacagcgacgcgctgggaaagcccgcgggggtcgacgaggccttggaccgccccagcatcgtgcaggtcacggaccggtcgccggacgcgttgaaccggttggcgggcgagcagtccgagcgcgcgctgggggcactggcggagctggagctgccggacggcgaggccaaagactacttgcagtatctcgcggagttcgtcgtcgagcgggacgcgtag

SEQ ID NO: 13384 - protein, 300 aa, Halobacterium sp. NRC-1
MEYVEARRAAIEQRITEAVGGVEPTELGDQLEHVVLAGGKRVRPTLTVLVCEAAGGAVWTGAAEAAAVRENAALSAGGEDALDYAVGVELVHNASLVVDDIIDRSELRRGSASAWAEYGYGPGIVASDGLLGEAFALFSRDPRAMECVTDSLVELGEGEAIELVARPETEREYMELARRKTGALFRAAAELGAIAADADGRAVERFGEYAERVGVAFQIRDDVLDATADSDALGKPAGVDEALDRPSIVQVTDRSPDALNRLAGEQSERALGALAELELPDGEAKDYLQYLAEFVVERDA

SEQ ID NO: 13385 - DNA, 1492 bp, Arabidopsis thaliana (mouse-ear cress)
  CDS (140)..(1255)
gttacttcctagcttctcactaatggccaatccaattctccattcataattttgactccactttccaaaaaaaacaaaaaaaaataaatactaatataaaaaattctcaaatctaaaatttcagatttcagaaatcgccatggcttcagtgactctaggttcatggattgttgttcaccaccacaatcatcatcatccatcttcaatccttaccaaatccagatccagatcttgtcctataactcttactaaacccatctcctttcgatcaaaacgcaccgtttcatcatcttcttcaatcgtttcttcttccgttgttacaaaagaagacaatctacgccaatctgaaccatcctctttcgatttcatgtcgtacatcatcaccaaagccgaattagtcaacaaagctttagattcagctgttcctctccgtgagccactcaagatccacgaagcgatgcgttactctcttctcgccggtggcaaaagagttagaccagttctctgcatcgctgcttgtgaactcgtcggaggtgaagaatcaaccgctatgccagcagcttgcgccgtcgagatgattcacaccatgtcgttgatccacgacgatctcccttgtatggataacgacgatctccgccgtggaaaaccgaccaaccacaaagtgtttggtgaagacgtcgctgttttagccggagacgcgcttctctctttcgctttcgagcatttagcttcggcgacgagttctgatgttgtttctccggtgagagtggttcgagccgttggagaattggctaaagcgataggaacagaagggttagtggcgggtcaagtcgtggatattagtagtgaagggttagatttaaacgacgtcggtttagagcatttggagtttatccatttgcataaaacggcggcgttgcttgaagcttctgctgttttgggagctattgttggtggaggaagtgatgatgagattgagaggttaagaaagtttgcgagatgtattggtttgttgtttcaggtggttgatgatatcttggatgtgacgaaatcgtcgaaagagttagggaaaactgctgggaaagatttgattgctgataagttgacgtatcctaagattatgggtttggagaaatcgagagagtttgctgagaaattgaatagagaggctcgtgatcagcttttagggtttgattctgataaggttgctcctttgttggctttggctaattacattgcctatagacagaactgatttgtgttcgattccttttgtcgggaatcattattagattggaattgtagaaatctcggacaggttctctagagtttgttggtgtaatcatctctatgttttcatgtactaaaaaatttggatagtaatggatgaaatatgaagaggttcatgtgtctgtaatagagtccctggttggtttcagtctttttgagtattaaactctctgttcttttggctcgtatttgtaatgatgaa

SEQ ID NO: 13386 - protein, 371 aa, Arabidopsis thaliana (mouse-ear cress)
MASVTLGSWIVVHHHNHHHPSSILTKSRSRSCPITLTKPISFRSKRTVSSSSSIVSSSVVTKEDNLRQSEPSSFDFMSYIITKAELVNKALDSAVPLREPLKIHEAMRYSLLAGGKRVRPVLCIAACELVGGEESTAMPAACAVEMIHTMSLIHDDLPCMDNDDLRRGKPTNHKVFGEDVAVLAGDALLSFAFEHLASATSSDVVSPVRVVRAVGELAKAIGTEGLVAGQVVDISSEGLDLNDVGLEHLEFIHLHKTAALLEASAVLGAIVGGGSDDEIERLRKFARCIGLLFQVVDDILDVTKSSKELGKTAGKDLIADKLTYPKIMGLEKSREFAEKLNREARDQLLGFDSDKVAPLLALANYIAYRQN

SEQ ID NO: 13387 - DNA, 915 bp, Agrobacterium tumefaciens
  CDS (1)..(915)
atggacgctcagatgacgaatttcgaaacgcggctgcgcgaaaacgcggcgaaaaccgaagcgctgcttggccacctgctttccggcgaggcgcgcgcggacgagatcacacgcccgcaaaacctgctagaggccatgcgccatggcgtgctgaacggcggcaaacgcctgcggccttttcttgtcatcgagagtgtcgcccttctgggcggagatgccgaagccggcctccacgtcggcgcagcactcgaatgcctccattgttattcgcttgtccatgacgatctgccagccatggacgacgacgacctgcgccgtggccagccgaccgtgcaccgcaaattcgacgaggcaaccgccatcctcgccggtgacagcctgctgacgcttgctttcgacataatcgcctcggatgacaatccgctggcggccgagcgcaaggccgccctcgttatctcgctcgcgcgtgccgccggtattggtggcatggctggcgggcaggcccttgatctcgctgccgaaaagaaagcgcccgacgaggatggcattattacattgcaggctatgaaaaccggtgccttgctgcgtttcgcctgtgaggccggcgcgatcattgccggcagcaatcaagccgaaaggcagcgactgcgcctcttcggcgaaaagattggcctttccttccagcttgccgacgatcttctggatctgaccgccgatgccgccaccatgggcaaggcgaccggcaaggatgccgcacgcggcaagggcacgctggtggccttacgcggcgaagcatgggcacgcgaaaagcttcaggagcaggtggcggaagccagcgaactcctcgccccctacggcgaaaaggccgcgattctcatcgcggccgcaagattcatcgccgaacggaaaagctga

SEQ ID NO: 13388 - protein, 304 aa, Agrobacterium tumefaciens
MDAQMTNFETRLRENAAKTEALLGHLLSGEARADEITRPQNLLEAMRHGVLNGGKRLRPFLVIESVALLGGDAEAGLHVGAALECLHCYSLVHDDLPAMDDDDLRRGQPTVHRKFDEATAILAGDSLLTLAFDIIASDDNPLAAERKAALVISLARAAGIGGMAGGQALDLAAEKKAPDEDGIITLQAMKTGALLRFACEAGAIIAGSNQAERQRLRLFGEKIGLSFQLADDLLDLTADAATMGKATGKDAARGKGTLVALRGEAWAREKLQEQVAEASELLAPYGEKAAILIAAARFIAERKS

SEQ ID NO: 13389 - DNA, 978 bp, Methanobacterium thermoautotrophicum
  CDS (1)..(978)
atgatggaagtaatggatattctaaggaagtactctgaaatggctgatgagaggataagggagtccatcagtgacataacacccgagacgttactcagagcatcagaacacctcatcacagcaggcggtaagaagataagaccatcactggccctcttaagctctgaggctgttggcggagaccccggggatgctgcgggtgttgcagcggcaatagaactgatccacacattctcactcatccacgatgatataatggatgacgatgagatcaggagaggcgaacctgccgtccatgtcctctggggggaacccatggccatactcgccggtgatgttctcttctcaaaggccttcgaggcggttatcaggaacggtgactctgaaatggtgaaggaagctcttgcagttgtcgttgactcctgcgtcaagatatgtgagggccaggcccttgacatgggattcgaggagaggctggacgtcacagaggaggaatacatggagatgatctacaagaagacagcagccctcatcgcagcagcaacaaaggccggggcgataatgggtggtggttcaccccaggagatcgccgccctcgaggactatggcagatgcattggtctcgcattccagatacacgacgactacctcgacgtggtcagtgacgaggaatcccttggcaaaccagtgggcagtgacatagcagagggaaagatgaccctcatggttgtgaaggcacttgagagggcatcagagaaggacagggagaggctgatatccatcctgggctccggggacgagaaacttgtggcagaggccatagagatatttgaacgatacggggcaacagaatatgcccatgctgtggccctggaccatgtgaggatggcaaaggaacgcctcgaggtacttgaggaatcggatgcaagggaagccctcgccatgatagccgacttcgtccttgaaagggaacactag

SEQ ID NO: 13390 - protein, 325 aa, Methanobacterium thermoautotrophicum
MMEVMDILRKYSEMADERIRESISDITPETLLRASEHLITAGGKKIRPSLALLSSEAVGGDPGDAAGVAAAIELIHTFSLIHDDIMDDDEIRRGEPAVHVLWGEPMAILAGDVLFSKAFEAVIRNGDSEMVKEALAVVVDSCVKICEGQALDMGFEERLDVTEEEYMEMIYKKTAALIAAATKAGAIMGGGSPQEIAALEDYGRCIGLAFQIHDDYLDVVSDEESLGKPVGSDIAEGKMTLMVVKALERASEKDRERLISILGSGDEKLVAEAIEIFERYGATEYAHAVALDHVRMAKERLEVLEESDAREALAMIADFVLEREH

SEQ ID NO: 13391 - DNA, 819 bp, Thermotoga maritima
  CDS (1)..(819)
atgaagaaggagaaagttgaagaaagaatacgcgagattttgaggcctggatgggatcttctcacagaagaagccatgctgtactccgcgacggttggaggaaagaggatccgtcctctcctcgtcttgacactgggtgaggatttgggagtggaagaggaaaaacttctcgatgtggcggtggccgttgaactctttcacacggcttctctgatacacgatgatcttcccccaatagataacgcggattttcgaagagggaagccttcttgtcacaggacctatggtgaagatatcgcccttcttgcgggagatggtctgttcttcctcgctttttctcagatatctaaaatcggaaattcaaagatttttgaagagttttcggaaacggcctacaaacttcttttgggggaagcgatggatgtggaattcgaaagaagaaagatggaagtctcgcaggagatggtggagagaatgtacgctttcaaaacgggagcgctatttgctttctgtttctcagctccatttatcctgaaaggaaaggatcacaccaagatgaaactcctcggagagaagttcggggtggctttccagatatacgacgatctgaaagacattcttgggtctttcgaaaaggtgggaaaggacctcggaaaagacacagaaaaagtgacgcttgtgaaaaaggtggggattcagaaagctcgtgagatggccgataagtattatgaagaagttttgaaaggtatcgaatcagaaggtctctttcgcacgctgtttcttctgaaagaactcaaacagatggtggaggagagatga

SEQ ID NO: 13392 - protein, 272 aa, Thermotoga maritima
MKKEKVEERIREILRPGWDLLTEEAMLYSATVGGKRIRPLLVLTLGEDLGVEEEKLLDVAVAVELFHTASLIHDDLPPIDNADFRRGKPSCHRTYGEDIALLAGDGLFFLAFSQISKIGNSKIFEEFSETAYKLLLGEAMDVEFERRKMEVSQEMVERMYAFKTGALFAFCFSAPFILKGKDHTKMKLLGEKFGVAFQIYDDLKDILGSFEKVGKDLGKDTEKVTLVKKVGIQKAREMADKYYEEVLKGIESEGLFRTLFLLKELKQMVEER

SEQ ID NO: 13393 - DNA, 1149 bp, Arabidopsis thaliana (mouse-ear cress)
  CDS (17)..(1135)
tatattgttgatcaaaatggaagctcaaaatatctttctctatcttttgatcgtctttctatctctacacttcgtgtttacaactctgaaaggacggctgagtcccgcgaatacacggcggcttatccgccttctccatatcccgatcaaatctccggtcgccgctgctattttcgctagaaaagacacccgtgagtttcttgattcatcaatcaaattagtaaacgaagaagacgatttcggtttcagtttcgatttcaaaccgtacatgatcagcaaagcagagacaataaacagagcattagatgaagcaattccacttattgagccactcaacatccacaaggcaatgcgttacgcgattctcgcaggcggaaaacgtgtcaggccaatactctgcctagccgcttgcgagctagtcggcggggaagagcgtttagcgattcaagcggcttgtgcagttgaaatgattcacacaatgtcactcatcaaagacgatcttccttgtatggacaacgacgatctccgacgagggaaaccaacaacacataaagtcttcggagaaagcgtagccatactctccggcggcgcacttttagctctagctttcgagcatttgacggaagctgacgtgtcatccaagaaaatggttcgagccgttaaagaattggctaagtctattggaacgaaaggactcgtagcgggacaggcgaaggatttaagcagtgaagggttggaacaaaacgatgtcggattagaggatcttgaatatattcacgttcataaaaccggttcgttgcttgaagcatctgcggttatcggagcggttataggcggtggaacagagaaagagatagagaaagtgagaaactttgcgaggtgtatcggattgttgtttcaggtggttgatgatatcttggatgagaccaagtcgtcggaggaattgggaaaaaccgccggaaaagataaggtcgccggaaagctgacgtatccaaaagtgattggtgttgagaaatctaaggagtttgtggagaagttgaagagagatgcgagagaacatcttcaagggtttgattctgacaaagtcaaacctttgatagctcttactaacttcattgccaacagaaaccactgaaaattgttgtttgc

SEQ ID NO: 13394 - protein, 372 aa, Arabidopsis thaliana (mouse-ear cress)
MEAQNIFLYLLIVFLSLHFVFTTLKGRLSPANTRRLIRLLHIPIKSPVAAAIFARKDTREFLDSSIKLVNEEDDFGFSFDFKPYMISKAETINRALDEAIPLIEPLNIHKAMRYAILAGGKRVRPILCLAACELVGGEERLAIQAACAVEMIHTMSLIKDDLPCMDNDDLRRGKPTTHKVFGESVAILSGGALLALAFEHLTEADVSSKKMVRAVKELAKSIGTKGLVAGQAKDLSSEGLEQNDVGLEDLEYIHVHKTGSLLEASAVIGAVIGGGTEKEIEKVRNFARCIGLLFQVVDDILDETKSSEELGKTAGKDKVAGKLTYPKVIGVEKSKEFVEKLKRDAREHLQGFDSDKVKPLIALTNFIANRNH

SEQ ID NO: 13395 - DNA, 876 bp, Streptococcus pneumoniae
  CDS (1)..(876)
atgaaaaagcaagaaaaattagctcttgtcgagtcggctttggaagatttttatggagaccagcagtttgcctctagtttacgggagtctgttctctattctattcatgctggtggcaagcgtattcggccttttctcttgttagaagttctggaagccttgcaggttaccatcaaacctgctcacgcgcaggtagctactgccttagagatgattcatacagggagcttgattcacgatgaccttcctgctatggatgatgacgattatcgaagagggcggttaaccaatcacaagaaattcggtgaagctatggccattttggctggagatgccttattcttagactcatatgccttgattgcgcaggcagatttgccaagtcagattaaggtggacttgattgccaacttatcccttgcttcaggtagtctgggtatggtagcagggcaagttttggatatggagggcgaacaccagcacttgtctttggaagaacttcagactattcatgccaataagactgggaagttactagcctatcccttccaagcggcagctattatagctgaattgtcacctgaaatgcaggtgaagctgaaaactgtgggtgaattgattggacttgcttttcaagtcagagatgatgtactggatgtgacagctagttttgaggaaatcggcaagacacctcaaaaggatctgcaggcagaaaaatcaacctatcctgccctgttgggcttggaagagtccattgccttttgtaaccaaaccctggatcaagctaatgaaaaattagaagaaattgcccagcagcttccctttgaaacagaatcgattgtaagtgtagtagaaagtttgagaatcaatggctaa

SEQ ID NO: 13396 - protein, 291 aa, Streptococcus pneumoniae
MKKQEKLALVESALEDFYGDQQFASSLRESVLYSIHAGGKRIRPFLLLEVLEALQVTIKPAHAQVATALEMIHTGSLIHDDLPAMDDDDYRRGRLTNHKKFGEAMAILAGDALFLDSYALIAQADLPSQIKVDLIANLSLASGSLGMVAGQVLDMEGEHQHLSLEELQTIHANKTGKLLAYPFQAAAIIAELSPEMQVKLKTVGELIGLAFQVRDDVLDVTASFEEIGKTPQKDLQAEKSTYPALLGLEESIAFCNQTLDQANEKLEEIAQQLPFETESIVSVVESLRING

SEQ ID NO: 13397 - DNA, 1044 bp, Halobacterium sp. NRC-1
  CDS (1)..(1044)
atgtcccaggaagcgcgcgaacgggcagtgctcgcggcggtccgtgagcgccgccagcaggtcaacgacgcgatcgacgacgacctcccggttgcggagcccgagcgcctctacgaggcgtcccggtatatcctcgaagccggcgggaagcggctgcggccggcggtcctgttgttgaccgcggaggcgctcgccgacacgagcgacacgcccccctaccgggagttcccggactgcatcggcggccacgtcgacgtgatgtcggcggcggtctcgatcgaggtgatccagtcgttcacgctcatccacgacgacatcatggacgacgacgacctgcgccgagggtcgccggctgtccaccgtgagtacgacaccgagaccgcgattctcgccggggacacgctgtactcgaaggcgttcgagatcatgctggagaccggcgcaccgcccgagcgtgggcttcgcgcgatgcggacgctggcggagacgtgcacccacatctgtgaggggcaggcgatggacatcgacttcgagactcggggtgacgtggtcaccgatgagtacttggagatggtggagctgaagaccgccgtcctgtacgcggccgccgcgaccctgccggggttgttgctctccgccgacgaggagacggttgaggcgctgtacaactacgggctgcgcgtcgggcaggccttccagatccaggacgacgtgttggatctcacggtgccgtcggcggaactcggcaagcaacgcgggtccgacctggttgaggacaagacgacgatcatcacgctgcacgccgccgagcacggcgtcgacgtcgatgggctgctcgacgccgaggacccggcggatgtcaccgaggcggcggtgcaagcggccgtccaagcgctccaggacgccgggagcatccagtacgcgagcgatctcgccgaggacctcgtcgaagaggggaaagcccacctcgaggtgctccccgagaacgaggcccgccaccggctggagcagatcgcggactacctcatcgagcgcgggtactag

SEQ ID NO: 13398 - protein, 347 aa, Halobacterium sp. NRC-1
MSQEARERAVLAAVRERRQQVNDAIDDDLPVAEPERLYEASRYILEAGGKRLRPAVLLLTAEALADTSDTPPYREFPDCIGGHVDVMSAAVSIEVIQSFTLIHDDIMDDDDLRRGSPAVHREYDTETAILAGDTLYSKAFEIMLETGAPPERGLRAMRTLAETCTHICEGQAMDIDFETRGDVVTDEYLEMVELKTAVLYAAAATLPGLLLSADEETVEALYNYGLRVGQAFQIQDDVLDLTVPSAELGKQRGSDLVEDKTTIITLHAAEHGVDVDGLLDAEDPADVTEAAVQAAVQALQDAGSIQYASDLAEDLVEEGKAHLEVLPENEARHRLEQIADYLIERGY

SEQ ID NO: 13399 - DNA, 1017 bp, Caulobacter crescentus
  CDS (1)..(1017)
atggttttggacgcagccgcagcgaccctgccccggaagtcgggatcggtggatcgtctcgtgcgcctcgccgaggccgacatggcgggcgtcaaccgtctgatcaccgatcgcatgcagagcgatgtggcgatcatccccgccctggccgagcatctgatcgccgcgggcggcaagcgcctgcgtccgctgatgaccgtggccgccgcgcgtctggccggcgccgacaacgaccacttccagaagctggccgccgccgtcgaattcattcacaccgccaccctgctgcatgacgatgtcgtcgacggcagccagctgcgccgcggcaaggtcgccgcgcacctgatctggggcggcgcgcagagcgtgctggtcggcgacttcctgttcgcccgcgccttcgagctgatggtcgagaccaactccatgaaggcgctggagatcctcgcccgcgccagccgcgtcatcgccgagggcgaggtgctgcaactgatgcgcagccacgacctgaatctgtcgcaggcggtctatctggagatcatccaggccaagaccgccgagctgttcgccgccgcttcggaagccggggcggtttcggccggtgtcgatgtggcgaagtccgaggctttgcgggattacggcctgaacctgggtctggcgttccagctggccgacgacgccctggattacggcggcgcgaccgaaaccctgggtaagaacgccggcgacgacttccgcgaaggcaaggccacactgccgctgctgctggccatcgcccgctcgggtccccgcgaagccgagttctgggagcgcgctatcggtcggcgtgagcagactgaggccgatttccgtcgcgcccgcgaactgatcatcggctcgggcgcgctggacgcgacgctggatctggccgctgactatgccgacaaggccaaggccgcgctggcgatgttcccggccaatgactggcgcgaggcgcttgaggagctggccgactttgcggtcagccgccgcgcctag

SEQ ID NO: 13400 - protein, 338 aa, Caulobacter crescentus
MVLDAAAATLPRKSGSVDRLVRLAEADMAGVNRLITDRMQSDVAIIPALAEHLIAAGGKRLRPLMTVAAARLAGADNDHFQKLAAAVEFIHTATLLHDDVVDGSQLRRGKVAAHLIWGGAQSVLVGDFLFARAFELMVETNSMKALEILARASRVIAEGEVLQLMRSHDLNLSQAVYLEIIQAKTAELFAAASEAGAVSAGVDVAKSEALRDYGLNLGLAFQLADDALDYGGATETLGKNAGDDFREGKATLPLLLAIARSGPREAEFWERAIGRREQTEADFRRARELIIGSGALDATLDLAADYADKAKAALAMFPANDWREALEELADFAVSRRA

SEQ ID NO: 13401 - DNA, 999 bp, Sulfolobus solfataricus
  CDS (1)..(999)
atgagtagtgatgatctaagtttatattttaacgagatagttaacaatgtaaattttcggataaaaaattttgtaaagagcaattttaagacgcttgaggaagcatcatttcatttatttacagcaggaggtaaaagacttagaccattagtgttggtttcatcttcagacttaattggcggggacagagaaagggcatacaaggcagctgcagccgtagaaattcttcacaattttactctagtccacgatgatattatggacaacgatggtctgagaagaggattaccaactgttcatgtaaagtggggtgaaccaatggcaatacttgcgggggattacttacacgcaaaggcttttgaagccttaaatgaggcactaaagggtcttgacggcaatactttttataaggcattttctatatttatcacttctattgagataatatctgaaggtcaagcaatggatatgtcatttgagaacagacttgacgtaactgaggaagagtatatacaaatgataaaaggaaagaccgcgatgctgttttcatgctctgcagcgttaggtggtataattaataaggctaatgatgatgtggttaaaaaattaaccgaatatggattaaatttgggtatatcgttccaaatagtagatgatatcctaggaattattggagatgaaaaggaactagggaaaccgatttatagtgatattagggaaggtaagaagacaattctagttataaaaactttaagtgaagctactgaagatgagaagaaaattctggtttcaacacttggtaacaaggaagctaaaaaagaagatctagaaagagcctcggaaataataagaaaacattcattacaatatgcatacgatttagctaaaaaatactcggatcttgcaatagaaaacttacgtgaaattcctgtttctaataaaactgctgaaaaggctttaaagtatctagcacagtttaccattcaaaggagaaagtaa

SEQ ID NO: 13402 - protein, 332 aa, Sulfolobus solfataricus
MSSDDLSLYFNEIVNNVNFRIKNFVKSNFKTLEEASFHLFTAGGKRLRPLVLVSSSDLIGGDRERAYKAAAAVEILHNFTLVHDDIMDNDGLRRGLPTVHVKWGEPMAILAGDYLHAKAFEALNEALKGLDGNTFYKAFSIFITSIEIISEGQAMDMSFENRLDVTEEEYIQMIKGKTAMLFSCSAALGGIINKANDDVVKKLTEYGLNLGISFQIVDDILGIIGDEKELGKPIYSDIREGKKTILVIKTLSEATEDEKKILVSTLGNKEAKKEDLERASEIIRKHSLQYAYDLAKKYSDLAIENLREIPVSNKTAEKALKYLAQFTIQRRK

SEQ ID NO: 13403 - DNA, 999 bp, Bradyrhizobium japonicum
  CDS (1)..(999)
atgcagactggttccacgccacacgacgaccgagctggcgtttccgcgaacggcatattgggcgcgcaggcgcgcggcgcatccggcaggctgctgcccgagatctggatgcaggacggcgcaaagcgggtcgaagaggcgctggcgcgtcttctctgcgccgaagacgacggtgagaccgagctgatggcggcgatgcgctacgccaccttgcatggcggcaagcgcacccgcgccttgctctgtttggctgccggcgcactggccgacacgccggcgcacatgctcgatgacgtcggtgccgccatcgagatgatgcacgcctgtacgttggtccacgacgatctgcccgcgatggacgacgacgtgcttcgccgcggccttccgaccgtgcacgtcaagttcggcgaagccaccgcgatcctggtcggcgatgcgctgcaggcgcacgccttcctgaccctggcgagcctgaatgcgccgggcgacagccctatcgcgctcgtgcgcgaactggcgcaggcggtgtccgccgagggggccgcaggcgggcaggccatagatctgtcgctggttggaaagcacgtcgagctggacaggatcgtggcgatgcaccggatgaagagcggagcgctagtgcgcgcgtccgttcgcatgggcgcgctatgcgctgtcggcgtgaatgccgcgcacgctgcactttactgtgcgctggatcactacagcgcctgtttcggcctggcgttacaggtgatcgacgacattctcgacgtgacagcggataccgcggcgctgggcaagacccccggcaaggacgcggcggcgcagaagccgacctgcgcgtcgatcatgggactgcaggaagcacgccagttcgcgctggatctgttgcgcgatgccggcgaggccatcgcgccgctggggccgcgtgcggaacggttggcgcaactcatacagcgggccaacgcgtatctgttcaaacacgcgccacgcgcatga

SEQ ID NO: 13404 - protein, 332 aa, Bradyrhizobium japonicum
MQTGSTPHDDRAGVSANGILGAQARGASGRLLPEIWMQDGAKRVEEALARLLCAEDDGETELMAAMRYATLHGGKRTRALLCLAAGALADTPAHMLDDVGAAIEMMHACTLVHDDLPAMDDDVLRRGLPTVHVKFGEATAILVGDALQAHAFLTLASLNAPGDSPIALVRELAQAVSAEGAAGGQAIDLSLVGKHVELDRIVAMHRMKSGALVRASVRMGALCAVGVNAAHAALYCALDHYSACFGLALQVIDDILDVTADTAALGKTPGKDAAAQKPTCASIMGLQEARQFALDLLRDAGEAIAPLGPRAERLAQLIQRANAYLFKHAPRA

SEQ ID NO: 13405 - DNA, 990 bp, Haemophilus influenzae
  CDS (1)..(990)
atgaagaaacaagatcttatgagcatagacgagatccagaaacttgcagatccagatatgcaaaaagttaatcaaaatattcttgctcagcttaattcagatgtaccgctaataggacagttaggtttttatattgttcaaggtggtggtaagcggatccgtccgttgatcgcagttctcgcagcacgatctttagggtttgaaggatctaattcaattacttgtgctacttttgttgaatttattcataccgcttctttgttacacgatgatgtcgtagatgaatctgatatgcgtcgtgggcgtgctacggcgaatgctgaatttggtaatgcagcgagtgtgttggtaggcgattttatttatacgcgtgcatttcaattagttgcacagttagaatcattgaaaattttaagtattatggctgatgcgactaatgttttagcggaaggcgaagttcagcagttaatgaatgttaatgatcctgaaacgagcgaagctaattatatgcgtgtaatttatagcaaaactgcccgtttgtttgaagtggctggtcaggctgcggcaattgtcgccggtggaacagaagctcaagaaaaggctttacaagattatgggcgttatcttggcactgcatttcagctcgtggatgatgtattggattatagtgcaaatacgcaagctctaggtaaaaatgtaggcgatgatttagctgaaggaaaaccaacccttcctctactacacgctatgcgtcatggaaatgctcaacaggcagctttaattcgcgaagcgattgagcaaggtggtaaacgtgaagcaattgatgaagtattagctattatgactgagcataagtctttagattatgcaatgaatcgtgcaaaagaagaggctcaaaaagcagtggatgcaatcgaaattttgccagaaagtgaatataaacaagcgttgatttcattggcatatttgtctgtagatagaaattattag

SEQ ID NO: 13406 - protein, 329 aa, Haemophilus influenzae
MKKQDLMSIDEIQKLADPDMQKVNQNILAQLNSDVPLIGQLGFYIVQGGGKRIRPLIAVLAARSLGFEGSNSITCATFVEFIHTASLLHDDVVDESDMRRGRATANAEFGNAASVLVGDFIYTRAFQLVAQLESLKILSIMADATNVLAEGEVQQLMNVNDPETSEANYMRVIYSKTARLFEVAGQAAAIVAGGTEAQEKALQDYGRYLGTAFQLVDDVLDYSANTQALGKNVGDDLAEGKPTLPLLHAMRHGNAQQAALIREAIEQGGKREAIDEVLAIMTEHKSLDYAMNRAKEEAQKAVDAIEILPESEYKQALISLAYLSVDRNY

SEQ ID NO: 13407 - DNA, 894 bp, Bacillus stearothermophilus
  CDS (1)..(894)
atggcgcagctttcagttgaacagtttctcaacgagcaaaaacaggcggtggaaacagcgctctcccgttatatagagcgcttagaagggccggcgaagctgaaaaaggcgatggcgtactcattggaggccggcggcaaacgaatccgtccgttgctgcttctgtccaccgttcgggcgctcggcaaagacccggcggtcggattgcccgtcgcctgcgcgattgaaatgatccatacgtactctttgatccatgatgatttgccgagcatggacaacgatgatttgcggcgcggcaagccgacgaaccataaagtgttcggcgaggcgatggccatcttggcgggggacgggttgttgacgtacgcgtttcaattgatcaccgaaatcgacgatgagcgcatccctccttccgtccggcttcggctcatcgaacggctggcgaaagcggccggtccggaagggatggtcgccggtcaggcagccgatatggaaggagaggggaaaacgctgacgctttcggagctcgaatacattcatcggcataaaaccgggaaaatgctgcaatacagcgtgcacgccggcgccttgatcggcggcgctgatgcccggcaaacgcgggagcttgacgaattcgccgcccatctaggccttgcctttcaaattcgcgatgatattctcgatattgaaggggcagaagaaaaaatcggcaagccggtcggcagcgaccaaagcaacaacaaagcgacgtatccagcgttgctgtcgcttgccggcgcgaaggaaaagttggcgttccatatcgaggcggcgcagcgccatttacggaacgccgacgttgacggcgccgcgctcgcctatatttgcgaactggtcgccgcccgcgaccattaa

SEQ ID NO: 13408 - protein, 297 aa, Bacillus stearothermophilus [sequence omitted]

SEQ ID NO: 13409 - DNA, 870 bp, Rhodobacter capsulatus
  CDS (1)..(870)
atgtctctggataaacgtatcgagtcggcgctggtcaaggcgctgtcacccgaggctttgggtgaatctccgccgttgcttgccgccgcgctgccttacggggtgtttcccggcggcgcgcggatccggccgacgatccttgtctcggtcgcgctcgcctgtggcgacgattgcccggcggtcaccgatgccgcggccgtggcgctggagctgatgcattgcgcgagcctcgtgcatgacgatctgcccgccttcgacaatgccgacatccggcgcggcaagccgagccttcacaaggcctataatgaaccgcttgcggttctggcgggcgacagcctgctgatccgcggcttcgaagtgctggccgatgtcggcgccgtcaacccggaccgggcgctgaagctgatctcgaaactgggtcagctgtcgggggcgcgcggcgggatctgcgccggtcaggcctgggaaagcgaatccaaggtcgatctggccgcctatcatcaggcgaagaccggggcgctgttcattgccgcgacccagatgggggcgattgcggcgggctacgaggccgaaccctggttcgatctgggcatgcggatcggctcggccttccagatcgccgacgacctgaaagacgcgctgatgtcggccgaggcaatgggcaagcccgccgggcaggacatcgcgaacgaacgcccgaatgcggtcaagacgatgggcatcgagggcgcgcgcaaacatctgcaagatgtgctggcgggggcgatcgcctcgatcccgtcctgccccggtgaggcgaagctggcccagatggtgcagctttacgcccacaagatcatggacatcccggccagcgccgagaggggctga

SEQ ID NO: 13410 - protein, 289 aa, Rhodobacter capsulatus
MSLDKRIESALVKALSPEALGESPPLLAAALPYGVFPGGARIRPTILVSVALACGDDCPAVTDAAAVALELMHCASLVHDDLPAFDNADIRRGKPSLHKAYNEPLAVLAGDSLLIRGFEVLADVGAVNPDRALKLISKLGQLSGARGGICAGQAWESESKVDLAAYHQAKTGALFIAATQMGAIAAGYEAEPWFDLGMRIGSAFQIADDLKDALMSAEAMGKPAGQDIANERPNAVKTMGIEGARKHLQDVLAGAIASIPSCPGEAKLAQMVQLYAHKIMDIPASAERG

SEQ ID NO: 13411 - DNA, 1038 bp, Rhodobacter sphaeroides
  CDS (172)..(1038)
aaccaccttcggcacaatctgtctcatgcccgggattgttgacacccccgtgcgggctgtccagtatcaaagaccagaaggtgtaagaaaaagttgacacctgtggagtcggcggcacggtggccgccccggggcgcaacgatgcgccggagctgtcctatgaggcacaagatggcgtttgaacagcggattgaagcggcaatggcagcggcgatcgcgcggggccagggctccgaggcgccctcgaagctggcgacggcgctcgactatgcggtgacgcccggcggcgcgcgcatccggcccacgcttctgctcagcgtggccacgcgctgcggcgacagccgcccggctctgtcggacgcggcggcggtggcgcttgagctgatccattgcgcgagcctcgtgcatgacgatctgccctgcttcgacgatgccgagatccggcgcggcaagcccacggtgcatcgcgcctattccgagccgctggcgatcctcaccggcgacagcctgatcgtgatgggcttcgaggtgctggccggcgccgcggccgaccgaccgcagcgggcgctgcagctggtgacggcgctggcggtgcggacggggatgccgatgggcatctgcgcggggcagggctgggagagcgagagccagatcaatctctcggcctatcatcgggccaagaccggcgcgctcttcatcgccgcgacccagatgggcgccattgccgcgggctacgaggccgagccctgggaagagctgggagcccgcatcggcgaggccttccaggtggccgacgacctgcgcgacgcgctctgcgatgccgagacgctgggcaagcccgcggggcaggacgagatccacgcccgcccgagcgcggtgcgcgaatatggcgtcgagggcgcggcgaaggggctgaaggacatcctcggcggcgccatcgcctcgatcccctcctgcccggccgaggcgatgctggccgagatggtccgccgctatgccgacaagatcgtgccggcgcaggtcgcggcccgcgtctga

SEQ ID NO: 13412 - protein, 288 aa, Rhodobacter sphaeroides
MAFEQRIEAAMAAAIARGQGSEAPSKLATALDYAVTPGGARIRPTLLLSVATRCGDSRPALSDAAAVALELIHCASLVHDDLPCFDDAEIRRGKPTVHRAYSEPLAILTGDSLIVMGFEVLAGAAADRPQRALQLVTALAVRTGMPMGICAGQGWESESQINLSAYHRAKTGALFIAATQMGAIAAGYEAEPWEELGARIGEAFQVADDLRDALCDAETLGKPAGQDEIHARPSAVREYGVEGAAKGLKDILGGAIASIPSCPAEAMLAEMVRRYADKIVPAQVAARV

SEQ ID NO: 13413 - DNA, 909 bp, Erwinia herbicola
  CDS (1)..(909)
atgacggtctgcgcaaaaaaacacgttcaccccactcgcagtgctgctgagcaattactggctgatattgatcggcggcttgagcagttattgcctgtcgagggagaacgggattttgtaggtgccgcgatgcgtgagggcgcgctggcaccgggtaaacgtattcgcccgatgctgttgttgctcacagcacgcgatctgggctgcgctgtcagccacgagggattgctggatatcgcctgcgccgtggaaatggtgcacgcggcatcgttgattcttgatgatatgccctgtatggatgatgcgcagatcgtcggcggccgccctaccgttcactgtcagtacggcgagcatgtggcaatactggcggcggtcgccttactgagcaaagcctttggggtcattgctgatgcagatggcctgaccgcgctggcaaaaaaccgcgcagtgtcagaattatcaaacgccattggtatgcaaggtttggtacagggtcagtttaaggatctgtcagaaggcgataagcgccgcagcgctgaagccattttgatgacgaaccactttaaaaccagcaccctgttttgcgcgtctatgcagatggcctcaattgtggcgaatgcctccagcgaacgacgcgattacctacaccgtttttcgcttgatctcggccaagcgtttcaactgctggacgacttaacggatggcatggctgacacgggtaaggacatcaatcaggatgaaggcaaatcgaccctggtcaatttattaggctccagagcagttgaagagcgtctgcggcacagtctgcatctcgccagtgagcacctctcagccgcgtgtcaaaacggtcattctactcaacaatttatccaggcctggtttgacaaaaaactcgctgccgtcagttaa

SEQ ID NO: 13414 - protein, 302 aa, Erwinia herbicola
MTVCAKKHVHPTRSAAEQLLADIDRRLEQLLPVEGERDFVGAAMREGALAPGKRIRPMLLLLTARDLGCAVSHEGLLDIACAVEMVHAASLILDDMPCMDDAQIVGGRPTVHCQYGEHVAILAAVALLSKAFGVIADADGLTALAKNRAVSELSNAIGMQGLVQGQFKDLSEGDKRRSAEAILMTNHFKTSTLFCASMQMASIVANASSERRDYLHRFSLDLGQAFQLLDDLTDGMADTGKDINQDEGKSTLVNLLGSRAVEERLRHSLHLASEHLSAACQNGHSTQQFIQAWFDKKLAAVS

SEQ ID NO: 13415 - DNA, 1428 bp, Capsicum annuum (pepper)
  CDS (149)..(1258)
agagaataggaaacaatatcatgacagtccaacatctcgactccatataaaatagtccactcaacactactttatatacatcttcccatattctaatatttttaagcttactttctccaagtgaaattgcaccacaaatctcaaaaaaatgagatctatgaaccttgttgatttatgggctcaacaagcttgtttagttttcaatcaaactttgtcttataaatccttcaatggattcatgaaaatccctttgaaaaattccaaaattaatcctaagttaaataagaaaagaccattttctcctctaacagtttcagcaattgctactaccaaagaagatgaaagaattgaagcagcacagacggaggaaccattcaatttcaagatttacgtaacggaaaaggctatttctgtaaacaaggcattagatgaggctattattgtaaaagaaccccatgttatccatgaagcaatgcgttattcccttctcgccggcggcaaacgggtccggccaatgctttgtctggccgcctgtgaactcgtcggcggcaaccaggaaaacgccatggccgccgcttgcgccgtcgagatgatccacactatgtcactcattcacgatgatttaccttgtatggacaacgacgacctccgccgcggaaaacctaccaaccacaaaatctacggcgaggacgtcgccgtcctcgcgggagactccctcctcgccttcgccttcgaacacattgtcaactccacggccggagtcaccccgtccagaatcgtaggcgctgttgcggagttagctaagtccatcggaaccgaaggactggtcgccggacaagtagcagacataaaatgcaccggcaacgctagcgtctctctagaaacgctggaattcatccacgtacacaaaacggcagctctcctagaatcctccgtcgtactcggcgcaatactcggcggcggcacgaatgtcgaggtggagaagctacggaggtttgccagatgcatcggattactatttcaagtagttgatgacatacttgacgtgacgaagtcgtcagaggagctcggaaaaactgctgggaaagatttggttgtcgataagacgacgtatccaaaattgttgggattagaaaaggctaaggaatttgcggcggagcttaatcgggaagcgaagcaacagctggaagggtttgattcgcgcaaagctgctccgttgattgcattggctgattatattgcttatcgtgataattaggaaatagtaatattatggaatgaatgtgctaattcttcatttgatttaccaaatggaaatgaaggtgatcgatctattaatgaatcaattgcttatcttgttgatacaaattggagtcttaaattcgtaattatatattacgactttcagtgtgcttatgttggtaatat

SEQ ID NO: 13416 - protein, 369 aa, Capsicum annuum (pepper)
MRSMNLVDLWAQQACLVFNQTLSYKSFNGFMKIPLKNSKINPKLNKKRPFSPLTVSAIATTKEDERIEAAQTEEPFNFKIYVTEKAISVNKALDEAIIVKEPHVIHEAMRYSLLAGGKRVRPMLCLAACELVGGNQENAMAAACAVEMIHTMSLIHDDLPCMDNDDLRRGKPTNHKIYGEDVAVLAGDSLLAFAFEHIVNSTAGVTPSRIVGAVAELAKSIGTEGLVAGQVADIKCTGNASVSLETLEFIHVHKTAALLESSVVLGAILGGGTNVEVEKLRRFARCIGLLFQVVDDILDVTKSSEELGKTAGKDLVVDKTTYPKLLGLEKAKEFAAELNREAKQQLEGFDSRKAAPLIALADYIAYRDN

SEQ ID NO: 13417 - DNA, 1258 bp, Arabidopsis thaliana (mouse-ear cress)
  CDS (11)..(1147)
tgatgtgttgatgaaaaatggaaccacaattctttttctctatctctcactcttcattctctccctaaacttcttcttcacgaatcttaaaccaaggctagtccgcctcttccagccttctttagaatctcgtgtcaagaccgctcttttatcccgaaaggaagtagccgcgtttcttgattctcccattgtcgaagacgaagaaggcgaagaaagagaagaggaagaagaaggaggtatcgtttcaaatgccaactttacgtttgagtttgatccatacatgatgagcaaagccgaatcagtgaacaaagctctagaagaagcaattccagtcggagagccactcaagattcatgaagccatgcgatacgcgattcttgcggctggaaaacgtgttaggccaatactctgccttgcttcttgcgagctagtaggtggccaagaaaatgcgacaatacccgccgcttgtgcggttgagatgatccacacgatgtctctaatcaaagacgatttgccttgtatggacaacgacgatttgcgtcgtggaaagcccacgaccgacaaagtctacggcgaaggagttgccattctctctggtggggctctcttgtctcttgcctttgagcacatgaccaccgcggaaatatcctcggagagaatggtttgggcggtgagagaattggctaggtctattgggacaagaggtttagtcgcgggacaagcgatggatataagcagtgaaggtttggacttaaacgaggtcggattagagcatttggagtttatccatgttcataaaaccgcggttttgttggaaactgccgcggttcttggcgccataattggtggtggatctgatgaagagattgaaagtgtgagaaagtttgcaaggtgcattggattgttgtttcaggtggtggatgatattttggacgagacgaagtcgtcggaggaattgggaaaaaccgccgggaaagatcagctcgccggaaagctaacgtatccaaagttgatagggttggagaaatcgaaagaatttgttaagagattgacgaaagatgcacggcaacatcttcaagggtttagttctgaaaaggttgctcctttagtagctcttactacttttattgctaatagaaataagtgattatatatttgccctgtttgtgtgtgttgggtttatgtatacatgctaaagtagtgtgttcccttatttttaagtgtaaccacattttaagatgtttattaatgaatattt

SEQ ID NO: 13418 - protein, 378 aa, Arabidopsis thaliana (mouse-ear cress)
MKNGTTILFLYLSLFILSLNFFFTNLKPRLVRLFQPSLESRVKTALLSRKEVAAFLDSPIVEDEEGEEREEEEEGGIVSNANFTFEFDPYMMSKAESVNKALEEAIPVGEPLKIHEAMRYAILAAGKRVRPILCLASCELVGGQENATIPAACAVEMIHTMSLIKDDLPCMDNDDLRRGKPTTDKVYGEGVAILSGGALLSLAFEHMTTAEISSERMVWAVRELARSIGTRGLVAGQAMDISSEGLDLNEVGLEHLEFIHVHKTAVLLETAAVLGAIIGGGSDEEIESVRKFARCIGLLFQVVDDILDETKSSEELGKTAGKDQLAGKLTYPKLIGLEKSKEFVKRLTKDARQHLQGFSSEKVAPLVALTTFIANRNK

SEQ ID NO: 13419 - DNA, 909 bp, Synechocystis sp
  CDS (1)..(909)
atggttgcccaacaaacacgaaccgactttgatttagcccaatacttacaagttaaaaaaggtgtggtcgaggcagccctggatagttccctggcgatcgcccggccggaaaagatttacgaagccatgcgttattctctgttggcggggggcaaacgattgcgaccgattttatgcattacggcctgcgaactgtgtggcggtgatgaagccctggccttgcccacggcctgtgccctggaaatgatccacaccatgtccctcatccatgatgatttgccctccatggataatgacgatttccgccggggtaaacccactaaccacaaagtgtacggggaagacattgccattttggccggggatggactgctagcctatgcgtttgagtatgtagttacccacaccccccaggctgatccccaagctttactccaagttattgcccgtttgggtcgcacggtgggggccgccggtttagtggggggacaagttctagacctggaatcggaggggcgcactgacatcaccccggaaaccctaacttttatccatacccataaaaccggggcattgctggaagcttccgtgctcacaggcgcaattttggccggggccactggggaacaacaacagagactggcccgctatgcccagaatattggcttagcttttcaagtggtggatgacatcctcgacatcaccgccacccaggaagagttgggtaaaaccgctggtaaagatgtcaaagcccaaaaagccacctatcccagtctcctcggtttggaagcttcccgggcccaggcccaaagtttgattgaccaggccattgtcgccctggaaccctttggcccctccgccgagcccctccaggcgatcgccgaatatattgttgccagaaaatattga

SEQ ID NO: 13420 - protein, 302 aa, Synechocystis sp
MVAQQTRTDFDLAQYLQVKKGVVEAALDSSLAIARPEKIYEAMRYSLLAGGKRLRPILCITACELCGGDEALALPTACALEMIHTMSLIHDDLPSMDNDDFRRGKPTNHKVYGEDIAILAGDGLLAYAFEYVVTHTPQADPQALLQVIARLGRTVGAAGLVGGQVLDLESEGRTDITPETLTFIHTHKTGALLEASVLTGAILAGATGEQQQRLARYAQNIGLAFQVVDDILDITATQEELGKTAGKDVKAQKATYPSLLGLEASRAQAQSLIDQAIVALEPFGPSAEPLQAIAEYIVARKY

SEQ ID NO: 13421 - DNA, 999 bp, Sulfolobus solfataricus
  CDS (1)..(999)
atgagtagtgatgatctaagtttatattttaacgagatagttaacaatgtaaattttcggataaaaaattttgtaaagagcaattttaagacgcttgaggaagcatcatttcatttatttacagcaggaggtaaaagacttagaccattagtgttggtttcatcttcagacttaattggcggggacagagaaagggcatacaaggcagctgcagccgtagaaattcttcacaattttactctagtccacgatgatattatggacaacgatggtctgagaagaggattaccaactgttcatgtaaagtggggtgaaccaatggcaatacttgcgggggattacttacacgcaaaggcttttgaatccttaaatgagtcactaaagggtcttgacggcaatactttttataaggcattttctatatttatcacttctattgagataatatctgaaggtcaagcaatggatatgtcatttgagaacagacttgacgtaactgaggaagagtatatacaaatgataaaaggaaagaccgcgatgctgttttcatgctctgcagcgttaggtggtataattaataaggctaatgatgatgtggttaaaaaattaaccgaatatggattaaatttgggtatatcgttccaaatagtagatgatatcctaggaattattggagatgaaaaggaactagggaaaccgatttatagtgatattagggaaggtaagaagacaattctagttataaaaactttaagtgaagctactgaagatgagaagaaaattctggtttcaacacttggtaacaaggaagctaaaaaagaagatctagaaagagcctcggaaataataagaaaacattcattacaatatgcatacgatttagctaaaaaatactcggatcttgcaatagaaaacttacgtgaaattcctgtttctaataaaactgctgaaaaggctttaaagtatctagcacagtttaccattcaaaggagaaagtaa

SEQ ID NO: 13422 - protein, 332 aa, Sulfolobus solfataricus
MSSDDLSLYFNEIVNNVNFRIKNFVKSNFKTLEEASFHLFTAGGKRLRPLVLVSSSDLIGGDRERAYKAAAAVEILHNFTLVHDDIMDNDGLRRGLPTVHVKWGEPMAILAGDYLHAKAFESLNESLKGLDGNTFYKAFSIFITSIEIISEGQAMDMSFENRLDVTEEEYIQMIKGKTAMLFSCSAALGGIINKANDDVVKKLTEYGLNLGISFQIVDDILGIIGDEKELGKPIYSDIREGKKTILVIKTLSEATEDEKKILVSTLGNKEAKKEDLERASEIIRKHSLQYAYDLAKKYSDLAIENLREIPVSNKTAEKALKYLAQFTIQRRK

SEQ ID NO: 13423 - DNA, 903 bp, cyanelle Cyanophora paradoxa
  CDS (1)..(903)
atgaaacctttacaaacaaatttcaatttattaacttatttatatgaacgtaaagaaattgttgaagacaccttaaataaatctattccacgaggtaatccaacttttatttatgattcaattcgatattcgttatctgcaggagggaaaagaatacgtcccattttgtgtttagcaagttgtgaacttgccggtggaacaatggaaatggctttaccgactgcttgtgctttagagatgattcataccatgtcattaatacatgacgatttacctgcaatggataatgattcttatcgtcgtggtaaaccaacaaatcatattatctatggggaagatcttgcgattttagcaggtgatgctttattagcttatgcttttgaatttattgctacacaaacaaaaaatgttccagcagacttaattgtaaaagtaattgcacaagtagctcattctgtaacaactagtggtttagttgggggacaaattattgatttaagttctgaaggaaaatcagatacaactttggaaactttaaattttattcatattcataagactggagctttattagaagcagcagtgttatctggtgctttattagctggggctaaagaaaaagatatgaatcgttttttacgatatgcccaaaatattggtttagcattccaaattattgatgatgttttagatattatttcaactgaagaaaaattaggtaagagtataggaaaagatttaaaaactcaaaaagcaacctatcctagtttttggggagttgaagaatcaataaaacaagctgaattattagttgaagaagcaaaagaagagattttatattttgataataaagcaatcccattaattgctattgcagatttcattgtaaatcgaaataattaa

SEQ ID NO: 13424 - protein, 300 aa, cyanelle Cyanophora paradoxa
MKPLQTNFNLLTYLYERKEIVEDTLNKSIPRGNPTFIYDSIRYSLSAGGKRIRPILCLASCELAGGTMEMALPTACALEMIHTMSLIHDDLPAMDNDSYRRGKPTNHIIYGEDLAILAGDALLAYAFEFIATQTKNVPADLIVKVIAQVAHSVTTSGLVGGQIIDLSSEGKSDTTLETLNFIHIHKTGALLEAAVLSGALLAGAKEKDMNRFLRYAQNIGLAFQIIDDVLDIISTEEKLGKSIGKDLKTQKATYPSFWGVEESIKQAELLVEEAKEEILYFDNKAIPLIAIADFIVNRNN

SEQ ID NO: 13425 - DNA, 1271 bp, Catharanthus roseus (Madagascar periwinkle)
  CDS (68)..(1141)
gaattcaattacaacatgggttccagcccaatcaatttattgtttggagaatggcagatccagttctatgcgctctaatctttgtcaccctctcaaaaatcaacttcccatttctttttttctttcgggcacaatccgaaagcccattttcagttgttctcgtctctcaatttctgccattataacgaaagaacaaacccaagaagagagcgaaagcaaaagcaagaaagaggtagccttttcttcctcatcttcatttgatttcaaggcatatatgattggaaaggccaattctgttaataaggcattggaagatgcagtcttggttagggaacctttgaaaattcatgaatctatgaggtactcacttctagctggtggtaaaagagttcgtcctatgctctgtattgctgcttgtgaactttttggtggaacagaatctgttgccatgccttctgcttgtgctgttgagatgattcatactatgtctctgatgcacgatgaccttccctgtatggataatgatgatttgagaagagggaagccgacaaatcataaggtttttggggaggatgttgctgttttagctggggatgcccttcttgcatttgcctttgaacatatagcaactgctaccaaaggtgtctcttccgaaagaattgtgagagtagttggggaattggctaagtgtattggttcagaagggctggtggctggacaggttgttgatgtgtgctctgagggcattgctgatgtagggcttgagcatttagagttcatccatattcacaagactgcagctttattagaagggtctgtggttttaggggcaattgtgggtggtgctaatgatgaacaaatttccaaattgaggaaatttgctaggtgtattgggttgttgtttcaggttgtagatgatattcttgatgttactaaatcttctcaagaattaggaaaaactgcagggaaagacttggtggcagataaggtcacttatcctaaacttcttggtattgataagtccagagaatttgctgagaagttgaatagagaagctcaagaacaacttgctgagtttgatcctgaaaaggctgctccattaattgctctagcaaattacatagcctacagagataactaataatatgttgtttaagttataagagaatttcacatttaagatagactataccaatagaattagatattgttgtcacacaagatatgagctggtaattctttcacattgttaatggaaatgatccgaattc

SEQ ID NO: 13426 - protein, 357 aa, Catharanthus roseus (Madagascar periwinkle)
MRSNLCHPLKNQLPISFFLSGTIRKPIFSCSRLSISAIITKEQTQEESESKSKKEVAFSSSSSFDFKAYMIGKANSVNKALEDAVLVREPLKIHESMRYSLLAGGKRVRPMLCIAACELFGGTESVAMPSACAVEMIHTMSLMHDDLPCMDNDDLRRGKPTNHKVFGEDVAVLAGDALLAFAFEHIATATKGVSSERIVRVVGELAKCIGSEGLVAGQVVDVCSEGIADVGLEHLEFIHIHKTAALLEGSVVLGAIVGGANDEQISKLRKFARCIGLLFQVVDDILDVTKSSQELGKTAGKDLVADKVTYPKLLGIDKSREFAEKLNREAQEQLAEFDPEKAAPLIALANYIAYRDN

SEQ ID NO: 13427 - DNA, 1394 bp, Sinapis alba (white mustard)
  CDS (105)..(1205)
ccaactttaaattgattttgactccaattttctctgagtcctataaaaaaatcatttcatttttgttcttttaattgtaatctgaaattgcagattgttgttgaatggcttcttcagtgactcctctaggttcatgggttcttcttcaccatcatccttcaactatcttaacccaatccagatccagatctcctccttctctcatcacccttaaacccatctccctcactccaaaacgcaccgtttcgtcttcttcctcctcttccctcatcaccaaagaagacaacaacctcaaatcctcttcctcttccttcgatttcatgtcttacatcatccgcaaagccgactccgtcaacaaagccttagactccgccgtccctctccgggagccactcaagatccacgaagcgatgcgttactctctcctcgccggaggaaaacgcgtcagaccagttctctgcatcgccgcgtgcgagctagtcggaggagaagagtctttagctatgccggcgcgttgcgccgtggaaatgatccacaccatgtcgttgatccacgacgacttgccttgtatggataacgacgatctccgccgcggaaagcccacgaatcacaaagtttacggcgaagacgtggcggttttagccggagacgcgcttctttcgttcgccttcgagcatttagcgtcggctacgagctcggaggtttctccggcgagagtggttagagctgtgggagagttggctaaagccatcggcaccgaagggctcgtggcgggacaagtggtggatataagcagtgaagggttggacttaaacaacgtcggattggagcatttgaagtttatacatttgcataaaacggcggcgttgcttgaagcttcagcggttttgggtgggatcatcggtggagggagtgatgaagagatcgagaggctgaggaagttcgcgaggtgtattgggttgttgtttcaggtggttgatgatatcttggacgtgacgaaatcgtctcaagaactggggaaaaccgctgggaaagatttgattgctgataagttgacttatccgaagctcatgggtttggagaaatcgagagagttcgctgagaagttgaatacagaggcacgtgatcagcttttagggtttgattccgacaaggttgctcctttgttggctttggctaattacattgccaatagacagaactgatgttctgtgtgtgtgttttttagttcttgtcggaattctctctgatcttgttttcatatcgaattgtagaattattggagagaagctaaaacagattctagtgtttgtaatggctatctcatgtgttggtatgattgctatgttatagattttaatgttaagagagatcagtgattctagtaaaaaaaa

SEQ ID NO: 13428 - protein, 366 aa, Sinapis alba (white mustard)
MASSVTPLGSWVLLHHHPSTILTQSRSRSPPSLITLKPISLTPKRTVSSSSSSSLITKEDNNLKSSSSSFDFMSYIIRKADSVNKALDSAVPLREPLKIHEAMRYSLLAGGKRVRPVLCIAACELVGGEESLAMPARCAVEMIHTMSLIHDDLPCMDNDDLRRGKPTNHKVYGEDVAVLAGDALLSFAFEHLASATSSEVSPARVVRAVGELAKAIGTEGLVAGQVVDISSEGLDLNNVGLEHLKFIHLHKTAALLEASAVLGGIIGGGSDEEIERLRKFARCIGLLFQVVDDILDVTKSSQELGKTAGKDLIADKLTYPKLMGLEKSREFAEKLNTEARDQLLGFDSDKVAPLLALANYIANRQN

SEQ ID NO: 13429 - DNA, 999 bp, Rhizobium sp
  CDS (1)..(999)
atgcagaccggttccacgctacacgacgaccgaactagcgtttccgccctcggcggattgggcgcgcgggcgcgcggcgcatccggcaggctgctgccggagatctggatgcagaacggcgcaaagcgggtcgaacaggcgctagcgcgtcttctctgcgccgaagaccacggtgagaccgagcttatggcggcgatgcgctacgccaccttgcatggcgggaagcgcacccgcgccctgctctgtctggctgctggagcactggccgacacgccggcgcacatactcgacgacgtcggcgccgccatcgagatgatgcacgcttgtaccctggtccacgacgacctgcccgcaatggacgacgacgtgcttcgccgcggccttccgaccgtgcatgtcaagttcggcgaagccactgcgatcctggtcggcgatgcgctgcaggcacacgccttcctgaccctggcaagcctggatgcgccgggcgacaaccgtatcgcgctcgtgcgcgaactggcgcaggcggtgtctgccgagggtgccgcaggcgggcaggccatggatctgtcgctggtcggaaagcacgtcgagctggacaggatcgtagcgatgcaccggatgaagtgcggagcgctagtgcgtgcgtccgttcgcatgggcgccctatgcgccatcgcggaggatgccgcggacgctacgctgtactgtgcgctcgatcactacagcgcctgtttcggcctggcgttgcaggtggtcgacgacattctcgacgcgacagcggataccgcgacgctgggcaagacccccggcaaggacgcggcggcgcagaaaccgacctgcgcgtcgatcatggggctgcaggcagcgcgccagttcgcgctggatctgttgtgtgaggccggggaggccattgccccgctggggccgcgtgcggaacggttggcgcagatgctgcagcgggccagtgcgtacctgttcaagcacgcgccatccgcatga

SEQ ID NO: 13430 - protein, 332 aa, Rhizobium sp
MQTGSTLHDDRTSVSALGGLGARARGASGRLLPEIWMQNGAKRVEQALARLLCAEDHGETELMAAMRYATLHGGKRTRALLCLAAGALADTPAHILDDVGAAIEMMHACTLVHDDLPAMDDDVLRRGLPTVHVKFGEATAILVGDALQAHAFLTLASLDAPGDNRIALVRELAQAVSAEGAAGGQAMDLSLVGKHVELDRIVAMHRMKCGALVRASVRMGALCAIAEDAADATLYCALDHYSACFGLALQVVDDILDATADTATLGKTPGKDAAAQKPTCASIMGLQAARQFALDLLCEAGEAIAPLGPRAERLAQMLQRASAYLFKHAPSA

SEQ ID NO: 13431 - DNA, 1157 bp, Lupinus albus (white lupine)
  CDS (136)..(1086)
cacaaaaccactagattcagatcttcaagttttcaaatcttccatagctttacaaagttacccatttcttttataagcatcgaaaaaccaaaaaggtcacaactttcatatttttcttctttctctatctctgcaatgctcactaaagaagataccgttaaagacaaagaagaagaagaagaagaagaagagaaacccagattcaatttcaacttgtacatggttgagaaatcacgttcagtgaaccaagctttaaacgacgccgtttcgttacgtgagccacataaaattcacgaagctatgcggtattctctactcgccggcgggaagcgcgtgaggccggtgttatgcattgcagcctgtgaagttgtcggcggcaatgaatctacggcgatggccgccgcatgttcaattgagatgatacacactatgtcccttattcatgatgatctcccctgcatggacaacgacgatcttcgccgagggaaacccacaaaccacaaggttttcggcgaaaatatcgctgtccttgcaggggatgcattattggcatttgcctttgagcatatcgccgtttcaacctccggtgtgtcaccggagagaattatcggcgcaatcggggagcttgcgaaatcgatcggaactgaaggccttgttgcaggacaagtagtggatattaattcagaagggttatgtgatattgggttagagaaattggaatttattcatcttcataaaacagcagcacttctagaaggttctgttgttgttggagcaattcttggtggtgggtgtaatgaagaggttgaaaagttaaggatgtttgctaggtacataggattgatgtttcaggttgttgatgatgttcttgatgttactaagtcttcaaaggaattgggaaaaactgcagggaaggatttggtggctgataaggttacttaccctaagcttttagggattgagaaatctaatgagtttgctcagaaattgaatagggatgcacaagaacagctttctggttttgatccagttaaggttgctcctttgattgcattagctaattacattgcttatagcccaaattaaactctcttgtgtaacaatttgttgtttagaaaaggttaaatttatggcaattattgagtttacttattacc

SEQ ID NO: 13432 - protein, 316 aa, Lupinus albus (white lupine)
MLTKEDTVKDKEEEEEEEEKPRFNFNLYMVEKSRSVNQALNDAVSLREPHKIHEAMRYSLLAGGKRVRPVLCIAACEVVGGNESTAMAAACSIEMIHTMSLIHDDLPCMDNDDLRRGKPTNHKVFGENIAVLAGDALLAFAFEHIAVSTSGVSPERIIGAIGELAKSIGTEGLVAGQVVDINSEGLCDIGLEKLEFIHLHKTAALLEGSVVVGAILGGGCNEEVEKLRMFARYIGLMFQVVDDVLDVTKSSKELGKTAGKDLVADKVTYPKLLGIEKSNEFAQKLNRDAQEQLSGFDPVKVAPLIALANYIAYSPN

SEQ ID NO: 13433 - DNA, 1137 bp, Streptomyces coelicolor
  CDS (1)..(1137)
atgaaagccgatccgcgcgggaccggctcccgcactcccggcaccgcaactggaggaaagactgtgcccactgtgcccccggccccgacggccgatcgacggaccacggtggacgtgaccgcgcttctggagcgcggccggaccctggccacgccggtcctgcgggcggccgtcgaccgcctggcccctcccatggacaccgtcgccgcctaccacttcggctggatcgacgcccagggcaaccccgcggacggcgacggtggcaaggccgtccgccccgcgctcgccgtgctctccgccgaggtcaccggcgccgcccccgaggtcggcgtgcccggcgcggtggccgtggaactggtgcacaacttctccctcctgcacgacgacctgatggacggcgacgagcagcgccgccaccgcgacaccgtctggaaggtgcacggccccgcccaggccatcctggtcggcgacgccctgttcgccctcgccaacgaggtgctgctcgaactgggcaccgtcgaggccgggcgggccacccgccgcctgaccaaggccagccgctccctgatcgacggtcaggcccaggacatctcctacgagcaccgcgaccgcgtcagcgtcgaggagtgcctggagatggagggcaacaagaccggcgccctgctcgcctgcgccagctccatcggcgcggtgctcggcggcgccgacgaacgcaccgccgacaccctggagaagtacggctaccacctcggtctcgccttccaggccgtcgacgacctgctcggcatctggggcgacccggacgccaccggcaagcagacctggagcgacctgcgccagcgcaagaagtcgctgccggtcgtcgccgccctcgcggccggcggggccgcttccgagcggctcggcgagatcctcacggccgacgccaaggccagcgacttcgcgaacttctccgaggaggagttcgcggcccgcgccgccctcatcgaggaagcgggcgggcgggagtggaccgccgacgaggcgcgtcgccagcacaccatcgccatcgaagccctcgacgccgtcgacatgcccgaccgggtgcgggaccggttcacggccctcgcggacttcgtcgtcgtacgaaagagatga

SEQ ID NO: 13434 - protein, 378 aa, Streptomyces coelicolor
MKADPRGTGSRTPGTATGGKTVPTVPPAPTADRRTTVDVTALLERGRTLATPVLRAAVDRLAPPMDTVAAYHFGWIDAQGNPADGDGGKAVRPALAVLSAEVTGAAPEVGVPGAVAVELVHNFSLLHDDLMDGDEQRRHRDTVWKVHGPAQAILVGDALFALANEVLLELGTVEAGRATRRLTKASRSLIDGQAQDISYEHRDRVSVEECLEMEGNKTGALLACASSIGAVLGGADERTADTLEKYGYHLGLAFQAVDDLLGIWGDPDATGKQTWSDLRQRKKSLPVVAALAAGGAASERLGEILTADAKASDFANFSEEEFAARAALIEEAGGREWTADEARRQHTIAIEALDAVDMPDRVRDRFTALADFVVVRKR

SEQ ID NO: 13435 - DNA, 933 bp, Rubrivivax gelatinosus
  CDS (1)..(933)
atgaacacgatgactcgcatcgaacaggcgctggaggcggcccttgtcgccaacgaaggcgccggttgtcccccgaagctggccgcggcgatccgccacgccgtcttccccggcggtgcccgcatccggccgcagctgtgcatcgccgtcgcgatggccaacggcgacaccgacccggccctggccgatgccgccgcgtcggcgatcgaactgatccactgcgcttcgctggtgcacgacgacctgccgtgtttcgacgacgcgccgacgcgccgcggccagccctcggtgcacaaggcctacggcgaacgcctggccgtgctggccggcgacgcgctgatcgtcaccgccttccagactctcggcgccgccggtggccgccaccccgagcgcatggcgcacgtgctgcagaccgtggcacgcggcgtcggcacgccgctgggcatcatcgccggccaggcctgggagtgcgaaccgcgcgtcgcgctgtccgactaccagcgtgccaagaccggggcgctgttcgccgcggccacggccgccggcgcgcaggcctcgggcggtgacggcgagacctggcgtgcgctcggcgactggctgggcgaagcctatcaagtggccgacgacgtgcgtgacgcgctcgccgaccccgaacaactcggcaagccggtcggccgcgacgtcgcgctcggccgcccgagcgcggcgatccagcacggcctggtcggcgccgtcgaacatttcgaacgcctggtgcagggcgcgatcgacgtcatcccggactgcaagggcgccggcatgctgcgccagatcgtgcgcatggaggccgagcgtctcgtgcccaaggcctggtgcgccaacatcgaagcgctcgccgagcgcgccgcggttcgtgccgccgagcggtccgccgctccgacccagaccgcttga

SEQ ID NO: 13436 - protein, 310 aa, Rubrivivax gelatinosus
MNTMTRIEQALEAALVANEGAGCPPKLAAAIRHAVFPGGARIRPQLCIAVAMANGDTDPALADAAASAIELIHCASLVHDDLPCFDDAPTRRGQPSVHKAYGERLAVLAGDALIVTAFQTLGAAGGRHPERMAHVLQTVARGVGTPLGIIAGQAWECEPRVALSDYQRAKTGALFAAATAAGAQASGGDGETWRALGDWLGEAYQVADDVRDALADPEQLGKPVGRDVALGRPSAAIQHGLVGAVEHFERLVQGAIDVIPDCKGAGMLRQIVRMEAERLVPKAWCANIEALAERAAVRAAERSAAPTQTA

SEQ ID NO: 13437 - DNA, 888 bp, Paracoccus sp
  CDS (1)..(888)
atgacgcccaagcagcaattccccctacgcgatctggtcgagatcaggctggcgcagatctcgggccagttcggcgtggtctcggccccgctcggcgcggccatgagcgatgccgccctgtcccccggcaaacgctttcgcgccgtgctgatgctgatggtcgccgaaagctcgggcggggtctgcgatgcgatggtcgatgccgcctgcgcggtcgagatggtccatgccgcatcgctgatcttcgacgacatgccctgcatggacgatgccaggacccgtcgcggtcagcccgccacccatgtcgcccatggcgaggggcgcgcggtgcttgcgggcatcgccctgatcaccgaggccatgcggattttgggcgaggcgcgcggcgcgacgccggatcagcgcgcaaggctggtcgcatccatgtcgcgcgcgatgggaccggtggggctgtgcgcagggcaggatctggacctgcacgcccccaaggacgccgccgggatcgaacgtgaacaggacctcaagaccggcgtgctgttcgtcgcgggcctcgagatgctgtccattattaagggtctggacaaggccgagaccgagcagctcatggccttcgggcgtcagcttggtcgggtcttccagtcctatgacgacctgctggacgtgatcggcgacaaggccagcaccggcaaggatacggggcgcgacaccgccgcccccggcccaaagcgcggcctgatggcggtcggacagatgggcgacgtggcgcagcattaccgcgccagccgcgcgcaactggacgagctgatgcgcacccggctgttccgcggggggcagatcgcggacctgctggcccgcgtgctgccgcatgacatccgccgcagcgcctag

SEQ ID NO: 13438 - protein, 295 aa, Paracoccus sp
MTPKQQFPLRDLVEIRLAQISGQFGVVSAPLGAAMSDAALSPGKRFRAVLMLMVAESSGGVCDAMVDAACAVEMVHAASLIFDDMPCMDDARTRRGQPATHVAHGEGRAVLAGIALITEAMRILGEARGATPDQRARLVASMSRAMGPVGLCAGQDLDLHAPKDAAGIEREQDLKTGVLFVAGLEMLSIIKGLDKAETEQLMAFGRQLGRVFQSYDDLLDVIGDKASTGKDTGRDTAAPGPKRGLMAVGQMGDVAQHYRASRAQLDELMRTRLFRGGQIADLLARVLPHDIRRSA

SEQ ID NO: 13439 - DNA, 1032 bp, Arabidopsis thaliana
  CDS (1)..(1032)
atgctctgtaagattattatcatgcggccgtgttacagcctggttctgtctgcaatgcggctgatacgaccgtccaaccgccgtctaagttcgatcgcaagctccgactctgagttcatttcatacatgaacaataaggctaagtccatcaacaaagcactagacaattcaattccactttgcaacaattctgttcctctttgggagccagtactcgaggttcacaaagctatgaggtacacgcttctctcaggcggcaaacgagtaaggccaatgctctgtttggtcgcttgcgagctcgtaggtggccaagagtcaaccgcaatgcctgcagcctgtgcggttgagatgattcacgcagcgtcgctcatcctagacgaccttccttgtatggatgacgacagcctccgccgtggaatacccaccaaccataaagtttttggcgagaaaacatccatcttggcctctaatgcgctcatgtctttggccgtcaagcagacattggcatcgacctcattgggggtgacttcagagagggttcttcgggctgttcaggagatggcgagagctgttgggacagagggacttgtggcaggccaagcagcggatttggccggagaaaggatgagttttaagaacgaagacgacgaattgagatatcttgagttgatgcatgttcataaaaccgcggttttggttgaagctgcggctgttgtgggagctataatgggaggtgggtctgatgaagagattgagaggcttaagagctacgcgaggtgcgttggactgatgtttcaggtgatggatgatgtactcgatgagaccaagtcttccgaggagcttgggaaaactgccggtaaagatttgatcaccggaaagctgacgtatccgaaggtgatgggtgtggacaatgcgagagaatatgcaaagaggttgaacagagaagcgcaggaacatcttcaggggtttgattctgacaaggtggttcctttgttgtctctcgctgattatattgtcaagagacaaaactga

SEQ ID NO: 13440 - protein, 343 aa, Arabidopsis thaliana
MLCKIIIMRPCYSLVLSAMRLIRPSNRRLSSIASSDSEFISYMNNKAKSINKALDNSIPLCNNSVPLWEPVLEVHKAMRYTLLSGGKRVRPMLCLVACELVGGQESTAMPAACAVEMIHAASLILDDLPCMDDDSLRRGIPTNHKVFGEKTSILASNALMSLAVKQTLASTSLGVTSERVLRAVQEMARAVGTEGLVAGQAADLAGERMSFKNEDDELRYLELMHVHKTAVLVEAAAVVGAIMGGGSDEEIERLKSYARCVGLMFQVMDDVLDETKSSEELGKTAGKDLITGKLTYPKVMGVDNAREYAKRLNREAQEHLQGFDSDKVVPLLSLADYIVKRQN

SEQ ID NO: 13441 - DNA, 1401 bp, Rhodobacter capsulatus
  CDS (205)..(1182)
aagaatatactcaaaggcagcggaccctaaactaaaggctcccgtctggtttaagccctagaattttggctaccttcctggctgctttaggatacaatagctttaattttttaagtatcagatatctaaaagctggttacggtgtttagacgtctcactgtttaactgtgcatccgattactttcgcaagaggttctttttcatatggccatcgatttcaagcaagatattctcgctcctgttgctcaagattttgcagcgatggaccagtttattaatgaaggaatcagctccaaggtcgcactggtcatgtcagtcagcaagcatgtcgttgaagcaggtggaaagcgcatgcgtccgattatgtgcttgctggccgcttatgcctgtggtgaaaccaatttaaagcatgcacagaagctggcggccattattgaaatgctgcatacggcgactctggtacatgatgatgtggtagatgagtctggcttacgccgtggcagaccaacagcaaatgcgacatggaataaccagactgcggtactggtgggggattttctgattgcccgggcatttgatctgctggttgatctggacaatatgatcctgttaaaggacttctctacaggaacctgtgagattgctgagggtgaagtattgcagttgcaggcacagcatcagccagatacaacagaagatatttatttacagattattcacggtaaaacctcacggttgttcgaactggcgaccgaaggcgctgcaatactggcaggcaaacctgaataccgtgaacctttacgtcgttttgccggacactttggcaatgcttttcagattattgatgatattctggattacacttcagatgctgatacgctcggcaaaaatattggcgatgacttgatggaaggcaaacccaccctgccgctgattgcagcaatgcaaaatactcaaggtgaacagcgcgacctgatccgtcgcagcattgccactggcggtacttcacagcttgaacaagttattgcgattgtacaaaattcgggagcgctggattattgccataagcgtgctactgaagaaaccgagcgagcattacaggcactagaaatattacctgagagtacttaccggcaggcgctggttaacttgacccgcttagctttagaccgaatccaataatattattaaaaattttatgcatttaaactttcaagatctttttctcagaatgcaccagcagcttgagcaacctcaagctgtattagatgaaaatattcttattgagctggttaaccgcctacgccccgctgataccaaaaataccgaagaaattgaaagaaaatttcaggcatttatccagtcgcttttaattacaccggctgctgcctgttacatttc

SEQ ID NO: 13442 - protein, 325 aa, Rhodobacter capsulatus
MAIDFKQDILAPVAQDFAAMDQFINEGISSKVALVMSVSKHVVEAGGKRMRPIMCLLAAYACGETNLKHAQKLAAIIEMLHTATLVHDDVVDESGLRRGRPTANATWNNQTAVLVGDFLIARAFDLLVDLDNMILLKDFSTGTCEIAEGEVLQLQAQHQPDTTEDIYLQIIHGKTSRLFELATEGAAILAGKPEYREPLRRFAGHFGNAFQIIDDILDYTSDADTLGKNIGDDLMEGKPTLPLIAAMQNTQGEQRDLIRRSIATGGTSQLEQVIAIVQNSGALDYCHKRATEETERALQALEILPESTYRQALVNLTRLALDRIQ

SEQ ID NO: 13443 - DNA, 978 bp, Micrococcus luteus
  CDS (1)..(978)
atgattgctttgagttataaagcgtttttaaacccatatatcattgaagttgaaaaaaggttatatgagtgtattcagagtgattctgaaacgataaacaaggcggcacaccatattttaagttcaggaggaaagcgcgtacgtccgatgtttgtattattaagtggttttctgaatgatacacaaaaggatgacttgattcgtacagcagtatctctggagctcgttcatatggcaagtctcgttcatgatgattacatcgataatagtgatatgcgtcgtggtaatacttcggttcatatagcttttgataaagacacagcaattcgcacaggacattttttattagcacgtgcgttacaaaatattgcaactatcaataattcgaaattccatcaaatttttagtaaaacgatacttgaagtttgttttggtgaatttgaccagatggcagatcgatttaattatcctgtatcctttactgcatatttaagacgtattaatcgtaaaacagcgatactgatagaagcaagctgtcatttaggggctctcagctcacagcttgatgaacaatctacatatcatataaaacaatttgggcattgtattggaatgagttatcaaattattgatgatattctcgattacacgagtgacgaagcaacactcggtaaacctgtcggtagcgatataagaaacggtcatattacgtatccgcttatggccgctatcgctaatttgaaagagcaagatgacgataaacttgaagcagttgttaaacatttaacatcaacatcagatgatgaagtgtatcaatatattgtttcgcaagttaaacaatatggaattgaacctgcagaattgctgagcagaaaatatggtgataaagcgaaatatcacttgagtcaattacaggatagtaatattaaagattatttagaagaaatccacgaaaaaatgttaaaacgtgtttattaa

SEQ ID NO: 13444 - protein, 325 aa, Micrococcus luteus
MIALSYKAFLNPYIIEVEKRLYECIQSDSETINKAAHHILSSGGKRVRPMFVLLSGFLNDTQKDDLIRTAVSLELVHMASLVHDDYIDNSDMRRGNTSVHIAFDKDTAIRTGHFLLARALQNIATINNSKFHQIFSKTILEVCFGEFDQMADRFNYPVSFTAYLRRINRKTAILIEASCHLGALSSQLDEQSTYHIKQFGHCIGMSYQIIDDILDYTSDEATLGKPVGSDIRNGHITYPLMAAIANLKEQDDDKLEAVVKHLTSTSDDEVYQYIVSQVKQYGIEPAELLSRKYGDKAKYHLSQLQDSNIKDYLEEIHEKMLKRVY

SEQ ID NO: 13445 - DNA, 1283 bp, Helianthus annuus
  CDS (49)..(1119)
atttcttcttgttacaacaacaatcaaatcaaatccacttgtccaaccatgagacccatgagtttggttcattcatgttccatcttcaccggatcttcattcatcaaaacaacccccattaacaacaaacccactttcaagattcaccaaagacccacaattagatccacaatttctgcagcaattgttgaagaagaagtagttgagttgcaacaaaaacccaaacccactttcaatttcaacgcttacatgttgggaaagggtaattctgtccataaagctcttgatgaatcaattatgattaaaaacccaccaacaatacatgaagctatgaggtactctttacttgctggtgggaagcgcgtcaggcccattctctgtattgccgcgtgtgagctcgtcggaggggaggaggccaccgccatgccggcggcctgtgcggtggagatgatacacaccatgtctttgatacatgatgatcttccttgtatggataatgatgatttccgtagagggaagcccactaatcataaggtttatggggaagacgttgccgttttggcaggcgattcgctgctggcgtttgctttcgagtatgtttctagtaggacggaaggcgcatcgcctgcacgcgtcttggctgccatcggggagctcgccaagtcgattgggaccgaagggctggtggcagggcaagtggtggatattgcttcaaccgggggccaagatatcggattggatcagctagagtttatacacatacataaaaccgcagcattgttggaggcttctgttgtgttgggagctatcttgggtggtgggagtgatgcgcaggtggagaagctgaggacattcgcgcggtgcatcgggttgttgtttcaggtggtggatgatatacttgatgtgaccaagtcgtccgaggaattggggaaaaccgcagggaaagatttgttggtggataagacgacatatccgaaactgcttgggttggacaagtcgaggcagtttgcggaggagttgctggcggaggctaaacagcagctggaggagtttgaatcgcaggcggcggtggcgccgttgttggctctggcggagtatatagcttaccgccagaactaatgttgttgtattgtaacctaggttgctgttgtcatcaatttgattcatacctgtttgatgatgtaagattaattgacttgaagaaacaggaggcaaattagatttttcttttgattgcaatataccacctatattatcattctgaaaaaaaaaaaaaaaaaaaa

SEQ ID NO: 13446 - protein, 356 aa, Helianthus annuus
MRPMSLVHSCSIFTGSSFIKTTPINNKPTFKIHQRPTIRSTISAAIVEEEVVELQQKPKPTFNFNAYMLGKGNSVHKALDESIMIKNPPTIHEAMRYSLLAGGKRVRPILCIAACELVGGEEATAMPAACAVEMIHTMSLIHDDLPCMDNDDFRRGKPTNHKVYGEDVAVLAGDSLLAFAFEYVSSRTEGASPARVLAAIGELAKSIGTEGLVAGQVVDIASTGGQDIGLDQLEFIHIHKTAALLEASVVLGAILGGGSDAQVEKLRTFARCIGLLFQVVDDILDVTKSSEELGKTAGKDLLVDKTTYPKLLGLDKSRQFAEELLAEAKQQLEEFESQAAVAPLLALAEYIAYRQN

SEQ ID NO: 13447 - DNA, 1047 bp, Gluconobacter oxydans
  CDS (1)..(948)
atgctggcctgcaaccgggcgatcatcgcccggatggaaagtccggttcccctgatcccgcagcttggcgcccatcttgtcgcggcgggaggcaagcgccttcgcccgctgctgacgctggcctccgcacgtctgtgcggttatcagccgggtccggaccatcagcgtcatgtcgggctcgccgcctgcgttgagttcattcataccgccacactgctgcatgatgatgtcgtggatgagagcacgttgcgtcgggggctggcttcggccaatgccgtgttcggcaacaaggcgtccgtgctggtaggtgacttcctgttcgcccgctcgttccagcttatgacagcagacggctccctgaaggtcatggcgatcctgtcggatgcatcggcgacaattgctgaaggtgaagtccttcagatggtcgtgcagaacgaccttacgacgcctgtagaacgctatcttgaagtcattcacggcaagacggctgcgctgtttgcggctgcctgccgtgtcggcgctgtcgtggccgagcgtccggaagcagaagaggaagctctggagcggtttggcaccaatctgggtatggcgttccagcttgttgatgatgccctggattatgccgcagaccagcaggttttgggcaagaccgttggtgatgacatgcgtgaaggcaagatcaccctgccggtcctggccgcctatgaggctggctcgccggaagatcgtattttctgggagcgcgtcattggagaaggggagcagactgaggacgatctgcctcatgctctgaacctgattgcaaagacgggtgcgatcaatacgacgatcgcccgcgcgcaggtctatgccgacgcagctgttgaagccctgtccattttcccggatagcgaactgcgccgccttctgatcgaaacggttcagttcacggtgaatcgggcccgctaaaaaccatattctgcgtcagccaactcagggctgacgcagaatatgctttcaggctgtcaaagcgagcggcccgaacagtgaccatccagaaaaacctaa

SEQ ID NO: 13448 - protein, 315 aa, Gluconobacter oxydans
MLACNRAIIARMESPVPLIPQLGAHLVAAGGKRLRPLLTLASARLCGYQPGPDHQRHVGLAACVEFIHTATLLHDDVVDESTLRRGLASANAVFGNKASVLVGDFLFARSFQLMTADGSLKVMAILSDASATIAEGEVLQMVVQNDLTTPVERYLEVIHGKTAALFAAACRVGAVVAERPEAEEEALERFGTNLGMAFQLVDDALDYAADQQVLGKTVGDDMREGKITLPVLAAYEAGSPEDRIFWERVIGEGEQTEDDLPHALNLIAKTGAINTTIARAQVYADAAVEALSIFPDSELRRLLIETVQFTVNRAR

SEQ ID NO: 13449 - DNA, 1109 bp, Arabidopsis thaliana
  CDS (27)..(1007)
caaggatgagatcatcctcataggcgatgttgtttagtggttcagcgatcccattaagcagcttctgctctcttccggagaaaccccacactcttcctatgaaactctctcccgctgcaatccgatcttcatcctcatctgccccggggtcgttgaacttcgatctgaggacgtattggacgactctgatcaccgagatcaaccagaagctggatgaggccataccggtcaagcaccctgcggggatctacgaggctatgagatactctgtactgccacaagggcccaagcgtgcccctcctgtgatgtgtgtggcggcctgcgagctcttcggtggcgatcgcctcgccgctttccccaccgcctgtgccctagaaatggtgcacgcggcttcgttgatacacgacgacctcccctgtatggacgacgatcctgtgcgcagaggaaagccatctaaccacactgtctacggctctggcatggccattctcgccggtgacgccctcttcccactcgccttccagcacattgtctcccacacgcctcctgaccttgttccccgagccaccatcctcagactcatcactgagattgcccgcactgtcggctccactggtatggctgcaggccagtacgtcgaccttgaaggaggtccctttcctctttcctttgttcaggagaagaaattcggagccatgggtgaatgctctgccgtgtgcggtggcctattgggcggtgccactgaggatgagctccagagtctccgaaggtacgggagagccgtcgggatgctgtatcaggtggtcgatgacatcaccgaggacaagaagaagagctatgatggtggagcagagaagggaatgatggaaatggcggaagagctcaaggagaaggcgaagaaggagcttcaagtgtttgacaacaagtatggaggaggagacacacttgttcctctctacaccttcgttgactacgctgctcatcgacattttcttcttcccctctgattttgggccctcttttacatttgggccttccttcgctatacgaaattaggccctgtaatggactgtgtatcgttcatttttagcccagagcttcttcgcttg

SEQ ID NO: 13450 - protein, 326 aa, Arabidopsis thaliana
MLFSGSAIPLSSFCSLPEKPHTLPMKLSPAAIRSSSSSAPGSLNFDLRTYWTTLITEINQKLDEAIPVKHPAGIYEAMRYSVLPQGPKRAPPVMCVAACELFGGDRLAAFPTACALEMVHAASLIHDDLPCMDDDPVRRGKPSNHTVYGSGMAILAGDALFPLAFQHIVSHTPPDLVPRATILRLITEIARTVGSTGMAAGQYVDLEGGPFPLSFVQEKKFGAMGECSAVCGGLLGGATEDELQSLRRYGRAVGMLYQVVDDITEDKKKSYDGGAEKGMMEMAEELKEKAKKELQVFDNKYGGGDTLVPLYTFVDYAAHRHFLLPL

SEQ ID NO: 13451 - DNA, 861 bp, Wolinella succinogenes
  CDS (1)..(861)
atgaatttagaatcggtgatggagggctttgagcgcttcttggaggaagaggcgcctctttttgagggatttcacccccattacaatgagtatctttgggagatggtgagaaatggggggaagcgctttcgccctagactgcttttgggggtggtgagtgcattagctccgctacttgtgaagagtgcttatgcacccgccttagcgctagagattctccacacctattcgctcatccacgatgatcttcctgcgatggataatgctgccactaggcgggggcatcccacgcttcatgtcaagtatgatgaggcgagcgcggttttggctggagatgcactcaacacacacgccttttaccttctagcccaagcccccttggggagcgacaccaaggttgcgcttgtgcgagagctcgctagtgcaggcggagcgggaggaatggtgctagggcaggcgttagattgctactttgaacatcaaaagcttgagattgaaaagctccgattcattcacctccacaagacaggccgtctcatcgccgcttcacttaagatgggggcgatcatcgcggcgctttctaaagaggagcaggcgcgattagaggagattggcctgaagcttggacttctctttcaggtgcaagatgacattatcgatgcgacatggagcgaagaggaggcgggcaaaaccacccaaaacgatggagctaaaaacagctatgtcaatcttttgggcttggaaggagcgaggatggagcacgctagactcaaagaggaagtgcgcgtcttgcttggattcttccccgaagcactctctttgaccctgcttgagattttagaaaaacagtttaaatcataa

SEQ ID NO: 13452 - protein, 286 aa, Wolinella succinogenes
MNLESVMEGFERFLEEEAPLFEGFHPHYNEYLWEMVRNGGKRFRPRLLLGVVSALAPLLVKSAYAPALALEILHTYSLIHDDLPAMDNAATRRGHPTLHVKYDEASAVLAGDALNTHAFYLLAQAPLGSDTKVALVRELASAGGAGGMVLGQALDCYFEHQKLEIEKLRFIHLHKTGRLIAASLKMGAIIAALSKEEQARLEEIGLKLGLLFQVQDDIIDATWSEEEAGKTTQNDGAKNSYVNLLGLEGARMEHARLKEEVRVLLGFFPEALSLTLLEILEKQFKS

SEQ ID NO: 13453 - DNA, 918 bp, Photorhabdus luminescens
  CDS (1)..(918)
atgtctgaacaaaattcaacccaatttaaagaacagcttaaaatctgtcaacaacgagtcaataacgttctgataagcacactatcttcagtggcatttgcaaacaacccactagttcatgcaatgcaacatggtactttactcggtggtaaacgcctgcgcccatttttagtttatgccgttggtgaaatgtttggattatccgcaaataatctggatgctccagcagcagccgttgaatgtatccacgccttttcattaattcatgacgatttaccggcgatggataacgatgatttacgccgtggacaaccaacctgccacataaaatttggtgaagctcacgcgattctagcgggagatgcattacaggctctggcgtttgaaatcctatctaaaagagaaatgccggatgttacaacagcagatcgccttgaaatggttgctgaattggcaaccgccagtggtatagccggtatgtgtggtggccaagccctagacttggccgctgaaggcagacacattgatctccatatgctggaacaaattcatcgccataaaacaggtgcgcttattcgttgcgccgtcagaatgggcgcatatggtgcaggccaaagtgggcatgacgccctgcctgaattggatcaatatgcccaagcgattggtctcgcattccaagttcaggacgatattcttgatgtcattggcgataccgaaatgataggaaaacgtcaaggcagtgaccaacagctaggaaaaagcacttaccccgcattactagggttagaacaagcacagaaaaaagcatacgaactgtatcaagaagccttaaaagctttgaataaactggaagataaatcctataacacaacaatgctgcgcgcacttgccagctttattattgaacgtaataactaa

SEQ ID NO: 13454 - protein, 305 aa, Photorhabdus luminescens
MSEQNSTQFKEQLKICQQRVNNVLISTLSSVAFANNPLVHAMQHGTLLGGKRLRPFLVYAVGEMFGLSANNLDAPAAAVECIHAFSLIHDDLPAMDNDDLRRGQPTCHIKFGEAHAILAGDALQALAFEILSKREMPDVTTADRLEMVAELATASGIAGMCGGQALDLAAEGRHIDLHMLEQIHRHKTGALIRCAVRMGAYGAGQSGHDALPELDQYAQAIGLAFQVQDDILDVIGDTEMIGKRQGSDQQLGKSTYPALLGLEQAQKKAYELYQEALKALNKLEDKSYNTTMLRALASFIIERNN

SEQ ID NO: 13455 - DNA, 897 bp, Vibrio vulnificus
  CDS (1)..(897)
atggataactctatgattgacgtccttgcgtcttttcagcagcgtaacaaccaacaactcaatctttggctcgataaactgccacaccaaaatcaagcgctgatccaagcgatgcgctatggattagtgctaggtggaaaacgtgctcgcccttttttagtgtatgccaccggtgagatgcttggttgcagccaagagcagctcgacacacctgcgtcagcgattgagtgtatccatgcttactctcttatccatgatgatctgccagccatggatgatgatgaactgcgccgtggccaaccgacctgccatgttaaatttgacgaagccaccgccattttaaccggtgatgctttacaaacgctcgcattcaccattctcgctgaaggtacattgtctcctgatggggaaacacagcgcgttgccatgatccaagcattggcgcaagcctctggagcgcaaggcatgtgcattggtcaggcgttggatttggctgcggaaaaccgcgcagtcacgctggaagagttagaagagattcaccgtaacaaaaccggcgctttgatccgttgtgcggtacgcttaggtgccttagcagcaggcgaaaaaggtttggcgattttgcctcagttggagaagttctccacggcgattgggttagcgttccaggtacaagatgacattttagatatcattagcgataccgaaacgctcgggaagccacaaggttctgaccaagaactcaacaagagtacctacccatcgctgctgggtttagaaggcgcaatggagaaagctcacactctgttacatgaagcacttcaagctttggaagcaatcccatacaatacccaacacttagaagagttcgcccgatacgtcgtcgagcgcaagaactaa

SEQ ID NO: 13456 - protein, 298 aa, Vibrio vulnificus
MDNSMIDVLASFQQRNNQQLNLWLDKLPHQNQALIQAMRYGLVLGGKRARPFLVYATGEMLGCSQEQLDTPASAIECIHAYSLIHDDLPAMDDDELRRGQPTCHVKFDEATAILTGDALQTLAFTILAEGTLSPDGETQRVAMIQALAQASGAQGMCIGQALDLAAENRAVTLEELEEIHRNKTGALIRCAVRLGALAAGEKGLAILPQLEKFSTAIGLAFQVQDDILDIISDTETLGKPQGSDQELNKSTYPSLLGLEGAMEKAHTLLHEALQALEAIPYNTQHLEEFARYVVERKN

SEQ ID NO: 13457 - DNA, 921 bp, Vibrio vulnificus
  CDS (1)..(921)
atgaaacaattcaagcccaactcaattaatgatgtctctttaatcaatcaacttggtttttatatcatcagtggtggtggcaaacgtcttcgccctcttttggccgtgctttcagcgcgagcgttaggctatcagggtaatgctcacacaaccgcagccgctttcatcgagtttattcataccgcaaccttgctgcacgatgatgtggtggatgagtctgatatgcgtcgtggcaaagccaccgctaacgctgcatttggcaacgctgccagcgttttggttggcgacttcatctacacacgctcctttcagatgatgacagagctaggatccatgaagatcctgaagctcatgagcgatgccgttaacatcattgcagaaggggaagtattgcagttaatgaactgtaacgatcccgataccactgaagaaagctacatgcaggtgatctactctaagaccgcacgcctgtttgaagccgcaacgcagattggggccatactcaatgatgctcccgcggaagtcgaaaccgcactgcaaaattatggcaagtatctcggtaccgcgtttcagttgatcgatgatgtgatggattacacctcagatggcgaagaaatgggtaaaaacgttggggatgatctcgctgaaggcaaacctactctgcccttgttacatgccatgcgtcataccaatgcagaaaacgcgcagatgatccgcgaagcgatcgagaatgccaatgggatggaacgtctagatgacattctggctgtaatgcaacaagcaggttcgttgacctatactgaagcaaaagcaatggaagaagccgataaggccatcgcggaattacaggtattacctgagtctgaatacaagcaagcattgattgcacttgcacatatggcggtcaagcgcagcaaatag

SEQ ID NO: 13458 - protein, 306 aa, Vibrio vulnificus
MKQFKPNSINDVSLINQLGFYIISGGGKRLRPLLAVLSARALGYQGNAHTTAAAFIEFIHTATLLHDDVVDESDMRRGKATANAAFGNAASVLVGDFIYTRSFQMMTELGSMKILKLMSDAVNIIAEGEVLQLMNCNDPDTTEESYMQVIYSKTARLFEAATQIGAILNDAPAEVETALQNYGKYLGTAFQLIDDVMDYTSDGEEMGKNVGDDLAEGKPTLPLLHAMRHTNAENAQMIREAIENANGMERLDDILAVMQQAGSLTYTEAKAMEEADKAIAELQVLPESEYKQALIALAHMAVKRSK

SEQ ID NO: 13459 - DNA, 978 bp, Porphyromonas gingivalis
  CDS (1)..(978)
atgcatactttcgaagacctgagagaaataatcgaacaggagatagcatcacaaccctatgatcagagaaaacccgacggcctcttccaacctatatcctatattttgaggctcggaggcaagcgtgtccgccctaccctcgcatgtatagcctgcgagatgttcggtggtgattataagccggccctcgaagtggctatggctattgaaacttaccataacttcaccttgctgcatgacgatctcatggacaaatcttccatgagaagaggtaaagaaaccgttcatcatcggtggggggataatacagccattctctccggcgatgccatgacagttgccgcctacgagcatctggccaaagtggatagtcggctactgcctgtccttttgcccttgttcaatcgtatggctatggagatttgccaaggacaacagtacgacatggacttcgaacggcgggactttgttgccgaggacgagtacctggagatgattcgtttgaagacagcagttctcttggctacagcccttaagatgggggctatagccggaggagcggatattgagaaagcagatattctctatcgctacggcatacatatcggcttgtctttccaattggaggacgacctcctcgatgtatatggcgatcccattatcctcggcaagaaaatcggcgatgatatagcttgtaataaaaagacgatgcttctgatcaaagcccttgagatggctcagggagaggaattgaatctcctcagagaatcccttttgatgccggatgtgcagtgtgaagaaaagatccgagctgtgacaggtatttataatcgtctggggattcgtccgatcgtggaagatctgatcgattatcacaacggtttggccgaaaaggctcttgacgaattgggtcttgatgagatcacaaccaagcctttgagagaactgatcggtactctccgtaacagaaaatcataa

SEQ ID NO: 13460 - protein, 325 aa, Porphyromonas gingivalis
MHTFEDLREIIEQEIASQPYDQRKPDGLFQPISYILRLGGKRVRPTLACIACEMFGGDYKPALEVAMAIETYHNFTLLHDDLMDKSSMRRGKETVHHRWGDNTAILSGDAMTVAAYEHLAKVDSRLLPVLLPLFNRMAMEICQGQQYDMDFERRDFVAEDEYLEMIRLKTAVLLATALKMGAIAGGADIEKADILYRYGIHIGLSFQLEDDLLDVYGDPIILGKKIGDDIACNKKTMLLIKALEMAQGEELNLLRESLLMPDVQCEEKIRAVTGIYNRLGIRPIVEDLIDYHNGLAEKALDELGLDEITTKPLRELIGTLRNRKS

SEQ ID NO: 13461 - DNA, 972 bp, Photorhabdus luminescens
  CDS (1)..(972)
atgaatttagaaaccattatcaagctaaccgctgatgatatggcagcggtaaatgaaaccattcttagtcagttgaattctgacgttactcttatcaatcagttgggctactacataatcagtggtggtggaaaacgcattcgcccaatcattgccatcctggctagcagagtattgggttatcagggtgataagcatattactgttgctgcattaattgaatttatccacacagcgactctgttacatgatgatgtagtagatgaatcagacatgcgacgtggcaaagcgactgccaatgccatgtttggtaatgcagcaagcgtgctggttggtgactttatatacacacgctctttccagatgatgacagcgcttaactccatgcgagtgcttaaattaatgtcagaggcaaccaatgttatcgctgaaggcgaagttttacagttgatgaactgcaatgatccaaatatttctgaagatgattatatgcgggtgatttacagtaaaacagcccggctgtttgaagtcgccgcgcactcttccgcaattctttctaacgccaccccagagcaagaaatggctttacaaaattacggacgttatttaggcactgcattccagttaattgatgatttgctggattataatgctgatagcgatacattaggcaaaaacactggtgatgatcttaacgaaggtaaaccgacattgcccttgctacacgctatgaatcatggcactccagaacaatcagcacttatccgtgaagcaattgaaaagggtaatggccgtcatttactcgaaaccgtactgacaaccatgaaacagtgcggttcactggaatatacccgtaaacgagcagaggaagaagcagataaagcaatagctgctttgcaggcgctggaaaactccccatacaagcaagcactcgtggggttagcccatatcgccgtacaacgcctttcttaa

SEQ ID NO: 13462 - protein, 323 aa, Photorhabdus luminescens
MNLETIIKLTADDMAAVNETILSQLNSDVTLINQLGYYIISGGGKRIRPIIAILASRVLGYQGDKHITVAALIEFIHTATLLHDDVVDESDMRRGKATANAMFGNAASVLVGDFIYTRSFQMMTALNSMRVLKLMSEATNVIAEGEVLQLMNCNDPNISEDDYMRVIYSKTARLFEVAAHSSAILSNATPEQEMALQNYGRYLGTAFQLIDDLLDYNADSDTLGKNTGDDLNEGKPTLPLLHAMNHGTPEQSALIREAIEKGNGRHLLETVLTTMKQCGSLEYTRKRAEEEADKAIAALQALENSPYKQALVGLAHIAVQRLS

SEQ ID NO: 13463 - DNA, 903 bp, Photorhabdus luminescens
  CDS (1)..(903)
atgaacgtcagtactgcacgagctatgaattacgaagagacattactggagctacagagtgcactacaacaacacctagaactggtacttccttcaggagccccagatgataaagtctgcgcagccatgcgagaaagtacactggtgtctggaaaacgtatccgccccctcttattgctactcatagtcctggatcttggagaaaacccctggaagactgactttctacagctggcatctgcaattgaaatagtgcatgccgcctcattaattttagacgatcttccctgtatggataatgcggagtatcggcgcggacgcccggctattcatcggcagtatggtgaaagtgtagcgatcctagcggctgtagccttgctgagccgggcttttggcctcattgtagaaacaaacctttctgaatacgataaatctgctgctgtcgccatactttcccatacagtgggtttaaacggtcttgtccaagggcagtttcgcgatctgaacaatacattatgtgctggtaattatcatgccattgctaccaccaacgatttaaaaacgggtttgcttttcgacacaacatttcagttagcggcaattgctgtgaatgcacctgatataattcgccaggcattgcgtcatgtatcacaacatctggggcaagcgtttcaattactggatgacttgagcgatgacctgaataatacagggaaagatatgtatcaggataaggaaaagttaacaatggttacgctgctcggaaaatctaaagtgcataaacaattacgcaggcacatcagatacattgataaatatttggcaatagtgtatcgcagaaatttagcttcacgatattttatacgacactggtttgataaaaatattgcgatgtttaattaa

SEQ ID NO: 13464 - protein, 300 aa, Photorhabdus luminescens
MNVSTARAMNYEETLLELQSALQQHLELVLPSGAPDDKVCAAMRESTLVSGKRIRPLLLLLIVLDLGENPWKTDFLQLASAIEIVHAASLILDDLPCMDNAEYRRGRPAIHRQYGESVAILAAVALLSRAFGLIVETNLSEYDKSAAVAILSHTVGLNGLVQGQFRDLNNTLCAGNYHAIATTNDLKTGLLFDTTFQLAAIAVNAPDIIRQALRHVSQHLGQAFQLLDDLSDDLNNTGKDMYQDKEKLTMVTLLGKSKVHKQLRRHIRYIDKYLAIVYRRNLASRYFIRHWFDKNIAMFN

SEQ ID NO: 13465 - DNA, 888 bp, Gloeobacter violaceus
  CDS (1)..(888)
atgtcacagttcgacctcgacgcttacctgcgccagtgccgctcgcaggtggaagccgccctcgaccgctatttgccccagcagtacccggacaagctctacgaagcgatgcgctattcgctgctggcgggaggcaagcgcctgcggccgattttgtgcctgaccagctgccggatgtccggcggcagtgcggatttggcgatgcccaccgcctgcgccttggagatggtgcacaccatgtcgctcatccacgacgacctgcccgccatggacgacgacgactaccgccggggcaagctcaccaaccacaaagtctacggcgaggacatggccatcctggcgggcgacgccctgctcgcctacgcctttcaactgatcgccgagaaaaccgtgggggcgcagcccgagcgcgtcgtcgaggtgctcggccgtctgggcaaagcggcgagcggcgccggtctggtgggaggccaggtggtcgatctcgaatcggaaggccggacaatcaccctcgaaaccctcgaatacatccacacccacaagaccggtgccttgctcgaggtctcggtgatctccggcgccatcctggccggggccgacggcggggtcgtcgagcggttgacccgctacagccgctgcatcggactggccttccaaatccgcgacgatctgctcgacatcaccgccacccaggctgaactgggcaagaccgccggtaaggacttgcgcgaccgcaaggcgacctacccgagcctgctgggctacgacggcgcgcgcgaccgcgccgagcagttgcgggagcaggcggtggcggaactggcggattttggggcatcggcgcgaccgctgaccgcccttgccgaatttatcgtgcaacggcgccattaa

SEQ ID NO: 13466 - protein, 295 aa, Gloeobacter violaceus
MSQFDLDAYLRQCRSQVEAALDRYLPQQYPDKLYEAMRYSLLAGGKRLRPILCLTSCRMSGGSADLAMPTACALEMVHTMSLIHDDLPAMDDDDYRRGKLTNHKVYGEDMAILAGDALLAYAFQLIAEKTVGAQPERVVEVLGRLGKAASGAGLVGGQVVDLESEGRTITLETLEYIHTHKTGALLEVSVISGAILAGADGGVVERLTRYSRCIGLAFQIRDDLLDITATQAELGKTAGKDLRDRKATYPSLLGYDGARDRAEQLREQAVAELADFGASARPLTALAEFIVQRRH

SEQ ID NO: 13467 - DNA, 897 bp, Chromobacterium violaceum
  CDS (1)..(897)
atggccaatgaaagcttcatcggctggatgacctccatccagcaatacatggaacaggcgctggaaaagttgctgccgtcggctgactgcgccccgcaacggctccatgaagcgatgcgctacgcgacgctggagggcggcaagcgcgtgcgcccgctgctggtgttcgccgccggcgagctggtcggcgcgcaagcggacaatctggcccgcatcggcgcggcgctggaaatggtccatgcttactcgctggtccacgacgacatgccctgcatggacaacgacgtgctgcgccgcggcaagcccacctgtcacatcgcctacgatgacgccaccgcgctcctggtcggcgacgcgctgcagacccgcgccttcgagctgatctcccagcccatgccggacatcgcgccggccagccagctggaaatggtccgcgcgctggcccacgccgccggccacgccggcatggcgggcggccaggcgatagacctggccagcgtcggcctgccgctgacgctgccggagctggaattcatgcacatgctgaagaccggcgcgctgatccgcgccgcggtgttggcgggttccatggcgggccgcgagctgtccgccgcagagaaggaggcgctcgacgccttcgccaagcgcatcggcctggccttccaggtggtggacgacattctggactgcgaggcggacaccgcgacgctgggcaagaccgccggcaaggacgccgccaacgacaaacccacctacgtcagcctgctgggcctcgccgaagccaagcggatggcgaaggatttgcacgaccaggccttcgccgcgctggagggcttcggcccgcaggccgaccgcctgaaacaactggccgactacatcgtcgcccgctcgttttga

SEQ ID NO: 13468 - protein, 298 aa, Chromobacterium violaceum
MANESFIGWMTSIQQYMEQALEKLLPSADCAPQRLHEAMRYATLEGGKRVRPLLVFAAGELVGAQADNLARIGAALEMVHAYSLVHDDMPCMDNDVLRRGKPTCHIAYDDATALLVGDALQTRAFELISQPMPDIAPASQLEMVRALAHAAGHAGMAGGQAIDLASVGLPLTLPELEFMHMLKTGALIRAAVLAGSMAGRELSAAEKEALDAFAKRIGLAFQVVDDILDCEADTATLGKTAGKDAANDKPTYVSLLGLAEAKRMAKDLHDQAFAALEGFGPQADRLKQLADYIVARSF

SEQ ID NO: 13469 - DNA, 930 bp, Chromobacterium violaceum
  CDS (1)..(930)
atgcagacggtagacggcgtgatccgcgcccgcctgcactccgacgtcgtcctgatccgccaggtggcggaatacatcatctccgccgggggcaagcgcctgcgccccatcctgaccctgctgtcgggccgcgcgctgggctaccggggcgagcacctgtttgaactcgccgcgatgatagagttcattcacaccgccaccctgctgcacgacgacgtggtggacgaatcagacctgcgccgcggccgcaagaccgccaacgcactgttcggcaacgccgccagcgtgctggtgggcgacttcctctacacccgcgccttccagatgatggtcaccacccgcaacatgaccatcctggaagtgatggccgaggcgaccaacatcatcgccgagggcgaagtgctgcaattgctgaacatcggcaacaccgacgtcagcgaagacgaatacctgaaggtcatccagtacaagaccgccaagctgttcgaagccgccgcccgcgtcggcgcgctgatcgccgacgcctccgccgagcaggtgcgggcgatggccgactacggcatgtacctgggcaccgccttccagatcatcgacgacgtgctggactacagcggcgacgccgacaccataggcaagagcctgggcgacgacctggccgaaggcaaacccacgctgccgctgatctacaccatgcgcaacggcagttcggaagcctccgccctggtgcgcgacgcgctggaaaacgccaaccgcgaccgtttccacgatgtgctgaatgcggtacaatcctgcggcgcgctggaatatgccaagaacgaagccgtgaaaatggccgaacaggccatcgcctccttgcagagcattcccgattcggaagtccgccaggctctcatcgagctggcccgcctgtcagtggaccgcagcgcctga

SEQ ID NO: 13470 - protein, 309 aa, Chromobacterium violaceum
MQTVDGVIRARLHSDVVLIRQVAEYIISAGGKRLRPILTLLSGRALGYRGEHLFELAAMIEFIHTATLLHDDVVDESDLRRGRKTANALFGNAASVLVGDFLYTRAFQMMVTTRNMTILEVMAEATNIIAEGEVLQLLNIGNTDVSEDEYLKVIQYKTAKLFEAAARVGALIADASAEQVRAMADYGMYLGTAFQIIDDVLDYSGDADTIGKSLGDDLAEGKPTLPLIYTMRNGSSEASALVRDALENANRDRFHDVLNAVQSCGALEYAKNEAVKMAEQAIASLQSIPDSEVRQALIELARLSVDRSA

SEQ ID NO: 13471 - DNA, 894 bp, Fusobacterium nucleatum subsp
  CDS (1)..(894)
atgaatgatttccaagtttatttaaaagaaaaaactgatttttttgaaactgaattgaaaagagaactaaaagagctttcttatcctgaaactattgctaagggtatggaatatgcaaccttaaatggtggaaagaggttaagaccttttttactttttgcaacattggaattattaaatgagaatataaaaaaaggtgtaaaatctgcaatagcattagagatgatacattcatattctcttgttcatgatgatttgccagctcttgacaatgatgattacagaagaggtaaattaacaacacataaagtttttggtgaagcagagggaatacttattggagattcacttttaacttatgctttttatgttctttctcaaaaaaatttagagttattatcttctgaacagattgtgaatatcatttcaaaaacttctgaatatgcaggaataaatggaatgataggtggacagatgatagatattgaaagtgaaaataaaaaaataggtttggaaactttaaaatatatccatagccataaaacaggaaaacttattaaactacctattgaaatagcttgtatcattgctgatttggaaaaagataaaagaaaagttttagaagaatatgcagatttaattggtttagcttttcaagttaaagatgatattttagatgttgaaggaacttttgaagaattaggaaaacctgtgggtagtgatgttgatttacataaagctacttatccaagtattttaggaatggaagaaagtaaaaaaattctaaatgatactgttgaaaaagctaaggagattattaaaaataaatttagagatgaaaaaggaaaagttttaatttctcttgcagattttataaaagatagaaataaataa

SEQ ID NO: 13472 - protein, 297 aa, Fusobacterium nucleatum subsp
MNDFQVYLKEKTDFFETELKRELKELSYPETIAKGMEYATLNGGKRLRPFLLFATLELLNENIKKGVKSAIALEMIHSYSLVHDDLPALDNDDYRRGKLTTHKVFGEAEGILIGDSLLTYAFYVLSQKNLELLSSEQIVNIISKTSEYAGINGMIGGQMIDIESENKKIGLETLKYIHSHKTGKLIKLPIEIACIIADLEKDKRKVLEEYADLIGLAFQVKDDILDVEGTFEELGKPVGSDVDLHKATYPSILGMEESKKILNDTVEKAKEIIKNKFRDEKGKVLISLADFIKDRNK

SEQ ID NO: 13473 - DNA, 930 bp, Synechococcus sp
  CDS (1)..(930)
atgaccgtcgcggcgacttctcccgacaacacttctggcctggccgacatctttgatttcaaggcctatctcgccaaagccaaggcgacggtggagcaagccttggatcagtccttggtgccggagcggccggagtcgctgcgtgaagccatgcgctactcactgctggcaggaggaaagcgtctgcggccaatcctctgcctggccgcctgcgagctggcgggtggggatgctgcccaggccatgccaacggcagtggcgctggagatgattcacaccatgtcgttgatccatgacgaccttccggccatggatgacgacgacctgcggcgtggacgccccacaaaccacaaggtctatggcgaggctgttgcgatccttgccggtgacgcattgctgacccgtgcctttgagatggtggcgctgcgtagtcctggggttccgcccgaacggctgctcaaggtggtgggagagctgtcgttggtggcgggggcccctggcctggtgggcggtcaggtggttgatctggaaagcgagggcaaggaggttgatcttgaaaccctcgagtacatccacctccacaaaaccggcgcgttgttgagcgcctgtgtgatcaccggcgcgatgatcggtggcgctgatgatgagctgattgctgcgttacgggtctacgcccgggggatcggcctggcgttccagatcattgacgacatcctggacatcacggccagcagcgaggtgcttgggaaaacagccggtaaggacctgatcgctgacaaaacgacgtatcccaaacttctcgggctcgaggaatcccgcaaacgggccgctgatctggtgcaggaggccaaaggggtgctcaagccatgggcaagcaaagcccaaccgctgctggccctggcggattacatcaccagccgtgatcgatga

SEQ ID NO: 13474 - protein, 309 aa, Synechococcus sp
MTVAATSPDNTSGLADIFDFKAYLAKAKATVEQALDQSLVPERPESLREAMRYSLLAGGKRLRPILCLAACELAGGDAAQAMPTAVALEMIHTMSLIHDDLPAMDDDDLRRGRPTNHKVYGEAVAILAGDALLTRAFEMVALRSPGVPPERLLKVVGELSLVAGAPGLVGGQVVDLESEGKEVDLETLEYIHLHKTGALLSACVITGAMIGGADDELIAALRVYARGIGLAFQIIDDILDITASSEVLGKTAGKDLIADKTTYPKLLGLEESRKRAADLVQEAKGVLKPWASKAQPLLALADYITSRDR

SEQ ID NO: 13475 - DNA, 1194 bp, Rhodopirellula baltica
  CDS (1)..(1194)
atgccctgtcgcctgatgattggcggttttctgtttttgtctagtttcactggtcgcgtcatggatcggtctgtggtccctccgtcttcgaaatccaccgtctctaagcgaacggccgattctgactcatccgttgcctcttcggatgcagtctccagtgcgcatggcacgagcggggaagtcagtccgcttcgatcgatctacgcaccgattgtggaatctttggccgccgtcgacgctcgtctgcatcgcgaattgcaatctcgctacgaagcgctggtgccagttctgcgtcacggaacacagttgggcggaaagcgtctgcgtccggcgttgctgttgctttcgggggccgcgatgcacgccgatcggacgtcgaaaaaccctttgacgactgaagaattggctacgaccgaagatcacatcgtgatggcgacggttgtcgaaatggttcacaccgcgacgctgatccatgatgatgttttggacaaagcagcaacgcgtcgacatgtccccacgatcaatgctcgttggaacgacgacaccagcattttgctgggcgattatctgttcgctcagagtttctatcttgccgcgacgctgccgtcgacgctggcatgtcgtttggttggccaagcggcccagaaggtttgcgaaggcgaactgcgtcaagttctcggacgcgattggctggatatcgatgaagaaacctatctcgacatcattcgcggtaaaacggccgagttgactcgcgtatcatgtcagattggtgcggatctcagtggcggcgatgagagccaagtcgaagcgtttgctcggtttggcaacgatctgggcatcgccttccaaatcgcggacgattttctcgacttgtggggtgacgacgacgacgtgggcaaaacgttgggaaccgatctgcagcagggtaaaatcacgctgccgttgatcaggctgctgcgtcatgaagacaccacggtcgcgaccgctgcgttggatgcgttgcgtttgtcgccggaagatcggctcgcgcgagtgatgccgttgctgcgaaagagcgatgcggcagaatacacgcgaaaggttgccgagtcctatcgtcggagtgccattgaagcgatcagcggattcgctccttcgtcagccttggaatcattgaagacgatcgctgatttcgcggtcgatcgccggttctag

SEQ ID NO: 13476 - protein, 397 aa, Rhodopirellula baltica
MPCRLMIGGFLFLSSFTGRVMDRSVVPPSSKSTVSKRTADSDSSVASSDAVSSAHGTSGEVSPLRSIYAPIVESLAAVDARLHRELQSRYEALVPVLRHGTQLGGKRLRPALLLLSGAAMHADRTSKNPLTTEELATTEDHIVMATVVEMVHTATLIHDDVLDKAATRRHVPTINARWNDDTSILLGDYLFAQSFYLAATLPSTLACRLVGQAAQKVCEGELRQVLGRDWLDIDEETYLDIIRGKTAELTRVSCQIGADLSGGDESQVEAFARFGNDLGIAFQIADDFLDLWGDDDDVGKTLGTDLQQGKITLPLIRLLRHEDTTVATAALDALRLSPEDRLARVMPLLRKSDAAEYTRKVAESYRRSAIEAISGFAPSSALESLKTIADFAVDRRF

SEQ ID NO: 13477 - DNA, 954 bp, Rhodopirellula baltica
  CDS (1)..(954)
atgagcgtgcaagcgtcgggggatcgtcgtgaacaaccgatcgattccaatgaatcattgaaggactacatggacgctcgccgaccggcggtggaagcggcattgcaagctgcgtgcgaagaccggccgggtgtccccgagcgtctggccgcggcgattcgatacgcggtactggcgcccggcaaacggctccgtccgatgctgacgatcatggccgcggaagcttgcggtggcgatgcggaatcggcaatgccgtcggctgtcgcggtcgaaatgattcatgcttattcgttgattcacgatgacttgccagcgatggatgacgacgatttgcggcgtggtcgaccgacgacgcacatcgaattcgacgaagcgacggcaatcttggctggcgatgccctgcaatcgatggcatttgctcacctgcaccacagcacatcggacgccaccaaatcagccgctctgatcggcacattggcgaccgccgccggaccggccgggttggtcgggggccaagcggacgacttggatgccgagaagtacaccgtcgaggacttcgggggggcggatgctgccctcaaacacctcgaagcaatccaccaccgcaaaacgggggctctgtttacagcctgtgcggcgatgggcgcaatttccgccggagcggatactaatgctgtttcggccttgaccgattacgctaaagcgtttggactcgcgtttcaaatcacggatgatttacttgattgcacgtccacggatgagcgacttggtaaacgaacgggcaaagacgacggccgtggcaagctgacttacccggggttgatgggtctggaccgggcgagagcccacgcggaaagcaccatccacatggcgcacgaatcgttgcagttgttcggaacagctggccagcggttaagaaaactggcggactttgtcttggagcgtacgaattga

SEQ ID NO: 13478 - protein, 317 aa, Rhodopirellula baltica
MSVQASGDRREQPIDSNESLKDYMDARRPAVEAALQAACEDRPGVPERLAAAIRYAVLAPGKRLRPMLTIMAAEACGGDAESAMPSAVAVEMIHAYSLIHDDLPAMDDDDLRRGRPTTHIEFDEATAILAGDALQSMAFAHLHHSTSDATKSAALIGTLATAAGPAGLVGGQADDLDAEKYTVEDFGGADAALKHLEAIHHRKTGALFTACAAMGAISAGADTNAVSALTDYAKAFGLAFQITDDLLDCTSTDERLGKRTGKDDGRGKLTYPGLMGLDRARAHAESTIHMAHESLQLFGTAGQRLRKLADFVLERTN

SEQ ID NO: 13479 - DNA, 903 bp, Prochlorococcus marinus subsp
  CDS (1)..(903)
atgacagaagttataaataatattccagattttgaaaaatatctaacagacacaaaaaaagtcgtcgaagaagctcttgatttctcattaggccccgagaacccagaaatccttagggaatcaatgagatattctctcctggctggaggaaaaaggatacgtccaattttatgtctagcttcttgttcactagcaggaggtgaaccctctctagcagttcctacagcagttgccatagaaatgattcataccatgtcattgattcatgatgatttacctgcgatggacaatgacggctttagaagaggaagacctactaatcataaagtttacggcgatgcaatagctattctggctggtgatgcattactaacgagagcctttgaaatggtctcattaagaagccctggcgttgattccaatagattattaaatgtagttggagaactttcccttgtagcaggagcacccggactagttggtggtcaagttgttgatttggaatgcgaaggtaaagaagttgacctcgaaacccttgaatatatacatcttcataagaccggtgcattattaaaagcctctgtcagaactggagcaatgattgcaggagctaatgaagaattattaaatgccctaactacttatgcagagggtattggtttagcattccaaataatagatgacatccttgatttaacttcaagtagtgagaaacttggtaaaacagcaggtaaagatcttttagcagataaaactacttatcccaaattacttgggatggaagaatcaaagaaaaaagctttcgatttagtggaccaagctaagaaagcaattgagccttggggtttaaatgcaaaatatttaatctccttagctgatttcattacaaatagagataggtaa

SEQ ID NO: 13480 - protein, 300 aa, Prochlorococcus marinus subsp
MTEVINNIPDFEKYLTDTKKVVEEALDFSLGPENPEILRESMRYSLLAGGKRIRPILCLASCSLAGGEPSLAVPTAVAIEMIHTMSLIHDDLPAMDNDGFRRGRPTNHKVYGDAIAILAGDALLTRAFEMVSLRSPGVDSNRLLNVVGELSLVAGAPGLVGGQVVDLECEGKEVDLETLEYIHLHKTGALLKASVRTGAMIAGANEELLNALTTYAEGIGLAFQIIDDILDLTSSSEKLGKTAGKDLLADKTTYPKLLGMEESKKKAFDLVDQAKKAIEPWGLNAKYLISLADFITNRDR

SEQ ID NO: 13481 - DNA, 921 bp, Prochlorococcus marinus
  CDS (1)..(921)
atgaacgagacaaggttcatggcggcggcggtcagcaccttcttcgacttccctgcttatttggctgcggccaaagccagcgttgaagaggcattggatgattcgcttggccctgagcgccctgagcaactcagggaggccatgcgctactcccttttggcgggtggtaagcgtttacgccccatcctttgcctagcagcttgcgaacttgctggaggtgaaccggcagaggctctgccgacagcagtggctttggaaatgattcacacgatgtcgctgattcatgacgatctccccgccatggataacgacgatttacgccgcggtcgtcccaccaatcacaaggtttatggcgatgctgttgccattctcgcgggtgatgcgctgcttacacgttctttcgagatggttgccttgcgcagtccgggagtacccccagagcggctgttgaaggttgttggcgagctttctctcgttgctggtgctcctggtttggtgggggggcaggttgtggatctggagtgtgagggcaaagaggtggatctggagactttggagttcattcatctccataagaccggggccttgttgagtgcttgtgtgatctgcggagcattgattggtggagcagaagacgatttgattgatgcactacgcatctatgcgagagggattggtttggcgtttcagatcattgatgacatccttgatgtgacagcgagcagtgatgttcttggcaaaactgctggcaaggatctgcttgctgataagaccacctatcccaaattgttgggtttagacgaatcccgccggcgagcagaactccttgtgagcgaagccaaggcagcactagagccttggcaagcttctgctgcacctttgctggcactagccgattacatcaccagccgcgatcgatga

SEQ ID NO: 13482 - protein, 306 aa, Prochlorococcus marinus
MNETRFMAAAVSTFFDFPAYLAAAKASVEEALDDSLGPERPEQLREAMRYSLLAGGKRLRPILCLAACELAGGEPAEALPTAVALEMIHTMSLIHDDLPAMDNDDLRRGRPTNHKVYGDAVAILAGDALLTRSFEMVALRSPGVPPERLLKVVGELSLVAGAPGLVGGQVVDLECEGKEVDLETLEFIHLHKTGALLSACVICGALIGGAEDDLIDALRIYARGIGLAFQIIDDILDVTASSDVLGKTAGKDLLADKTTYPKLLGLDESRRRAELLVSEAKAALEPWQASAAPLLALADYITSRDR

SEQ ID NO: 13483 - DNA, 903 bp, Prochlorococcus marinus
  CDS (1)..(903)
atggcggaagcagtcatgtttccttttgactttaccgcttatctggctaaggctagaacaagaattgagtctgcattagatgcttccttaggtccagaacgacctaatcaacttagagaagcaatgcgatattcccttcttgctggtggcaaaagactaagaccaattctttgtttagcagcctgcgaattaacaggttctgattctgagaatgcaatctcaacagcagtagcaattgagatgattcatacaatgtcattaattcatgatgacttgccatctatggataatgatgatttgcgtagaggtcgtcctactaatcacaaagtatatggagaagctatagcaatccttgctggggacgcacttttaacaagagcttttgaaatggttgcgcttcgaagtccaaatgtgccgaaggatcgtttactaaaagtagtaggcgaactctctttggtagcaggtgctccaggtttagtcggaggacaagtcgaagatcttgaaagtgaagggaaggcagtcgatcttgatactctggaattcattcatattcataaaacaggagccctacttaaagcatccgttgtatgtggagctctaattggaggagcagatgaagacttgcttatagctcttagtacttatgccaaaggaataggcttagcctttcagatagtagatgatatccttgatgttacagcgagtagtgaagtcttagggaaaacagctggtaaggatctattggctgataaatctacttatccaaagctgcttggcttggatgaatcacgcaaaaaagctaaggaactaattagaaaatccaaagacgttatacatccttggagtgataaggctgccccgcttttatctttagcggattacattattaatagagatagatga

SEQ ID NO: 13484 - protein, 300 aa, Prochlorococcus marinus
MAEAVMFPFDFTAYLAKARTRIESALDASLGPERPNQLREAMRYSLLAGGKRLRPILCLAACELTGSDSENAISTAVAIEMIHTMSLIHDDLPSMDNDDLRRGRPTNHKVYGEAIAILAGDALLTRAFEMVALRSPNVPKDRLLKVVGELSLVAGAPGLVGGQVEDLESEGKAVDLDTLEFIHIHKTGALLKASVVCGALIGGADEDLLIALSTYAKGIGLAFQIVDDILDVTASSEVLGKTAGKDLLADKSTYPKLLGLDESRKKAKELIRKSKDVIHPWSDKAAPLLSLADYIINRDR

SEQ ID NO: 13485 - DNA, 867 bp, Helicobacter hepaticus
  CDS (1)..(867)
atgagtatttcacagattcttaatgattttgaatcctttcttatcagtcaagcacctcagattccaagttttcacccacattatgaacaagctgtgtgggaaatgatgaaaaatggtggcaaaagattccgccctgcacttgtattttgtgtagttaatgctcttgctcctcaactgattaaaaatgcttttttacctgctctaagcattgaatgtatccatacttattcgcttatacacgatgatttgccttgtatggataatgcacctttaaggcgtggacacgctacattgcacacaaaatatgacgaaacacttgcgcttttagtaggtgatggactaaacacctatgcttttgctttgctttctcaagcacgacttgacgcgcaagtgcgcttagagcttatccattctcttgcactcaatgctggtattggtggtatggtgcttggacaaatgcttgattgtgcttttgaggataaaaaactttcattacaagaacttcaaattatacacacaaacaaaactgctaaactcattgctacttctttgcaatttggtgctattatttcaaatgcaaaagcacattttgcttcatcaatttatgagtttgggctaaagcttggcatatattttcagctgcgtgatgatcttattgatgcctgttttgatgcacaacaagcaggtaaaacgacacacaatgatatacataaaaatagttatgtgaatctacttggcttagaaggtgcaaaagtggaatttactcgtatgaaagagcagattcaaaaagaactccaaacatttgatgaagccatttatgttcatttgactactcttttgcaagattatttcaaggatattgaatga

SEQ ID NO: 13486 - protein, 288 aa, Helicobacter hepaticus
MSISQILNDFESFLISQAPQIPSFHPHYEQAVWEMMKNGGKRFRPALVFCVVNALAPQLIKNAFLPALSIECIHTYSLIHDDLPCMDNAPLRRGHATLHTKYDETLALLVGDGLNTYAFALLSQARLDAQVRLELIHSLALNAGIGGMVLGQMLDCAFEDKKLSLQELQIIHTNKTAKLIATSLQFGAIISNAKAHFASSIYEFGLKLGIYFQLRDDLIDACFDAQQAGKTTHNDIHKNSYVNLLGLEGAKVEFTRMKEQIQKELQTFDEAIYVHLTTLLQDYFKDIE

SEQ ID NO: 13487 - DNA, 927 bp, Haemophilus ducreyi
  CDS (1)..(927)
atgaacaagccgaacttgcagattacgaataatatgacttactcactcacaaccgatcttaatgctatccaacaacggatcaaccatttcctaagcaaccaactgccacaatcgccaaccgaacaaccaccgcttaatcaagcgatggcctatgccgtattactaggtggcaaacgcatacgcccttttctaatgtacaccaccggcaaaatgctaggcgtcccattaactacactcgaccactcagcggctgcaattgaagccattcacgcttactcactagtacacgacgatctccctgcaatggacaatgaccaactacgccgcggcaaaccgacttgccacatagcctttgacgaagccaccgccatcttagccggcaatgccttacaagcgctagcatttgagctaattgctaacgccccacacctaaccgactggcaaaaagtccaacaaatcagaacgctaagcaccgcagcaggcgctaaaggcatgtgtctcggccaaaatttagatctactcgccgaaaataaatcgctcaacttaaccgaattagaacaaattcaccgccacaaaaccggcgcattaatagtagcctccgtattaatggcagttaacttatctgatcacgcacaaaataatgcaataaaacaaccgcttgaacgctacgcacaagcaattgggctcgcctttcaagtgcaagacgatatcctagacgttatcggccaaaccgacaaaatcggcaaaacagtcggcgcagatcaacaactacacaaaagcacctaccccaaattacttgggctaacacaagcaaaacaaaaagcacaagacttacaccaaacagcactcaacgcactcgcagaactgccgtttaaaagcactgcattaaaagagttagccgactttattattcatcgcgaaaattaa

SEQ ID NO: 13488 - protein, 308 aa, Haemophilus ducreyi
MNKPNLQITNNMTYSLTTDLNAIQQRINHFLSNQLPQSPTEQPPLNQAMAYAVLLGGKRIRPFLMYTTGKMLGVPLTTLDHSAAAIEAIHAYSLVHDDLPAMDNDQLRRGKPTCHIAFDEATAILAGNALQALAFELIANAPHLTDWQKVQQIRTLSTAAGAKGMCLGQNLDLLAENKSLNLTELEQIHRHKTGALIVASVLMAVNLSDHAQNNAIKQPLERYAQAIGLAFQVQDDILDVIGQTDKIGKTVGADQQLHKSTYPKLLGLTQAKQKAQDLHQTALNALAELPFKSTALKELADFIIHREN

SEQ ID NO: 13489 - DNA, 912 bp, Bordetella pertussis
  CDS (1)..(912)
atgaagcaaagtcatctcgcctgcgccgactggctgcgggaacgcgcgcagcatgtcgagcacgtgctcgacgaattgctgcctggcgccgatatcgctcccacgcggctgcacgaagccatgcgctatgcggtgctgggcggcggcaagcgggtgcgcgcggccctggtctacgcggccgggcaggcctgccccgtcaacggcagcacgctggccgtcggggcgtcgatggaccgcgccgccgcggccgtcgagctgatccacgcctattcgctggtgcacgacgacctgccgtgcatggacgacgacacgctgcgccgcggccggcccacggtgcatgtgcaattcgacgaggccacggccatgctggccggcgatgccctgcagcctctggccttcgaactgctggccggcatgccgatcgcgcccgcgctggtggtgcaggccgcccaggtcctggcgcgcgccgccggcagccagggcatggccggcgggcaggccatcgacctgcacagcgtgggccgcatgctcacgcgcgacgaactgcagaccatgcacagcatgaagaccggcgccatgctggcgtgcagcgtgacgctgggaggcatcgtggccggcgccagctcgaccgcgcgccaggcgctcgacagctacgcgcaggcgatcggcctggcgttccaggtcgtcgacgatatcctcgatgtgacggccgacaccgccagcctgggcaagacggccggcaaggatgcggccgacaacaagccgacctatgtatccttgctgggcctggagcaggcccgcgcgctggcgcaggagttgcgccaggcggcccaccaggctctggcgccgctgggcgagtccggcgcgcggctgggccaactggcagatttcatcgtactcagagaccgctga

SEQ ID NO: 13490 - protein, 303 aa, Bordetella pertussis
MKQSHLACADWLRERAQHVEHVLDELLPGADIAPTRLHEAMRYAVLGGGKRVRAALVYAAGQACPVNGSTLAVGASMDRAAAAVELIHAYSLVHDDLPCMDDDTLRRGRPTVHVQFDEATAMLAGDALQPLAFELLAGMPIAPALVVQAAQVLARAAGSQGMAGGQAIDLHSVGRMLTRDELQTMHSMKTGAMLACSVTLGGIVAGASSTARQALDSYAQAIGLAFQVVDDILDVTADTASLGKTAGKDAADNKPTYVSLLGLEQARALAQELRQAAHQALAPLGESGARLGQLADFIVLRDR

SEQ ID NO: 13491 - DNA, 966 bp, Bordetella pertussis
  CDS (1)..(966)
atgaatctccctgagttgattgcccctattgccgacgacatgaaggctgtcgacacggtcatccgcgaccggctgaattccgatgtcgtgctgatccgcaccatcggcgactacatcatcggcgccggcggcaagcgcatgcggcccgccatggtgctgatggtggcgcgcgcgctcggctaccagggcacgcaccaccagttgctggccgcggtcgtcgagttcatccacaccgccacgctgctgcatgacgacgtggtcgacgagtcggacctgcgccgtggccgcgacacggccaacgccgtgttcggcaacgccgccagcgtgctggtgggcgattacctgtattcgcgttcgttcgagatgatggtcgaggccgactcgatgcgcatcatgcagatcctgtcgcaggccaccacggtgatcgccgaaggcgaggtgctgcagctgctcaacgtgcacgaccccgatgtgtcgcaggagcgctacctgcaggtggtgcgctacaagaccgccaagctgttcgaggccgcagcccaggtcggcgcggtgctggctggcgccagccccgagcaggagaccgccgcggccgcctatgggcgccacgtcggcaccgccttccagctggtcgacgacgtgctggactacagcggcgatgcccacgccttgggcaagaacgtgggcgacgacctgcgcgagggcaagcccacgctgcccctgatccgcgtcatggagacgggcacgcccgagcagcgcgagctgatccgcgaggcgatcaagaccggccaggccgacttcgccgcggtggcccaggccatccaggccaccgacgccctggcgcatgcgcgccaggccgccgaaaacgaggccgaacttgcccgacaggcgctgtcggccttcccggtttccctttatcaaaaatctctgctagaattctgcgctttcgcggtgaatagagatcgttga

SEQ ID NO: 13492 - protein, 321 aa, Bordetella pertussis
MNLPELIAPIADDMKAVDTVIRDRLNSDVVLIRTIGDYIIGAGGKRMRPAMVLMVARALGYQGTHHQLLAAVVEFIHTATLLHDDVVDESDLRRGRDTANAVFGNAASVLVGDYLYSRSFEMMVEADSMRIMQILSQATTVIAEGEVLQLLNVHDPDVSQERYLQVVRYKTAKLFEAAAQVGAVLAGASPEQETAAAAYGRHVGTAFQLVDDVLDYSGDAHALGKNVGDDLREGKPTLPLIRVMETGTPEQRELIREAIKTGQADFAAVAQAIQATDALAHARQAAENEAELARQALSAFPVSLYQKSLLEFCAFAVNRDR

SEQ ID NO: 13493 - DNA, 867 bp, Thiocapsa roseopersicina
  CDS (1)..(867)
atggatccaaccacgcgaatcgagcaagcactggcggcagccttggagtcggtgacgacgtcggcctgcccgcccaggcttgccgaggcggttcgccatgccgtcttcccgggcggagcgcgcgtgcgaccgcggctctgtttggccgtcgctgcggcgtgcggcagccgcgatgtcgaggctgccgatgccgccggcgcctccatcgagctgctccactgcgcgtccctggtccatgacgatctgccttgtttcgacgactccccgctgcgtcgaggtctgccctcggtccatcgggcctacggcgagccgctcgccgtgttggccggcgatgccctgatcgtcctcgccttcgaaaatttggcccgcgtcttgggcaacagcccggagcgtctggcgccactcctgatgaccgtcagccgagctgtcgggatgccgtccggcatcgtcgccggtcaggcttgggagtgtgagcccaaggtctccgtcgcagactatcaccgggcgaagacaggcgcgctctttgccgctgcaaccgccgccggtgctcaagtggccggggccgatgccgatgcctggcgtgtggtcggcgacaagatcggcgaagcctaccaggtcgcggatgatctgcgcgacgtcgccgccagtgcccaagaggtcggcaagccggtcgggcgcgatgcggtactcaatcgcccgagcgctgcaggcgagctcggggtggacggcgcggtcgctctgcttcgcggtctggtcaagggcgccatcgatgcgatcccgccatgtccgggctccgcgcaacttgcagaggtcctgatgtcggaatcgcgacatattatgccgaagggcctcgccgatcgcgcttaa

SEQ ID NO: 13494 - protein, 288 aa, Thiocapsa roseopersicina
MDPTTRIEQALAAALESVTTSACPPRLAEAVRHAVFPGGARVRPRLCLAVAAACGSRDVEAADAAGASIELLHCASLVHDDLPCFDDSPLRRGLPSVHRAYGEPLAVLAGDALIVLAFENLARVLGNSPERLAPLLMTVSRAVGMPSGIVAGQAWECEPKVSVADYHRAKTGALFAAATAAGAQVAGADADAWRVVGDKIGEAYQVADDLRDVAASAQEVGKPVGRDAVLNRPSAAGELGVDGAVALLRGLVKGAIDAIPPCPGSAQLAEVLMSESRHIMPKGLADRA

SEQ ID NO: 13495 - DNA, 1541 bp, Oryza sativa
  CDS (174)..(1274)
gagtggaacggagccaccgcccaactcgcccccaaagttgcccatctagataagaagaagcgtcgcaactcacggtcgcagtgccacgccccacttcatatcctttccctcccccaactgaacgaaaaaaacaacagagaaaaactcctccctcctcctccccctctgaagccatggctgccttccccccgctcgccgcctcccgcgtccgcatctcccctctcatccccgccgccgcgatggctgggacagcaggggcggcggcggcgtcgtacgcgcagcaccggcggaggttctgcgccatcgtggcgaccgcggcggcgtcaccggtgccggccgcggcggcggcggcggcgacggggtttgattttaacgcgtatatgggtgagaaggctgcggcggtgaaccgggcgctggacgcgtcgatcccggcggacgagccgcccgcggcgctccacgaggcgatgcggtacgcgctgctggcgggcgggaagcgggtgcggcccgcgctgtgcctggcggcgtgcgcggtggtcggggggcgggaggcctgggcgatgcccgccgccgctgccgtcgagatggtgcacaccatgtcgctcgtccacgacgacctcccctgcatggacgacgacgacctccgccgcgggaagcccacctgccacgtcgtctacggggagcccatcgccgtgctcaccggcgacgcgctgctctccctctccttccaccacatggccaggttcgactcctaccctccggacatcgacgctgacaagcaccccgcccgcgtcgtccgcgccattggcgagctcgcgcgctgcataggctccgagggcctagtcgccggccaggttgttgatcttgagatgactggatcgaccgaaactgtacctcttgaacgtcttgagtacatccatctccacaaaactgctgcattgcttgaggcatcagtggttattggggcaatcttgggaggtggctctgatgagcagattgaaagtttgcgcatgtatgcgagatcgataggattgttgttccaggttgttgatgatatacttgatgtgaccaagtcttctgaggagctcggcaagacagcagggaaggacttggcgagtgacaagacgacatacccgaaattacttgggctggagaaatcacgggagtttgcagaaaagttgctttctgatgcaagggaacaactttcaggatttgatcaagagaccgcagcaccacttctgcacctggccaattatattgcctatcggcagaactgaggtgatgggtactccattgattattgttgatttgtaactttgtaagctcattaagattcagatttgaggaatatctgaattatcttgtgatacgtgctagttgtagtttcttatcttgagaagaatatctggttgacaaatgtcaatttcctagttagtcagtcaaaacggaataatgaaaatcagcctctctgccctataccccaattgcttgattcttgacaattgaacacatcatatcataaaggaagaaaatattttatcttc

SEQ ID NO: 13496 - protein, 366 aa, Oryza sativa
MAAFPPLAASRVRISPLIPAAAMAGTAGAAAASYAQHRRRFCAIVATAAASPVPAAAAAAATGFDFNAYMGEKAAAVNRALDASIPADEPPAALHEAMRYALLAGGKRVRPALCLAACAVVGGREAWAMPAAAAVEMVHTMSLVHDDLPCMDDDDLRRGKPTCHVVYGEPIAVLTGDALLSLSFHHMARFDSYPPDIDADKHPARVVRAIGELARCIGSEGLVAGQVVDLEMTGSTETVPLERLEYIHLHKTAALLEASVVIGAILGGGSDEQIESLRMYARSIGLLFQVVDDILDVTKSSEELGKTAGKDLASDKTTYPKLLGLEKSREFAEKLLSDAREQLSGFDQETAAPLLHLANYIAYRQN

SEQ ID NO: 13497 - DNA, 891 bp, Bacillus cereus
  CDS (1)..(891)
atgacgattgcttttgatacttttttgaaagaaagtaaaactttcgtagaagaaaaacttgtaagctatgcaaatggattacaatgtccaaatgtacttcgtgaagcgatggcatattctttggaagcgggtggaaaacgtctccgcccgttacttttgtttgcaacattacaagcgtttgggaaagaaagaaatcttggagtaggtgcagcttgtgctcttgaaatgattcatacatattcgttagttcatgatgatttaccttgtatggatgatgatgatttaagaagaggaaagcccacaaatcacaaggtatttggtgaagcgatggcagttttagcaggagatggcttattgacatacgcttttcaagttattatggcatatgagcaaaaagaaatttctgctgaaaaaaaagtaagacttgtacttgaactcgcaaaagcagcaggaccagaaggaatggttggcggacaagtggcagatatggaagcggaagggaaacgccttacgattgatgaattggagtacatccataaacataaggccggaaaactacttgaatttgctgtacttgcgggtgcgatactttctgatgcgacagaagagcaagaagaaaagttgcttacgtttgccaaatatatcggtctagctttccaaattcgagatgatattttagatgtcgaaggaactgaagaagagattggaaaaccgattggtagcgatctttctaatgaaaagagcacatatacgacgttgtttactgtagatagagcaaaggatattttagaagaaacaattgcagaagcaaaaggtgcgattagctccttgcaattacaagatgaatatttactatctatttgcgatttgattgcaaaacgtaataactaa

SEQ ID NO: 13498 - protein, 296 aa, Bacillus cereus
MTIAFDTFLKESKTFVEEKLVSYANGLQCPNVLREAMAYSLEAGGKRLRPLLLFATLQAFGKERNLGVGAACALEMIHTYSLVHDDLPCMDDDDLRRGKPTNHKVFGEAMAVLAGDGLLTYAFQVIMAYEQKEISAEKKVRLVLELAKAAGPEGMVGGQVADMEAEGKRLTIDELEYIHKHKAGKLLEFAVLAGAILSDATEEQEEKLLTFAKYIGLAFQIRDDILDVEGTEEEIGKPIGSDLSNEKSTYTTLFTVDRAKDILEETIAEAKGAISSLQLQDEYLLSICDLIAKRNN

SEQ ID NO: 13499 - DNA, 891 bp, Bacillus anthracis
  CDS (1)..(891)
atgacaattgcttttgatacttttttaaaagaaagtaaaacttttgtagaagagaagcttgtaagctatgcaaatgaattacaatgtccaaatgtacttcgtgaagcgatggcatattctttggaagcgggtggaaagcgtctccgcccgttacttttatttgcaacattacaagcgtttgataaagaaagaaatcttggagtaggtgcagcttgtgctcttgaaatgatacatacatactcgttagttcatgatgatttaccttgtatggatgatgatgatttaagaagaggaaagcccacaaatcataaagtatttggtgaagcgatggcagttttagcaggtgatggtttattaacgtatgcttttcaagttattatggcatatggacaaaaggaaatctctgctgagaaaaaagtaagacttgtacttgagcttgcaaaagcggcagggccagagggaatggttggcggacaagtggcagatatggaagcggaagggaaacagcttacgatcgatgagctagagtatattcataagcataagactgggaaactacttgaattcgctgtacttgcaggatcgatactttctgatgccacagaagaacaagaagaaaaattacttgagtttgcaaaatatatcggcttagctttccaaattcgagatgatattttagatgtggaaggaaccgaagaagagattggaaaaccgattggtagtgatgtttccaacgaaaagagcacatatacaacgttgtttactgtagatagagcaaaggatattttagatgaaactattgcaaaagcaaaagatgctattggttccttgcaattacaagatgaatatttactatctatttgcgatttgattgcaaaacgtaataactaa

SEQ ID NO: 13500 - protein, 296 aa, Bacillus anthracis
MTIAFDTFLKESKTFVEEKLVSYANELQCPNVLREAMAYSLEAGGKRLRPLLLFATLQAFDKERNLGVGAACALEMIHTYSLVHDDLPCMDDDDLRRGKPTNHKVFGEAMAVLAGDGLLTYAFQVIMAYGQKEISAEKKVRLVLELAKAAGPEGMVGGQVADMEAEGKQLTIDELEYIHKHKTGKLLEFAVLAGSILSDATEEQEEKLLEFAKYIGLAFQIRDDILDVEGTEEEIGKPIGSDVSNEKSTYTTLFTVDRAKDILDETIAKAKDAIGSLQLQDEYLLSICDLIAKRNN

SEQ ID NO: 13501 - DNA, 963 bp, Bacillus anthracis
  CDS (1)..(963)
atgaagttacaacttatgtactcttttttacgatcggatattaatgtgatagaaaaagaattaaaaaagacagttgcttctgaacagccattagtagaagaggcggcattacaacttattgaagctggtgggaagcgaattcgtcctgtatttgtgttgcttgcggggaaatttggagattataagttagatgcaattaagcatgtagctgttgcgttagaacttattcatatggcttctcttgttcacgatgatgttattgatgctgcgtttttacgacgtggtagtgcaactgtgaatgcgaaatggggagatcgtattgcaatgtatacaggggactatttattcgctaagtctcttgaatgtataacgaatattgaaattccagaggcgcatcaggcgctatcgcataccattttagaagtttgtaaaggtgaaatcgaacaaataaaagataagtataactatgaccaaaatttaagaacatatttaagaagaataaagcgaaaaaccgctttattaattgctgcaagttgccaactaggagcgattgctgctggcgctaatcgtgatacggtaagtcgtctgttttggtatggctatttcgtagggatgtcgtatcaaattattgatgacattttagacttcgtttctacagaagagaaacttggaaaacctgctggtggtgatttattgcaaggaaacattacgcttcctgccctatatgctatggaagatccaatcctttgtaagaaaatcagatctgtacatgaaaatacaacagcggacgaaatgaaagaaattattgaagctgtaaagaatagtgctgctattgataaagcatttgcgtttagtgaacgttatttacataaagcattagaaatgataaaaccactcccacgtggacaagcgaagtatgcattacaaaatgtagcaaagtatattggaaaacgaaaattttag

SEQ ID NO: 13502 - protein, 320 aa, Bacillus anthracis
MKLQLMYSFLRSDINVIEKELKKTVASEQPLVEEAALQLIEAGGKRIRPVFVLLAGKFGDYKLDAIKHVAVALELIHMASLVHDDVIDAAFLRRGSATVNAKWGDRIAMYTGDYLFAKSLECITNIEIPEAHQALSHTILEVCKGEIEQIKDKYNYDQNLRTYLRRIKRKTALLIAASCQLGAIAAGANRDTVSRLFWYGYFVGMSYQIIDDILDFVSTEEKLGKPAGGDLLQGNITLPALYAMEDPILCKKIRSVHENTTADEMKEIIEAVKNSAAIDKAFAFSERYLHKALEMIKPLPRGQAKYALQNVAKYIGKRKF

SEQ ID NO: 13503 - DNA, 882 bp, Chlamydophila caviae
  CDS (1)..(882)
atggtcgttatgaacatgttcgaaacttatcgaataatgatagaagctggtattgagtcctctttagaagaatttggttctaaagggttatcggtacgcgcacctgtagagtatgctctaacaagcggcggaaaacgcattcgtcctatgttagtttgtatgattgctaaaggtctggatatgagcagagatgttttagacgccgccttagctatagaatttatacatacatctactttaatagctgatgatcttccttgtatggatgatgatgacgagcgtcgtggacgccctacagtacataaagcttttgatgaggcttcagctttattagcatcttatgctttgattcctgctgcatattctcgcattcgtttaaatgcgaaaaaactcaaatctcagggtgtagatcctaaagaagtcgatattgcttacgatatcatttctgatgttacggataagaattttggtgttaacggagttttgggaggacagtatgaagatatgttctttaaaaatgacggtcctgagtatgtccaatctatcatcaataaaaaaacaggcgctcttttcgaaatagcgtgtgtctctggttggttatttggaggcggtgatcctttatgcgttcctcaaataatcgaattttctcaaacttttggtcttctttttcaaatgaaagatgatattttagacatccaccaagacggtcaagatgtggggctaaattacgctttgttatttggtttagacgctgctaaagatcttttaaactcttctatggataagtgcatgatcttattaaagcatcttaaacaacatgggttgaaggacacttcagaattagaaatgcttatagaatatatgggtattcgagattattaa

SEQ ID NO: 13504 - protein, 293 aa, Chlamydophila caviae
MVVMNMFETYRIMIEAGIESSLEEFGSKGLSVRAPVEYALTSGGKRIRPMLVCMIAKGLDMSRDVLDAALAIEFIHTSTLIADDLPCMDDDDERRGRPTVHKAFDEASALLASYALIPAAYSRIRLNAKKLKSQGVDPKEVDIAYDIISDVTDKNFGVNGVLGGQYEDMFFKNDGPEYVQSIINKKTGALFEIACVSGWLFGGGDPLCVPQIIEFSQTFGLLFQMKDDILDIHQDGQDVGLNYALLFGLDAAKDLLNSSMDKCMILLKHLKQHGLKDTSELEMLIEYMGIRDY

SEQ ID NO: 13505 - DNA, 1011 bp, Streptomyces avermitilis
  CDS (1)..(1011)
atgaccgtcgtcgggccgttcgggctgagcgtgcgggaccaggctctcgaagccgatgtccaggccgggttggcggctgtcgaggagggtttgctcgaagccaccaagagcgaggtcccgttcatcacggaggccgcgcagcatctcgtgcgcgcgggcgggaagcggttcaggccgctgctcgtgatgctcgccgcgcggttcggtgatccgtacgcgccggggctcgtgccctcggccgtggtggtggaactgacccacctcgccacgctgtaccacgacgacgtcatggacgaggcggacgtgcgacgcggggtccccagcgcgaacgcccgctggggcaactcggtcgcggtcctcaccggcgacttcctcttcgcccgcgcctcgcacatcctcgccgacctcggcccggaggcggtgcgcgtccaggcggaggcgttcgagcggctggtgaccgggcagatcctggagaccgctgggccgatggacggccgcgaccccgtggagcactacctggaggtgctgagcggcaagaccggggcgctggtggcggtggcgtgccggttcggggcgatgatgtccggggccgacgagacggtcgtggacgtgctcacgcagtacggggagcggctgggcgtggccttccagctcgccgacgacgtgctcgacatcgcctccgactcgcacgagtccgggaagacgcccggcacggatctgcgcgaaggcattccgacgctgccggtgctgcggctgcgggagcgggtggcccggctcgggctggccgaggacatcgccctgtgcgagctgctggactccgacctgacggacgacgcgcggcacgcggaggcgctgacccggctgcgggcgcaccccgcgctggagcaggcccgcaaggacaccgtgcggtacgtggaggacgcgcgggccgccctggcgccgctggcggagtgcaacgcgaaggccgcgctgatcgagctgtgcgacgcggtggtgcaccgggccgggtga

SEQ ID NO: 13506 - protein, 336 aa, Streptomyces avermitilis
MTVVGPFGLSVRDQALEADVQAGLAAVEEGLLEATKSEVPFITEAAQHLVRAGGKRFRPLLVMLAARFGDPYAPGLVPSAVVVELTHLATLYHDDVMDEADVRRGVPSANARWGNSVAVLTGDFLFARASHILADLGPEAVRVQAEAFERLVTGQILETAGPMDGRDPVEHYLEVLSGKTGALVAVACRFGAMMSGADETVVDVLTQYGERLGVAFQLADDVLDIASDSHESGKTPGTDLREGIPTLPVLRLRERVARLGLAEDIALCELLDSDLTDDARHAEALTRLRAHPALEQARKDTVRYVEDARAALAPLAECNAKAALIELCDAVVHRAG

SEQ ID NO: 13507 - DNA, 1185 bp, Streptomyces avermitilis
  CDS (1)..(1185)
atgggtgagttcctgacggaggcgaagcagagcccggccgaggtgctcgaaaggcggagccccgcgggccccgccggccggcgaggcccgctcccggctccgtccaccgggcggcaggcgccggccgcgagtccgcccaccgatccgcagggcccggcggcccagctcgacgggcaggaagccgcggggatcctggagcgtgcccgggcctcggtcgaccccgagctgcgccgggccgtcgactcgctgccggggtccatgcgccggatcgcgctccaccacttcggctgggagcacgcggacggcaccccggcggcaggcaacgcgggcaaggcgatccgccccgcgctcgtgctggccgcggtccgggcgctcggcggaccgcagtcctccgccgttcgggccgccgcggcggtggagctgatccacaacttcaccctgctgcacgacgacgtcatggaccgggacaccacccgcaggcaccgccccaccgcgtggaccgtgttcggcgacgccgacgcgatcctcgccggggacgcacttcaggccctggcccaccggctgctcgccgaggacccgcacccggcgtccgcggcggccgccgcccggctcgcggcctgtgtcatcgaactgtgcgcggggcagcacgcggacacggcgatggagcggcgcggcccgggtgaggtcaccctcgacgagtgcctcgccatggccgaggccaagacgggcgcgctgctcggctgcgcctgtgcgctgggggcgttgtacgcgggggcggaggaggaggacgtcgaggcgctggacgcgttcggccgggaggccgggctcgccttccagctcatcgacgacgtgatcgggatctggggggacccgagccgaaccggcaagccggccggggcggacctgatggcccgcaagaagtccctgcccgtggtggccgcgctcgccgcgggcactccggcggcggcggaactcgccgagctgtacgcggttccgcaccaggaaggggagctggagcgcacggtcctggccgtcgagcgggccggcggccgcgactgggcccagcagcaggccgccgaccggatggcccgggcgatgcacgagctgtcccgggcgattccggacccggaggcggcgggcggcctgctcgccctcgccgagttcgtgacccggcgcagcaactga

SEQ ID NO: 13508 - protein, 394 aa, Streptomyces avermitilis
MGEFLTEAKQSPAEVLERRSPAGPAGRRGPLPAPSTGRQAPAASPPTDPQGPAAQLDGQEAAGILERARASVDPELRRAVDSLPGSMRRIALHHFGWEHADGTPAAGNAGKAIRPALVLAAVRALGGPQSSAVRAAAAVELIHNFTLLHDDVMDRDTTRRHRPTAWTVFGDADAILAGDALQALAHRLLAEDPHPASAAAAARLAACVIELCAGQHADTAMERRGPGEVTLDECLAMAEAKTGALLGCACALGALYAGAEEEDVEALDAFGREAGLAFQLIDDVIGIWGDPSRTGKPAGADLMARKKSLPVVAALAAGTPAAAELAELYAVPHQEGELERTVLAVERAGGRDWAQQQAADRMARAMHELSRAIPDPEAAGGLLALAEFVTRRSN

SEQ ID NO: 13509 - DNA, 1014 bp, Streptomyces avermitilis
  CDS (1)..(1014)
atgaccgtgaccccggaaagtctgcaccgcagccgcgacgcgatcacaccggcgttgcgcaccgcgctccacctgctcgacgaggagacccgccatcaggcggcgtaccacctcggctggatcgaggccgacggcaccccggcggacggcggcggaggcaaggccgtacggcccgcgctcgcgctgctgtcggcgcaggcggccggcgcaccggcggaaaccggcctgcccggtgcggtggccgtcgaactggtgcacaacttctcgttgctgcacgacgacctgatggacggcgacgaggagcgtcggcatcgacgtacggtctggacgctgtggggcgcctcgggcgcgatcctcaccggtgacgcgctgctggcgctcgcgcaggaggtgctgctcgactgcgggctgcccacgggggcggccgcggcgcggctgctcgcccgcaccacccgcgacctcatccgcgggcaggtgcaggacgtggcgttcgagcggcgggcccatgtgccgatcgaggagtgcgtcgacatggcggccggcaagaccggcgcgctgctgtcggccagcgccgcgatcggtgccgtactggccggcgcgccggtgaccaccgtcgacgccctggcgctctacgggcagcaggtgggcctcgccttccagctgaccgacgacgtcctcggcatctggggcgacccggctgtcaccggcaagtcggtccactccgacctgcgggcccgcaagaagtcgctgccggtcacgtacgcgctcaaccagggcgggaccgtgagtgtcgagctggccacctggctctccgcaccaggcgagcccgacgaggcagagctgcgccgggcggccgacctggtggcggcggccggcggccgcgactgggccaccgccgaggcggcccggcgcatggcgctcggggaggccgcgctgcgcggcgtcgacctggacgccgcggcgcgcgacgagctcatcgccctcggacacttcgtcgtcgaccgggaggtgtga

SEQ ID NO: 13510 - protein, 337 aa, Streptomyces avermitilis
MTVTPESLHRSRDAITPALRTALHLLDEETRHQAAYHLGWIEADGTPADGGGGKAVRPALALLSAQAAGAPAETGLPGAVAVELVHNFSLLHDDLMDGDEERRHRRTVWTLWGASGAILTGDALLALAQEVLLDCGLPTGAAAARLLARTTRDLIRGQVQDVAFERRAHVPIEECVDMAAGKTGALLSASAAIGAVLAGAPVTTVDALALYGQQVGLAFQLTDDVLGIWGDPAVTGKSVHSDLRARKKSLPVTYALNQGGTVSVELATWLSAPGEPDEAELRRAADLVAAAGGRDWATAEAARRMALGEAALRGVDLDAAARDELIALGHFVVDREV

SEQ ID NO: 13511 - DNA, 1131 bp, Streptomyces avermitilis
  CDS (1)..(1131)
atgacgcccgatctgcacgggactggtccccgcaccccccgtaccgcaacaagaggagagactgtgcccactgtgcccccggccgagaaggctgccgacgcggtggacgtgaccgcgctcctggagcgcggccggaccctgtccaccccggtgctgcgcgcggccgtggaccgcctggcaccgcccatggacaccgtcgccgcctaccacttcggctggatcgacgccgcgggcaaccccgcggacggtgacggcggcaaggccgtacgccccgccctcgccgtgctctccgcgcaggccgccggtgccgcccccgaggtgggcgtcccgggcgcggtcgccgtcgaactggtgcacaacttctcgctgctgcacgacgacctgatggacggcgacgaacagcgccgccaccgcgacaccgtctggaaggtgcacggccccgcccaggccatcctcgtcggcgacgccctcttcgcgctggccaacgagatcctcctggagctcggcacggtcgaggcgggccgcgccacccgccgcctcaccaccgccagccgcgccctgatcgacggccaggcgcaggacatctcctacgagcaccgcgagcgggtcaccgtcgaggagtgcctggagatggagggcaacaagaccggcgcgctgctcgcctgcgcctgctccatcggcgcggtcctcggcggcgcggacgaccgcaccgccgacaccctggagaagtacggctaccacctcggcctcgccttccaggccgtcgacgacctcctcggcatctggggcgacccggagtccaccggcaagcagacctggagcgacctgcgccagcgcaagaagtccctcccggtcgtggcggcgctcgccgcgggcggacccgcctcccggcggctcggcgaactgctcgccgaggacgccaagagcagcgacttcgagaacttctccgaagaggagttcgccgcgcgtgccgcgctcatcgaggaggcgggcggtcgcgagtggaccgcccaggaggcgcggcgccagcacacgatcgccatcgaggccctggacacgatcgagatgccccagcaggtgcgggcccagctcgtggcgctcgccgacttcgtcgtcgtacggaagagatga

SEQ ID NO: 13512 - protein, 376 aa, Streptomyces avermitilis
MTPDLHGTGPRTPRTATRGETVPTVPPAEKAADAVDVTALLERGRTLSTPVLRAAVDRLAPPMDTVAAYHFGWIDAAGNPADGDGGKAVRPALAVLSAQAAGAAPEVGVPGAVAVELVHNFSLLHDDLMDGDEQRRHRDTVWKVHGPAQAILVGDALFALANEILLELGTVEAGRATRRLTTASRALIDGQAQDISYEHRERVTVEECLEMEGNKTGALLACACSIGAVLGGADDRTADTLEKYGYHLGLAFQAVDDLLGIWGDPESTGKQTWSDLRQRKKSLPVVAALAAGGPASRRLGELLAEDAKSSDFENFSEEEFAARAALIEEAGGREWTAQEARRQHTIAIEALDTIEMPQQVRAQLVALADFVVVRKR

SEQ ID NO: 13513 - DNA, 1035 bp, Streptomyces avermitilis
  CDS (1)..(1035)
atgaccaccctgacgacggccctgaaggccggtcccgaagcgcccgccatattgcaccgctgccgtgaactggtcgccccggccctggccgaggccgtcggcgggatgcatccatggatgcgggagatggccgactacgcgctgggccgtggcgcggcgggcggcgccccggccgcgcacagtcagggcaagggcgtacggcaggcgctcgccgtgctgggggcggaggccgccggagggccggcggaagccggcgtaccggccgccgtggcggtcgaactcgtgcacaccttctcgctgttgcacgacgacatcatggacggcgacgcgatgcgccgaggccgcccggcgctgtggaaggcgtacggcacgggccccgccgtcctggcgggcgacgccctgttcgccctggccgtgcagacgctgaccaccgcgtccgcgcccggagccgcgcaccggctgagcgcggccctcggtgacctggtgcgggggcaggccgacgacctgctgttcgcccaccggccctggaccgggcccgaggcggtgagcgtcgccgagtacgaggcgatggccgagcacaagacgggatcgctgctcggctgcgctctcgcgctgggcgcccacctcgcgggtgcgccggaggagacggccgccgtgctggaccggacgggacgtcatctcggagtggcgttccagatcgtcgacgatctgctgggcatctggggtgatcccgcggtcaccggcaaacccgtccacggcgatctgcgtcaggggaagaagacctttccggttctcgccgcgctggccaccccctccggctccgcgctcgagggtctcctcacggcccgcgacgacaccgcggtggtgcgggcggcggccgttgtggaacaggcgggcgggcgctcggccgcgctgcgggaggcccgccgtcatctcaccgtggcgcacggactcctggcctccgtccagccggccccgcgtcccgccgccgacctgcgcaccctgctctccgccctcagccggcgcacgatctga

SEQ ID NO: 13514 - protein, 344 aa, Streptomyces avermitilis
MTTLTTALKAGPEAPAILHRCRELVAPALAEAVGGMHPWMREMADYALGRGAAGGAPAAHSQGKGVRQALAVLGAEAAGGPAEAGVPAAVAVELVHTFSLLHDDIMDGDAMRRGRPALWKAYGTGPAVLAGDALFALAVQTLTTASAPGAAHRLSAALGDLVRGQADDLLFAHRPWTGPEAVSVAEYEAMAEHKTGSLLGCALALGAHLAGAPEETAAVLDRTGRHLGVAFQIVDDLLGIWGDPAVTGKPVHGDLRQGKKTFPVLAALATPSGSALEGLLTARDDTAVVRAAAVVEQAGGRSAALREARRHLTVAHGLLASVQPAPRPAADLRTLLSALSRRTI

SEQ ID NO: 13515 - DNA, 894 bp, Nitrosomonas europaea
  CDS (1)..(894)
atgcatcctgatttccagtcatgggcaagcgaacagcttgctctggttgaaacctgtctggaaaaacatcttccggagaccaattgtgctccggcacgtttgcatgatgcaatgcgatattccgtgctgggcggaggtaaacgggtacgaccgctgctgtcgtttgcggccggagaattgagtggcgcagataaaacacacgccaccattgccggtgcggcagtggaactgattcatgtctactccctggtacatgatgatctgccctgcatggataacgatacactgcgacgcggcaaaccaacctgccatgtcagatatgatgaacctaccgccctgctggtgggtgacagcctgcaaagcctggcttttcagttattgacggaaactaatctgactgaagacccacatgtccaactcgaaatggttcgacatcttgcatttgcagccggatcccgaggtatggcgggcggacaggcaatagatctggacagcgtaggtaaaacactgagcctgccggaactcgaatttatgcatattcacaagaccggcgcgctgattcgggctgcagtcatactgggcgcccgctgtggcaacagactggatgagacacaattcaagctgctggatcattttgccaaatgcatggggcttgcgttccaggtaatagatgacatcctcgatacagaagccaccactgccgcgctgggtaaaacagctggaaaggatgcagaaaacaataaacccacctatgttagtatactgggcatcaaacaagcacgagaacttgcccacgagctccggcaggaggccaccggggtattgaatcagtttggatccgaggccctgcgtttgcagcaggtcactgatttcattgtacagcgtgagttttga

SEQ ID NO: 13516 - protein, 297 aa, Nitrosomonas europaea
MHPDFQSWASEQLALVETCLEKHLPETNCAPARLHDAMRYSVLGGGKRVRPLLSFAAGELSGADKTHATIAGAAVELIHVYSLVHDDLPCMDNDTLRRGKPTCHVRYDEPTALLVGDSLQSLAFQLLTETNLTEDPHVQLEMVRHLAFAAGSRGMAGGQAIDLDSVGKTLSLPELEFMHIHKTGALIRAAVILGARCGNRLDETQFKLLDHFAKCMGLAFQVIDDILDTEATTAALGKTAGKDAENNKPTYVSILGIKQARELAHELRQEATGVLNQFGSEALRLQQVTDFIVQREF

SEQ ID NO: 13517 - DNA, 882 bp, Enterococcus faecalis
  CDS (1)..(882)
atgacgaattttagtcaacagcatttaccgttggttgaaaaagtcatggtcgattttatcgcagaatatactgaaaatgagcgtttgaaagaagcaatgctctactcaatacacgcaggtggcaaacgattacgcccgctattagtgttaacaacagtggccgcttttcaaaaagagatggaaacacaagactatcaagtggctgcctctttagagatgattcatacgtattcattaattcatgatgatttaccagcaatggacgatgatgatttacgtcgtggcaaaccaaccaatcataaagtgtttggtgaagcgactgccattttagcaggggacggcttattaacaggtgcatttcagttgctttctttgagtcaattaggcttaagtgaaaaagttttactgatgcaacaactggcaaaggcagcggggaatcaaggcatggtttccggccaaatgggtgatattgaaggagaaaaagtcagcttgactttagaagagttagcggctgttcatgaaaagaaaaccggagcgctaattgaattcgccttaattgctgggggcgtattagccaatcaaacagaagaagtcattggtttactgacacagtttgcgcatcactatggcttggcttttcaaattcgtgatgacttattagatgccacaagtacagaagcagatttaggtaaaaaagtaggccgagatgaagcgttgaataaaagtacgtatccagctcttctagggattgctggcgcgaaagatgcgctaacacatcaattagcagaaggtagcgctgttttagaaaaaatcaaagcaaatgttcccaacttttcagaagaacatttagcaaacttgttaactcagttacaattgagatag

SEQ ID NO: 13518 - protein, 293 aa, Enterococcus faecalis
MTNFSQQHLPLVEKVMVDFIAEYTENERLKEAMLYSIHAGGKRLRPLLVLTTVAAFQKEMETQDYQVAASLEMIHTYSLIHDDLPAMDDDDLRRGKPTNHKVFGEATAILAGDGLLTGAFQLLSLSQLGLSEKVLLMQQLAKAAGNQGMVSGQMGDIEGEKVSLTLEELAAVHEKKTGALIEFALIAGGVLANQTEEVIGLLTQFAHHYGLAFQIRDDLLDATSTEADLGKKVGRDEALNKSTYPALLGIAGAKDALTHQLAEGSAVLEKIKANVPNFSEEHLANLLTQLQLR

SEQ ID NO: 13519 - DNA, 804 bp, Coxiella burnetii
  CDS (1)..(804)
atgaacgttatcacaatttatcaagagcgtatcaatcacaagcttggaagtatattgcctgacatcagacaaaccccccaacgtttgcacgaagcgatgacttatgcggtgatgtcgggcggcaagcggattcgtcctttattcacctacgcgactgggtttagttttgaggttgaccccgctcaaatcgacaacgcggcttgcgccattgaattaatgcattgttattcactggttcatgatgatttaccagcgatggatgatgacgattttcgtcgcggaaaaccgagctgtcataaggcctttgatgaagcgacagcgattttaacgggcgatgcgttgcagtgcttagcttttgaggttttagcacgcgacaaaaatattcgtttgattaacgtattagcgaatgcctgtggctctttgggtatggcgggcggccagcagttggatttagagtttaaaaataaagaggcgactcccgaacaaattgagatcgttcatcgcctaaaaacaggtgctttgtttagcacagccattgaattaggcgcgcttgcagcaggttgtctcgatgaaaagaggcttcaaaaattgcggaaattgggggccaccgttggtttaatttttcagtggcaagatgatctggcggatcaaacagtggaggatgaaaaaataccattgattaatcgcatcggcgttttatttaatcaagtggaaaagttattaaatgaactagaaggcaataacagctttcttcaagaactaattcattttctcaaatcctctatcaccgccgtcattcaatga

SEQ ID NO: 13520 - protein, 267 aa, Coxiella burnetii
MNVITIYQERINHKLGSILPDIRQTPQRLHEAMTYAVMSGGKRIRPLFTYATGFSFEVDPAQIDNAACAIELMHCYSLVHDDLPAMDDDDFRRGKPSCHKAFDEATAILTGDALQCLAFEVLARDKNIRLINVLANACGSLGMAGGQQLDLEFKNKEATPEQIEIVHRLKTGALFSTAIELGALAAGCLDEKRLQKLRKLGATVGLIFQWQDDLADQTVEDEKIPLINRIGVLFNQVEKLLNELEGNNSFLQELIHFLKSSITAVIQ

SEQ ID NO: 13521 - DNA, 1017 bp, Tropheryma whipplei
  CDS (1)..(1017)
atgcttgtgtcaggtatttttctgtccgatattcttgatccatctggcagtctgagtgatgatatttctcccgctctcgatagggttgaagatcttctgctagaaaccgttggtgattgtcatgaaatagtaagccatttgcttgtcagtggcggcaagcgcgcccgtccgcttttagttttgctcacatcttgtatgggttctggcattaatgatgctgttatacgtgctgccgcggggattgagttaatacacctgggctctttgtatcacgacgatgttatggataatgcgtatattcgtcatggatcgatcaccgcacatcgtctatggggtaagtctgcggctattcttgcgggtgattttttattcgccaaggcaggtgtgctcggtcttaaccttgataagcgtgcaattgcggtgcaaactgaggcatttcagaggatgatatcgggtcagctcagtgaaactttgggtatttctgacagtcttgaccctcttgaggcttatatagaagtttcgagaggaaagacaggttctttaatcgccgcatccgctcaggttggggcgattttaggtgatgccagcccatcaactcttgaacccctgagggattttggagagagcataggggttgctttccagcttgttgacgatgtgatcgatctttcgggtaaatccggcaagacccctgggagtgacatacgcgctggtgtcatgagtttgccgattctgcttttgagtaacgccgcgaaagatgacagagactctgcggttttgcttgaggaaatagagcgcgtgcggcggcatagcggcgcatgtgggagtgatgattattcgtcagagatgaacgcggttttggcgcatttgcgtaagcatgatgtgaccgcacgcactctggaaatcgcgagaacgtggggagataaggccaaacatgcgttgaaaaaacttcctgaatgtgcccctcgtgatgcacttttggcgtttgtcgaaacggttgtttctcgtgagttttag

SEQ ID NO: 13522 - protein, 338 aa, Tropheryma whipplei
MLVSGIFLSDILDPSGSLSDDISPALDRVEDLLLETVGDCHEIVSHLLVSGGKRARPLLVLLTSCMGSGINDAVIRAAAGIELIHLGSLYHDDVMDNAYIRHGSITAHRLWGKSAAILAGDFLFAKAGVLGLNLDKRAIAVQTEAFQRMISGQLSETLGISDSLDPLEAYIEVSRGKTGSLIAASAQVGAILGDASPSTLEPLRDFGESIGVAFQLVDDVIDLSGKSGKTPGSDIRAGVMSLPILLLSNAAKDDRDSAVLLEEIERVRRHSGACGSDDYSSEMNAVLAHLRKHDVTARTLEIARTWGDKAKHALKKLPECAPRDALLAFVETVVSREF

SEQ ID NO: 13523 - DNA, 1041 bp, Streptomyces argenteolus
  CDS (1)..(1041)
atgacggcgatcgaggtcacggccgaggggcgctcggcgcgcgaggtgctgctctggagccgtgacacggtcgagtcggcactgcgcccggcgatcgacaggctgcccccggcgatgcggcgcatcgccggctaccacttcggctggtcggacgagcgaggcgagcccgcccgggcgggtggcggcaaggcgatccgtcccgcgctggtcctgctggccgccgaggccgtggggggcgccgccgatgcggcgctgcccgcggcggtcgcggtcgagctggcgcacaatttctccctcctgcacgacgacgtgatggacggtgaccggactcgccgccaccgtcccacggcctggacggtcttcggtgtcagcccggcgatcctggcgggggacgccctgctggcgctggccttcgacgtgctcgccacggctgggcacccggccgctccggaggcgacgcggatcttcggtgccgccatccaggaactgctggaggggcagaacgcggacatggccttcgagaggcgtcaggatgtcgagctcgccgagtgcctggtcatggcggcgggcaaaaccggtgccctgctggggtgtgcctgcgcgctcggcgccctgctcggcggcggcgctccggagcaggtcgagcacctgcgcgccttcggcagggacctgggactggcgttccagctcgtcgacgatctcctgggcatctggggagatccgcaggtgaccggtaagccggtctattcggacctgcgcagccgtaagaagtctctgccgatcgtggccgcgctcacctcctcctcccctgcgggacgggagctggccggactgtaccagcgggaacgtcccctgtccgacgccgatctggttcacgccgccgaactcgtcgacgccgtgggcgggcgtgcctggagccagacgcaggccgatgagctactggcgcgcgcactgcaccacctgcggtcggccggttcggtgtctcgccccatcgccgagctgggcacgctcgcccgcctcgtcacccaccgagaccactga

SEQ ID NO: 13524 - protein, 346 aa, Streptomyces argenteolus
MTAIEVTAEGRSAREVLLWSRDTVESALRPAIDRLPPAMRRIAGYHFGWSDERGEPARAGGGKAIRPALVLLAAEAVGGAADAALPAAVAVELAHNFSLLHDDVMDGDRTRRHRPTAWTVFGVSPAILAGDALLALAFDVLATAGHPAAPEATRIFGAAIQELLEGQNADMAFERRQDVELAECLVMAAGKTGALLGCACALGALLGGGAPEQVEHLRAFGRDLGLAFQLVDDLLGIWGDPQVTGKPVYSDLRSRKKSLPIVAALTSSSPAGRELAGLYQRERPLSDADLVHAAELVDAVGGRAWSQTQADELLARALHHLRSAGSVSRPIAELGTLARLVTHRDH

SEQ ID NO: 13525 - DNA, 885 bp, Vibrio parahaemolyticus
  CDS (1)..(885)
atgcaacagacattgacgtctttccaagaaagaaacaatcagcaattgaatttgtggctagaacagcttccatatcaagagcagccattgattcaagcaatgaaatacggccttttgttaggcggcaaacgcgttcgcccatttcttgtttacatcacaggtcaaatgctcggctgtaaacctgaagatctagacactccagcttcagccatcgagtgtattcatgcctactcgctcatccatgacgatcttcctgctatggatgatgatgatctgcgccgcggtcagccaacctgccatatcaaatttgatgaagcgaccgccattttaaccggtgatgccctacaaactcttgcttttaccatcattgctgacggtccgttgagcccaagcgcagaaaaccaacgtgtcaacatgatcaaagcgttagctcactcctctggtgcgaacggcatgtgtgtcggccaagcattggatttgggtgcggagaatcgccaagtttctcttgcagaaatggaagagatacaccgtaaaaaaaccggagctctgattgattgtgcggtaaaattaggtgctctggccgctggtgaaaaaggtatcgaggttttacctcatttagaacgctattcaaaagcaattggtttggcgtttcaggttcaagacgatattcttgatatcattagtgacacagaaacattgggtaaacctcaaggttcagaccaagaactgaacaaaagcacttacccatccctgctgggtttagagggagccattgagaaagctcacactctattacaggaagcacttcaagcattggaagctatcccatacaatactcagttactcgaagagttcgcccgatacgtcatcgagcgcaaaaactaa

SEQ ID NO: 13526 - protein, 294 aa, Vibrio parahaemolyticus
MQQTLTSFQERNNQQLNLWLEQLPYQEQPLIQAMKYGLLLGGKRVRPFLVYITGQMLGCKPEDLDTPASAIECIHAYSLIHDDLPAMDDDDLRRGQPTCHIKFDEATAILTGDALQTLAFTIIADGPLSPSAENQRVNMIKALAHSSGANGMCVGQALDLGAENRQVSLAEMEEIHRKKTGALIDCAVKLGALAAGEKGIEVLPHLERYSKAIGLAFQVQDDILDIISDTETLGKPQGSDQELNKSTYPSLLGLEGAIEKAHTLLQEALQALEAIPYNTQLLEEFARYVIERKN

SEQ ID NO: 13527 - DNA, 888 bp, Pseudomonas syringae
  CDS (1)..(888)
atgatcgcgagctatcaagcgcaaagccagactcgcgtcaatgcagcactcgaaggcttgtttcaggcaccgagccctgagctgagccgcctctacgaggccatgcgttacagcgtgatgaacggtggcaaacgtgtgcgcccgctgctggcctacgccgcctgtgaagcactgggcggcgtggccgaagatgccaatggcgcggcctgtgcggtcgagctgatccatgcttactcactggtgcacgacgatttgccggcgatggacgatgacgacctgcgtcgcggccagccgaccacccataaggcgttcgatgaggcctgcgcgatcctcgccggtgacggcctgcaaagcctcgctttcaccgccttgctcgccccgcacctgagctcgcgtaacgccgcaacccgattgcagatggtcagcacactggccgctgccgcaggtccggccggaatggtgggcggacaggccatcgatctgggttcggtaggactaaagctggatcaggctgcgctggaatacatgcaccgtcacaagaccggcgcgttgatcgaagccagtgttcggctcggagccctggccagcggtcaggccgatcaggcgcggctcgatgccctgcaggtctatgcacgtgcggtcggtctggcctttcaggttcaagacgacattctcgacgtcgaaagcgataccgcgaccctcggcaagcgccagggtgccgacatcgcccgcgacaaaccgacctaccccgcactgctgggcctggacgcggccaagggctatgccctggaattgcgcgatcaggcgctcgctgcgctgagtcttttcgacaccacggcagagccgttgcgcgagttggcgcggtacatcgtcgagcgccgtcactga

SEQ ID NO: 13528 - protein, 295 aa, Pseudomonas syringae
MIASYQAQSQTRVNAALEGLFQAPSPELSRLYEAMRYSVMNGGKRVRPLLAYAACEALGGVAEDANGAACAVELIHAYSLVHDDLPAMDDDDLRRGQPTTHKAFDEACAILAGDGLQSLAFTALLAPHLSSRNAATRLQMVSTLAAAAGPAGMVGGQAIDLGSVGLKLDQAALEYMHRHKTGALIEASVRLGALASGQADQARLDALQVYARAVGLAFQVQDDILDVESDTATLGKRQGADIARDKPTYPALLGLDAAKGYALELRDQALAALSLFDTTAEPLRELARYIVERRH

SEQ ID NO: 13529 - DNA, 969 bp, Pseudomonas putida
  CDS (1)..(969)
atgcaaccccaaaccttctaccgcgcggtggctgatgatttcagcgccgtcgacgagatcatcaagaagcagctgacctcgcgcgtgccgctggtatcgaagatcggcgactatatcacgtccgccggtggcaagcgcctgcgtcccctgctggtactgctttgtggcaaggccctgggccgcgaaggcgacgacctgcgcctgctggccgccaccatcgaattcctgcacaccgccaccctgctgcacgacgacgtggtcgacatgtccggcatgcgccgtggccgctctaccgccaatgccctgtggggcaacgcgccgagcgtactggtgggcgacttcctttattcgcgctcgttcgaaatgatggtcgagctgggctcgatgccggtcatgcagatcctgtccaaggccacccgggtgattgccgaaggtgaagtgctgcaactgtcgcgcgtacgcgacgccagcaccaccgaggaagtctacatggaggtcattcgcggcaagacggcgatgctgttcgaagcttctacccacagtgctgcggcgctggcccaggccaccgacgagcagcgcgaagccctgcgtacctttggcgaccatctgggcgtggccttccagctggtcgacgacctgctggactacaagggtgactcgcagaccctgggcaagaacgtcggtgacgacctggccgagggcaaacctaccctgccgctgatctacaccatgcgcgaaggcactgccgagcaggcggcgctggtacgccaggcgatccagaagggtggcctggaagatctggaacagattcgcgttgcggtcgaagaatcgggcgcactgaaatacaccgccgagctggcgcgcgattacgtgaaacgcgccatcgcctgcctcgaagtgctgcctgccagtgaataccgggatgcgctggttgaactgagcgagtttgcggtcgcgcgtacgcactga

SEQ ID NO: 13530 - protein, 322 aa, Pseudomonas putida
MQPQTFYRAVADDFSAVDEIIKKQLTSRVPLVSKIGDYITSAGGKRLRPLLVLLCGKALGREGDDLRLLAATIEFLHTATLLHDDVVDMSGMRRGRSTANALWGNAPSVLVGDFLYSRSFEMMVELGSMPVMQILSKATRVIAEGEVLQLSRVRDASTTEEVYMEVIRGKTAMLFEASTHSAAALAQATDEQREALRTFGDHLGVAFQLVDDLLDYKGDSQTLGKNVGDDLAEGKPTLPLIYTMREGTAEQAALVRQAIQKGGLEDLEQIRVAVEESGALKYTAELARDYVKRAIACLEVLPASEYRDALVELSEFAVARTH

SEQ ID NO: 13531 - DNA, 888 bp, Pseudomonas putida
  CDS (1)..(888)
atgattggcacctaccaggccagttgccaggcgcgcgtcgacgcagccctcgaaccgctgttcatcgccccgagcaaagagctggaacgcctttacgccgccatgcgctacagcgtgatgaacggcggcaaacgcgtgcgcccgttgctggcctacgcggcctgcgaagccttgggcgccccggccgaacaggccaacggtgcagcctgcgcggtcgagctgatccatgcttactcgctggtgcatgacgacctcccggccatggacgacgacgacctgcgtcgcggccagccgaccacccacaaggcgtttgacgaagcgtgcgccatccttgctggcgacggtttgcagagcctggctttcagtgccctgctcgacccttgcctgagccctcagatcgacagcattcgcctggccatggttcaggtgctggccaaagctgccggcccggccggcatggttggcggccaggccatcgatctcggttcggtgggccagaagctggaccagcaggcgctggagttcatgcaccggcacaagaccggcgcgctgatcgaagccagcgtacgcctcggcgccctggcaagtgcccgtgccgaaccggtgcagctggatgccctgcaaacttatgcacaggccattggcctggcattccaggtgcaggacgacatcctcgacgtggaaagcgacactgctaccttgggcaaacgccaaggtgcagacatagcgcgtgacaaaccgacctacccggccctgctgggcctggaagccgccaaagcctatgcaatcgaactgcgcgaccaggcgctggccgcactgcaagggttcggcgaaaaggccgagccgctgcgggccttggcgcgttatattgtcgaacgccgtaactaa

SEQ ID NO: 13532 - protein, 295 aa, Pseudomonas putida
MIGTYQASCQARVDAALEPLFIAPSKELERLYAAMRYSVMNGGKRVRPLLAYAACEALGAPAEQANGAACAVELIHAYSLVHDDLPAMDDDDLRRGQPTTHKAFDEACAILAGDGLQSLAFSALLDPCLSPQIDSIRLAMVQVLAKAAGPAGMVGGQAIDLGSVGQKLDQQALEFMHRHKTGALIEASVRLGALASARAEPVQLDALQTYAQAIGLAFQVQDDILDVESDTATLGKRQGADIARDKPTYPALLGLEAAKAYAIELRDQALAALQGFGEKAEPLRALARYIVERRN

SEQ ID NO: 13533 - DNA, 891 bp, Lactobacillus plantarum
  CDS (1)..(891)
atgaataagcaattattaactgaatttgaatccaagtggcgtcctcagattaatcagtatttagatgagcagcttcaagcgtgttctgaccaatcaaccctgactgacgccatgcgttattcggtactagcaggtggcaaacggttacggccgttattgacgttagccattttagatacttttgatatcacaacgacggctgcaaacttgcgggcaagtgtggccgttgagttgatgcatacttattcgctaattcacgatgatttaccggcgatggataatgatcagctacgacgtggcgaaccgactaaccatgttaagtttggggaagacgttgccattcttgcaggggatgctttacaaccgttgactttcgaatggattgcggatagtgggttaccggcatcgatcgtcgctaatcaaaccttagcattagcgcaggccaccggacctcgcgggatggtggctggtcaagttgctgatgtccttggagcgggacaacatctggctttgccagccttacaacagctgcatcgcgagaagacgggggcgttaattcactacgctgtccaggcagggttgattcaagctcaagtgcaaccaaccgtgcaggaattgctattacaatatgctgatgcctatggattggcgtttcaaatttacgatgatattttagacgtgacgagtacgcctgctcagttaggaaaagctacgcataaggatgccgatgagcataagaatacgtatccaggtttgctggggcttgcaggcgcacgaacagcgttagaacaagcggtaacagctgctcaaacggcgttagtaaaagctagtgctgctagtcaacgaggcatgggcttgcttgcagcttttctaacgtattttacagattaa

SEQ ID NO: 13534 - protein, 296 aa, Lactobacillus plantarum
MNKQLLTEFESKWRPQINQYLDEQLQACSDQSTLTDAMRYSVLAGGKRLRPLLTLAILDTFDITTTAANLRASVAVELMHTYSLIHDDLPAMDNDQLRRGEPTNHVKFGEDVAILAGDALQPLTFEWIADSGLPASIVANQTLALAQATGPRGMVAGQVADVLGAGQHLALPALQQLHREKTGALIHYAVQAGLIQAQVQPTVQELLLQYADAYGLAFQIYDDILDVTSTPAQLGKATHKDADEHKNTYPGLLGLAGARTALEQAVTAAQTALVKASAASQRGMGLLAAFLTYFTD

SEQ ID NO: 13535 - DNA, 867 bp, Clostridium tetani
  CDS (1)..(867)
atgaatttaaattcatataaagatgaagtagacacatggttaaaagaatactttaaagataagggaacttataataaaagtgtgtatgaagctatgtcctatagtgtaaatatagggggaaagagaatacgacctatattagcactaattacgtataaaatatacaataaaaactacaaagaagccctttcaatagcttgtgcaatagaaatgatacacacttattcattgatacatgatgacttaccatgtatggatgatgatttaagaagaggcaagccaactaatcataaagtttttggagatggattagcagttttagcaggagatggattattaaatgaggcatttaatattatattgaaaaacggttgccaaaaaggtatgacatgggttgaagctggatacgaaataggaaaagcttccggagttgagggaatgattggaggtcaagtggtagatgttttaaatacaaacaaaagtatagaaattgaagaacttgattatatccatgaaaaaaagactgcggctttaataacagcgtctataatgacaggggcaattcttggtgaagccaatgaaaaagatacaactattttaaaggaatttggtaaaaaattaggtttggcttttcaaataaaagatgatatcttagatattgaaagtgatacaagaaagctagggaaaaccataggaaaagataaagaacaaaataaaaatacttttgttaaattttatggattagaaaaatgcaaaaaaatgtgtaaagacttaacaagtagttgcatagaattattacaaaacatgaataaagacactaaagaattagaagaaatcactttatatttgttaaatagagatttttga

SEQ ID NO: 13536 - protein, 288 aa, Clostridium tetani
MNLNSYKDEVDTWLKEYFKDKGTYNKSVYEAMSYSVNIGGKRIRPILALITYKIYNKNYKEALSIACAIEMIHTYSLIHDDLPCMDDDLRRGKPTNHKVFGDGLAVLAGDGLLNEAFNIILKNGCQKGMTWVEAGYEIGKASGVEGMIGGQVVDVLNTNKSIEIEELDYIHEKKTAALITASIMTGAILGEANEKDTTILKEFGKKLGLAFQIKDDILDIESDTRKLGKTIGKDKEQNKNTFVKFYGLEKCKKMCKDLTSSCIELLQNMNKDTKELEEITLYLLNRDF

SEQ ID NO: 13537 - DNA, 924 bp, Bradyrhizobium japonicum
  CDS (1)..(924)
atgaccggcacgtccccgtccgatttcgccaaacgtctggacaagaccgctgatgataccgaggccctgctcgggcgcctcctcgcggacgacatcctgcccgatgaaatcgcccgtcccaagcgactgatggacgcaatgcgctattcgagcctgaacggcggcaagcgcctgcggccgttcctggtggttgaaagcgcagccgtgttcggcgtgccgcgcgaggcggcgctgctcgccggtgcggcgctcgaatgcatccactgctattcgctgatccatgacgacctgccggcgatggacaattcggacctgcgccggggccggcccaccctgcacaagaagaccgacgacgcgaccgcgatcctcgccggcgacggcctgctgacgctcgccttcgatatcgtcacccgcgacgagatccatcgcgacgccaatgtacggctgctgctgacgcgcgcgctggcgcgctgcgccggcatcggcggcatggtcggtggccagattctcgacctcgcaggcgaaggccgtttcggcggcaacgagccgatcgatgtcgcccgcattcagcagatgaagaccggcgcgctgctgcgctacggctgcatcgccggcgcgattctcggccaggccacggccaaggaatatcaggcgctcgacgattacggccgcgcgctcggcgaagccttccagatcgccgacgatctgctcgacgtcgaaggcgatgccgcggcgctcggcaaaccttcgggccaggatgctgcgctcggcaagaccaccttcgtcacccagctcggcatcgaaggcgccaagcagcgcgtgcgcgacctgctcgcgcgggccgacagcgcggtctcgatcttcggcgaccgcgccgccgtgctgcaagccgccgcgcggttcgtcgccgagcgcaagaactga

SEQ ID NO: 13538 - protein, 307 aa, Bradyrhizobium japonicum
MTGTSPSDFAKRLDKTADDTEALLGRLLADDILPDEIARPKRLMDAMRYSSLNGGKRLRPFLVVESAAVFGVPREAALLAGAALECIHCYSLIHDDLPAMDNSDLRRGRPTLHKKTDDATAILAGDGLLTLAFDIVTRDEIHRDANVRLLLTRALARCAGIGGMVGGQILDLAGEGRFGGNEPIDVARIQQMKTGALLRYGCIAGAILGQATAKEYQALDDYGRALGEAFQIADDLLDVEGDAAALGKPSGQDAALGKTTFVTQLGIEGAKQRVRDLLARADSAVSIFGDRAAVLQAAARFVAERKN

SEQ ID NO: 13539 - DNA, 975 bp, Bacteroides thetaiotaomicron
  CDS (1)..(975)
atgtttacagcttctcaattacttgataaaataaacaaccacctatctgaaattcagataacccggactccggaaggactctacgaaccaatcgaatacatcctttctctgggaggaaagcggattcgtcctgtattgatgctgatggcatataacttgtataaggaagatgtttcatcaatttacgatcctgctaccggtatcgaagtttatcataatcacactttgttgcatgatgatctgatggatcgttcggatatgcgcagaggaaaaccgactgtgcataaggtctggaacgataacacagctattttgtcgggtgataccatgctgatactggctttccggtatgtagccggttgtgcgcccgagcatttgaaagaagtcattgatttgtttagtctgactgcgttggaaatttgtgaagggcagcagttggatatggaatttgagtcgcgcaacgatgtggcggaagacgaatatattgaaatgattcgtctgaaaacggctgtattgcttgccgcaagtctgaagatcggtgcgattctggcaggagcgtctgccgctgatgcggagaatctttataattttggtatgcagataggggttgcattccagttacaggatgatttgctggatgtttatggcgatccggaagtgttcggaaagaaaatcggtggagacatcctttgcaataagaagacatatatgctgatcaaagcactggaacgtgcaaacggagaacagctggaagaactgaatcgctggctgaatgcagacaactgtcagccggcagaaaagatagcggcagtgacggagatttataatcagttgactatccgcagcgtttgtgaaaacaaaatgcgcgaatattatacgctggctatggagagtcttgaagcagttgcagttgcagaagagaagaagaaagaacttaagaatttagtgaaattactgatgtatcgggaaatgtag

SEQ ID NO: 13540 - protein, 324 aa, Bacteroides thetaiotaomicron
MFTASQLLDKINNHLSEIQITRTPEGLYEPIEYILSLGGKRIRPVLMLMAYNLYKEDVSSIYDPATGIEVYHNHTLLHDDLMDRSDMRRGKPTVHKVWNDNTAILSGDTMLILAFRYVAGCAPEHLKEVIDLFSLTALEICEGQQLDMEFESRNDVAEDEYIEMIRLKTAVLLAASLKIGAILAGASAADAENLYNFGMQIGVAFQLQDDLLDVYGDPEVFGKKIGGDILCNKKTYMLIKALERANGEQLEELNRWLNADNCQPAEKIAAVTEIYNQLTIRSVCENKMREYYTLAMESLEAVAVAEEKKKELKNLVKLLMYREM

SEQ ID NO: 13541 - DNA, 882 bp, Staphylococcus epidermidis
  CDS (1)..(882)
atgaagaaactacagatgaataaattaataaatataattaatacatcactgaataagtcaatacaatcatcaccattaaaaactaatttagaagaaagtatgaaatattcattaaatgctggtggtaaaagaatcagaccagtcatattattattaacactaaaaatgcttaacaaagattatcaacaaggactaaatagtgctttagcattggaaatgattcatacttattctttaattcatgatgatttaccagcaatggataatgacgattaccgtagaggaaaattaacaaatcataaagtttatggtgaatggaaagccattcttgctggtgatgcattattaacaaaagcttttgaattagtttctaatgatactaccattgaagatagtgtgaaagtaagtattataaaaagactttcaaaagcaagtggacattggggaatggtgggtggccaagcgcttgatatggaaagtgaagggaagtcaattcgtttagaaactttagaatcaattcatgaaactaagacaggcgctttactaaatttttcagttatggctgcggtagacattgctcaagtagaacaaaatattgctaagaatttagatgaatttagtcatcatttaggaatgatgtttcaaattaaagatgatttactggatgtgtatggtgatgaatcaaaacttggcaaaaaagtaggcagtgatatagtaaatcataaaagtacttatgtttctttacttggaaaagaaggagcagaagaaaagttaaacaatcatcaatatcttgctatgaactgcttaaatcaaatttctgatcaatatgatacttctgaattaagtgatattgtagatttattctataacagagaccattaa

SEQ ID NO: 13542 - protein, 293 aa, Staphylococcus epidermidis
MKKLQMNKLINIINTSLNKSIQSSPLKTNLEESMKYSLNAGGKRIRPVILLLTLKMLNKDYQQGLNSALALEMIHTYSLIHDDLPAMDNDDYRRGKLTNHKVYGEWKAILAGDALLTKAFELVSNDTTIEDSVKVSIIKRLSKASGHWGMVGGQALDMESEGKSIRLETLESIHETKTGALLNFSVMAAVDIAQVEQNIAKNLDEFSHHLGMMFQIKDDLLDVYGDESKLGKKVGSDIVNHKSTYVSLLGKEGAEEKLNNHQYLAMNCLNQISDQYDTSELSDIVDLFYNRDH

SEQ ID NO: 13543 - DNA, 903 bp, Wigglesworthia glossinidia brevipalpis
  CDS (1)..(903)
atgaataattttttattatctttaacaaagattcagaatcatattaatttaattttaaaaaaatatttaaatattttttctaaaaaaaatatgaatttaactttagctatgaaatacgcattattaaatggcggtaagagattgagagcatttctagtatattgcataggaaaaatgcttaacgtttcttcaaataatttagattgtatagcggcttcaatagaatgcattcatgcatattcattaattcatgacgatttgccatctatggataatgatagatttcgtagaggtcgtgaatcttgtcatgtaaaatttaatgaatacatcgctatattagctggagattcattgcaatctttagcttttaatatattatctactgtaaatatgccagatgtatctgtaaataatagaatgaaaatgatttctatactttcatatgcatctggagctaaaggaatgtgtttaggacaatctttagatttagaaaatcaaggatcattgatatctattaaacaattggaagaaatttataaatacaaaacaagctttttaatttatgctgcaactagaatgacaatactatctagtaatataaaaaataaaaaaatattaataaatttaataaaatattctaaatcaataggtttagcgtttcaaattcaagatgatattttaaatgtaattggatcaaaaaaaattactggaaaatgtcaaggatcggataaaaaattaaataaaaatacttattcaagtttaattggaataaaattatctaaagaaaaagcatttaatttatataaaaaatcattatcttatttagaatatattaatgaattaggttataatactgaatcactaataaaattagcgcattatattataataagaaataagtaa

SEQ ID NO: 13544 - protein, 300 aa, Wigglesworthia glossinidia brevipalpis
MNNFLLSLTKIQNHINLILKKYLNIFSKKNMNLTLAMKYALLNGGKRLRAFLVYCIGKMLNVSSNNLDCIAASIECIHAYSLIHDDLPSMDNDRFRRGRESCHVKFNEYIAILAGDSLQSLAFNILSTVNMPDVSVNNRMKMISILSYASGAKGMCLGQSLDLENQGSLISIKQLEEIYKYKTSFLIYAATRMTILSSNIKNKKILINLIKYSKSIGLAFQIQDDILNVIGSKKITGKCQGSDKKLNKNTYSSLIGIKLSKEKAFNLYKKSLSYLEYINELGYNTESLIKLAHYIIIRNK

SEQ ID NO: 13545 - DNA, 924 bp, Synechococcus elongatus
  CDS (1)..(924)
atgatttccgctgatcccccccaagtccatcccgccggcacatttgatctcaaggcctacctcaaagaacgccaagcccttgtggaagctgcccttgaagcctcgattccggtggcctatccggagaaaatttacgatgcgatgcgctattcactgatggcggggggcaagcggctgcgcccgattctctgtttggccacctgtgaactgatggggggcaccgtggaaatggccatgccgactgcctgtgccttggagatgatccatacgatgtcgctcatccacgatgatctaccggccatggacaatgacgactaccgtcgcggcaagcccaccaatcacaaggtctatggtgaagatattgccattctggcgggggatggcttactggcctatgcctttgagtatgtggtggaacaaaccaagaatgtacccgcggagtatctgttgaaaattgtggcgcggttggggcatgcggtggcagcaacgggcttagtcggtggtcaagtggtggacttagagtgtgaaggacagcccgacattggtctggaaacgctgcattttatccactcccacaaaacgggggccctactggaggcctctgtggtgtctggggcattgctgacgggggcgcatgaatctgacgtggcacgcctgtcccgttatgcggcaaatattggcttggcattccagattgtggatgacattttggatattacttcgacccgcgatgtcctcggtaaaaccgttggtaaagatgtggctgcccaaaaaatgacctacccgcgcctgtggggtctggaaaaatctcgccaagaggctgagcgcttggtggcggaggcgaaggcagagttggctgtatatggggcggccgctgttcctttgcaggcgatcgccgactacattaccagccgtagtcattaa

SEQ ID NO: 13546 - protein, 307 aa, Synechococcus elongatus
MISADPPQVHPAGTFDLKAYLKERQALVEAALEASIPVAYPEKIYDAMRYSLMAGGKRLRPILCLATCELMGGTVEMAMPTACALEMIHTMSLIHDDLPAMDNDDYRRGKPTNHKVYGEDIAILAGDGLLAYAFEYVVEQTKNVPAEYLLKIVARLGHAVAATGLVGGQVVDLECEGQPDIGLETLHFIHSHKTGALLEASVVSGALLTGAHESDVARLSRYAANIGLAFQIVDDILDITSTRDVLGKTVGKDVAAQKMTYPRLWGLEKSRQEAERLVAEAKAELAVYGAAAVPLQAIADYITSRSH

SEQ ID NO: 13547 - DNA, 870 bp, Streptococcus mutans
  CDS (1)..(870)
atgaaagataagattaaatccattaatcaggctattaagcattattatgcgcaaactcatgtgtctcaggatttgattgaagcggtcttgtattctgttgatgcaggcggtaaacggattcgtcctctcttactattggaaatcttgcaaggctttggtttggtacttacagaagctcactatcaggtggcagcaagtctagagatgattcataccggcagcctcgttcatgatgacctgcctgctatggataatgatgattataggcggggacagctgaccaatcataagaaatttggtgaagcgacagctatcttggcaggtgacagtctttttctagacccttttggtttgctagccaaggcggacttaagggctgatatcaagataaaattagtagcagaattgtcagatgctgcaggaagctatggtatggtcggtgggcaaatgttggatattaagggtgaacatgttcaactcaatttagaccaactagctcaaattcatgccaataagacaggaaaactcttgacttttccttttgtagccgcaggaataatagcagaattatcagaaaaagcccttgctcggctccgtcaggtgggtgaattagttggtttggcttttcaagtacgtgatgatattttagatgtgacagctagtttttcagaacttggtaagaccccacaaaaggatatcgaagctgataaatcaacctatcccagtcttttgggcttggacaagtcctatgccattttggaagattctctcaatcaagcgcaagctattttccaaaaattagctttagaggaacaatttaatgctactggaattgaaacaataatagaaaggttgcgtctccatgcctaa

SEQ ID NO: 13548 - protein, 289 aa, Streptococcus mutans
MKDKIKSINQAIKHYYAQTHVSQDLIEAVLYSVDAGGKRIRPLLLLEILQGFGLVLTEAHYQVAASLEMIHTGSLVHDDLPAMDNDDYRRGQLTNHKKFGEATAILAGDSLFLDPFGLLAKADLRADIKIKLVAELSDAAGSYGMVGGQMLDIKGEHVQLNLDQLAQIHANKTGKLLTFPFVAAGIIAELSEKALARLRQVGELVGLAFQVRDDILDVTASFSELGKTPQKDIEADKSTYPSLLGLDKSYAILEDSLNQAQAIFQKLALEEQFNATGIETIIERLRLHA

SEQ ID NO: 13549 - DNA, 876 bp, Streptococcus agalactiae
  CDS (4)..(876)
atgatggttactattgaaaaaattgatgaagctattcatcgttattacaaacagacacatagtgtcgtttctcctgatttgattaaggctatcctctactcagttgatggaggtgggaaacgtattcgtccacgcatccttttagaaattttagagggatttggagttgaactaatagatggtcattatgatgtggctgctgctttggagatgattcacaccggctcattaatccatgatgatttaccggcgatggataatgatgattttcgtcgtggccgcttaacaaaccataaaaagtttgatgaagctacagcggttttagctggagattccctttttttagacccatttgatttagttgtaaaagctggttttaaagctgatgttactgttaggttaatagagttattgtctatgtctgcgggtagttttggcatggttggtggacaaatgttagatatgaagggagaaaacaaagttttatctattgacgatttaagcttgattcatattaataaaacgggacgcctgttagcttatccctttgttgcagcaggtattttagctgagaagtcggaagaagtaaaaggaaaactgcatcaagctggccttttaatcggtcatgcttttcaagtacgtgatgatattttagatgtgactgctagttttgaagaattggggaagacaccaaataaagacattgtagcagaaaagacaacttatccaaatttattgggtttggataagtcacaggaaatacttgatgatactttgaaaaaagctcaggcaatttttcaaaatctagagaaaaaagctaactttaatgctagaaaaataatagatataatagagggattacggttgaatggctag

SEQ ID NO: 13550 - protein, 290 aa, Streptococcus agalactiae
MVTIEKIDEAIHRYYKQTHSVVSPDLIKAILYSVDGGGKRIRPRILLEILEGFGVELIDGHYDVAAALEMIHTGSLIHDDLPAMDNDDFRRGRLTNHKKFDEATAVLAGDSLFLDPFDLVVKAGFKADVTVRLIELLSMSAGSFGMVGGQMLDMKGENKVLSIDDLSLIHINKTGRLLAYPFVAAGILAEKSEEVKGKLHQAGLLIGHAFQVRDDILDVTASFEELGKTPNKDIVAEKTTYPNLLGLDKSQEILDDTLKKAQAIFQNLEKKANFNARKIIDIIEGLRLNG

SEQ ID NO: 13551 - DNA, 972 bp, Shewanella oneidensis
  CDS (1)..(972)
atggatttaaacgctattcgtcaactggctgacactgatatgcaagcagtcaatcagctgatctataaacagctggagtcagatgtcgccctgattaaccagctaggtttctacattattaatggtggtggtaaacgtcttcgtcctttactgtccgtactcgctgctcgcgcagtcgactaccaaggtgaagcccacctcaaacttgccgccattatcgaatttattcataccgcctcactactgcatgatgatgtggtcgatgagtcaaccctaagacgcggccgcgaaacagcaaacgctctttttggtaacagcgccagtgtattagtcggcgacttcctttatacccgctcattccaaatgatgactgaactcgatagcatgcgcgtattacgagtattagccgataccaccaacgtattagcagaaggtgaagtattgcagctaatgaactgcaatgatccagatacgactgaagaaagctatatgcgggtgatttactgtaagaccgcgaagctattcgaagcggcgaccttacttgccgcagtattagctggcgcctcacccgagcaagaaaccgcattaggcgactatggtaagtatttaggcaccgccttccaattgaccgacgatttactcgattacaccgcggatagcgacgagttaggtaaaaacatcggtgatgaccttgctgaaggtaagccaaccttaccgctgatttatgctattgcccacggcacagaggaagaaaagcagcttatacgccaagcgattgagcaaggtgatggcactcatgccattgagaagatagttgccgcactgcatcattgcggcgccctcaactacactcagcaaaaagcaattgaagaatcaaataaagccattgcagcgctctcggtattacccgacagtgatttcaaaaccgcattaatttcgctggcaaaaatatctgttgatcgcaaccactaa

SEQ ID NO: 13552 - protein, 323 aa, Shewanella oneidensis
MDLNAIRQLADTDMQAVNQLIYKQLESDVALINQLGFYIINGGGKRLRPLLSVLAARAVDYQGEAHLKLAAIIEFIHTASLLHDDVVDESTLRRGRETANALFGNSASVLVGDFLYTRSFQMMTELDSMRVLRVLADTTNVLAEGEVLQLMNCNDPDTTEESYMRVIYCKTAKLFEAATLLAAVLAGASPEQETALGDYGKYLGTAFQLTDDLLDYTADSDELGKNIGDDLAEGKPTLPLIYAIAHGTEEEKQLIRQAIEQGDGTHAIEKIVAALHHCGALNYTQQKAIEESNKAIAALSVLPDSDFKTALISLAKISVDRNH

SEQ ID NO: 13553 - DNA, 882 bp, Shewanella oneidensis
  CDS (1)..(882)
atgttagtcaatgcaataaaagaatatcaactgcgggttgatgaccaattaaaacaacgttttagtacactcgaagatacagctcctcagttaaaagccgcgatgacccatggcgcccttttagggggaaaacgcattcgtcccttcttggtttacagtgtggggcaaatgtttggcgtaccacttgaaaaactcgatgcctgcgccgccgccattgaatgtatccatgcctattcgttaatccatgacgatttacccgccatggatgatgatgcgcttcgccggggtcaacccactgtacatatcgctttcgatgaagccaccgccatacttgctggcgatgcactgcaaaccttagcctttgaaattgtgactgaagcagtccctgggattacgagcgagcaacatatcgctatggtcagggcattggcaaaagcctcgggttatcgggggatgtgtggcggtcaagctatcgacttagcttctaccgataagcacattgatcttaaagcattaactcaactacataatatgaaaacaggggcgcttatcagctgcgccgttgagttagcgttgattgccgcgaatgcgccaaaagatcaatatcagactatgatggaatttgcccacgcggtaggacttgccttccaagtgcaagacgatattctggacattattgccaccacagaagaactcggcaaaccccaaggctccgatgccgagtcaaataagagtacttttccgcaactacttggactgcaaggcgccaaagataccgccacgcaactgatccaagaggcactatcagcgctggctaaattgccatacaatagccagttaattgcagacttcgcccgctatattattgagcgaagaatataa

SEQ ID NO: 13554 - protein, 293 aa, Shewanella oneidensis
MLVNAIKEYQLRVDDQLKQRFSTLEDTAPQLKAAMTHGALLGGKRIRPFLVYSVGQMFGVPLEKLDACAAAIECIHAYSLIHDDLPAMDDDALRRGQPTVHIAFDEATAILAGDALQTLAFEIVTEAVPGITSEQHIAMVRALAKASGYRGMCGGQAIDLASTDKHIDLKALTQLHNMKTGALISCAVELALIAANAPKDQYQTMMEFAHAVGLAFQVQDDILDIIATTEELGKPQGSDAESNKSTFPQLLGLQGAKDTATQLIQEALSALAKLPYNSQLIADFARYIIERRI

SEQ ID NO: 13555 - DNA, 885 bp, Oceanobacillus iheyensis
  CDS (1)..(885)
atgaatgaaaacttacaaagatatttagagatatatcgtgagaaattggaagcaacatataatacttatttttcacatttagatatcccgaataatttaaaagaatccatgctatattcattaaatgcaggcgggaagcgattaaggccaatattaatattggctagctatgaggtatacggaaaaacattagataaagtgatgtcctcagcagttgcaatagaaatgattcatacgtattcacttattcatgatgatttgcctgccatggatgatgatgattatcgtcgaggcaagttaacaaatcacaaacaattcaatgaagcaacagcaatattggctggagatgcattactaacgtatagttttcaattaattagttcagatgacctactaacttctgatgaaaaagtggagttaatacgaatattatctgaagcgagtggaccagctgggatggtcgctggtcaaatattggatatggaagctgaaaaacaagctgttacacttgaagaaatggaagaaattcacgcattaaaaactggagagttaattcggtttgcaattattgctggagcatatcttggtggagcaacagacaatcagttaaaacaccttactgattatgcttattatttaggcttaatttttcaagtgcaggacgatatcttagacataactggagatgcgtcgaagattgggaaaccagtgggtagcgatgaactgaatgaaaaaagcacgtatccgaaattattaggattgcaaggtgctatcgatcagaaaaatctctatgttgaaaaagcctacaaaagtctacatttggctggagcagaagattctctgctcgctgaattgacaaagtatttcagtgagcgtgatcattag

SEQ ID NO: 13556 - protein, 294 aa, Oceanobacillus iheyensis
MNENLQRYLEIYREKLEATYNTYFSHLDIPNNLKESMLYSLNAGGKRLRPILILASYEVYGKTLDKVMSSAVAIEMIHTYSLIHDDLPAMDDDDYRRGKLTNHKQFNEATAILAGDALLTYSFQLISSDDLLTSDEKVELIRILSEASGPAGMVAGQILDMEAEKQAVTLEEMEEIHALKTGELIRFAIIAGAYLGGATDNQLKHLTDYAYYLGLIFQVQDDILDITGDASKIGKPVGSDELNEKSTYPKLLGLQGAIDQKNLYVEKAYKSLHLAGAEDSLLAELTKYFSERDH

SEQ ID NO: 13557 - DNA, 1101 bp, Corynebacterium efficiens
  CDS (1)..(1101)
atgagcacagcacatgaccacaatgtcgacctcgatcagattccggatgttgtacgtgaacgactcacccgtttcctggatgaccgggccgctaacgtggttgcgatcggggggccggtgactgaggccctcagttatctacgggactttgtgctcaacggtggcaagcggatccgtcccctctatgtctgggcgggtttcgtggcggcgcagggcccggggaggagttccgaggacatcaacgctgtgttggatgcagcagccagcctggaattcatccaggcctgtgccctgatccacgatgacatcatcgattcctcggacacccgtcgtggagcacccaccgtccaccgtgcggtggagtcaatgcacggagctgtcggcctggagggtgatgccgcgcacttcggtgagtcggtggcgattctcgctggtgacatggcgctggtgtgggccgaggacatgcttcaggattccggattgtccgccgcagccctggcccgcgcccgcgatgcctggcgcgggatgcgcacggaggtcatcggcggtcaactgttggatatctacctcgaagcccaggccagcgagtccgtcgagctggccaattccgtcaaccgtttcaagaccgcggcatacaccatcgaacgccccctccatctgggcgcatctctggcgggtggggccccggagcttatcgacgcattgcgcaactacggccgcgacatcggtatcgccttccagctccgggatgatctgctcggtgtgttcggggacccggcggtcaccgggaagcccgcgggcgacgacatccgtgagggcaaacgcaccgttctgctcgccctggcactccagcgcgccgatgctgaagatccggaggctgcagccgccatccggtcggccatcgggaaggtcaccgacccggcggagatcacccggatcgccggactcatccgggccaccggtgccgaggatgaggtggaggagcacatctcccggctcaccgcctcggggctggcacacctggagatcgcaggcatcccggatgaggtacgcgagcagctgcgtcacctggctatcagagctaccgaacgcaggatgtaa

SEQ ID NO: 13558 - protein, 366 aa, Corynebacterium efficiens
MSTAHDHNVDLDQIPDVVRERLTRFLDDRAANVVAIGGPVTEALSYLRDFVLNGGKRIRPLYVWAGFVAAQGPGRSSEDINAVLDAAASLEFIQACALIHDDIIDSSDTRRGAPTVHRAVESMHGAVGLEGDAAHFGESVAILAGDMALVWAEDMLQDSGLSAAALARARDAWRGMRTEVIGGQLLDIYLEAQASESVELANSVNRFKTAAYTIERPLHLGASLAGGAPELIDALRNYGRDIGIAFQLRDDLLGVFGDPAVTGKPAGDDIREGKRTVLLALALQRADAEDPEAAAAIRSAIGKVTDPAEITRIAGLIRATGAEDEVEEHISRLTASGLAHLEIAGIPDEVREQLRHLAIRATERRM

SEQ ID NO: 13559 - DNA, 1053 bp, Corynebacterium efficiens
  CDS (1)..(1053)
atgagtagcggccgaaccgttccaacccgttcccacgggctcggaaaagaaggtgcgtcaggaaacaacgcatctcaggtcgagtttggtgacccggcgctcaccgccaggatcgacaacgccatgcagcaggtcgaggaccgcctgctgaaggaactgtccatcggggaggacttcctcgtggacaaggtcacccacctcgcccgggccggcggcaaacgcttccgccccatgttcgcactgctggcctccgagttcggtgccaaaccactcagcgacaacgtgatcaaggccgctgtggtcgtggaaatcacccacctggccaccctttaccacgacgacgtgatggacgaggccaccatgcgtcgcggggtccccagcgccaactcccggtgggacaactccgtagccatcctcgccggcgacatcctcctcgcccacgcctcccggatcatgagccaactcggcatggaaaccgtcgcccacttcgccgagaccttcggtgaactggtcaccggccagatgcgtgagacggtcggcgcccgcggcggtgatcccgtcgaccactacatgaaggtcatccgcgagaagaccgccgtgctcatcgcctccgccggcttcctcggctccatgcatgccgacgccaccccggaacacgtcgatgccctcaagaaattcggtgcggccgtgggcatgatcttccagatcgtcgacgacatcatcgacatcttctccgagaccgccgaatccggcaagacccccggcaccgacctccgcgaaggcgtgttcaccctgcccgtgctctacgccatgcgtgaacagaccgaggtgggtgcccagctgcgtgagatcctcaccggacccatcgaggacgacgacaccgtcgaccgcgccctggagctgctcgcccagtccggtggtcgccgcgaggcgcttgccgacgtccaccactacatggccatcgccaacgccgaactcgaccgcctgcccgacaactccgtcaaggacgccctgcgcaacctcgcgatcttcacggtgcagcgcgtcggctag

SEQ ID NO: 13560 - protein, 350 aa, Corynebacterium efficiens
MSSGRTVPTRSHGLGKEGASGNNASQVEFGDPALTARIDNAMQQVEDRLLKELSIGEDFLVDKVTHLARAGGKRFRPMFALLASEFGAKPLSDNVIKAAVVVEITHLATLYHDDVMDEATMRRGVPSANSRWDNSVAILAGDILLAHASRIMSQLGMETVAHFAETFGELVTGQMRETVGARGGDPVDHYMKVIREKTAVLIASAGFLGSMHADATPEHVDALKKFGAAVGMIFQIVDDIIDIFSETAESGKTPGTDLREGVFTLPVLYAMREQTEVGAQLREILTGPIEDDDTVDRALELLAQSGGRREALADVHHYMAIANAELDRLPDNSVKDALRNLAIFTVQRVG

SEQ ID NO: 13561 - DNA, 915 bp, Brucella suis
  CDS (1)..(915)
atggaaaagctgcctgtcgatttcaccactcttcttaaccgccgcgccatggaagtagaagctgcccttgccggtcttctggacgaacgcccgcgcaccggcgagattgcccgtccgcagcgtctcatcgccgccatgcgccatggcgtactgaacggcggcaagcgcctgcgcccgtttctcgtcctcgaaagtgctgcccttttcggacagtacggccaggcggtgctgcgcgtcgctgccgcgctggaatgtatccattgctattcgctggtccatgacgatctgccagccatggatgatgacgatctgcgccggggccagccaaccgtgcacaaggcctttgatgaggcagccgccattctggccggtgatagcctgctgacctacgccttcgacattatcgcatccgatgaaacggaactcgacgccaccacccgcataaagcttgtttgcgcgctcacgcgcgcttccggccttggcggcatggcaggcggacaggcgctcgacctgatggcggaaaccagaaaaccggacgaggcaagcatcatcacgcttcaagccatgaagaccggcgcgctgatccgctttgcctgcgaggcgggcgctatcatcgctggcgcatcgcaggaagaccgggagcgcatggcggaattcggctcggcaatcggcctggccttccagcttgccgacgatcttctggacgtgaccgccgacgctggcaccatgggcaaggcaaccggcaaggatgccgccgccggaaaagccacgctggtttcacttcacggcattgactggacccgccagcagctttcaggcctcgtcgcacaggccgaaagcctgctcgcaccctttggagaagacgccgaacccctcaagcaagcggcccgcttcatcgccgagcggcagaattaa

SEQ ID NO: 13562 - protein, 304 aa, Brucella suis
MEKLPVDFTTLLNRRAMEVEAALAGLLDERPRTGEIARPQRLIAAMRHGVLNGGKRLRPFLVLESAALFGQYGQAVLRVAAALECIHCYSLVHDDLPAMDDDDLRRGQPTVHKAFDEAAAILAGDSLLTYAFDIIASDETELDATTRIKLVCALTRASGLGGMAGGQALDLMAETRKPDEASIITLQAMKTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 13563 - DNA, 912 bp, Pantoea stewartii
  CDS (1)..(912)
atgatggtctgcgcaaaaaaacacgttcaccttactggcatttcggctgagcagttgctggctgatatcgatagccgccttgatcagttactgccggttcagggtgagcgggattgtgtgggtgccgcgatgcgtgaaggcacgctggcaccgggcaaacgtattcgtccgatgctgctgttattaacagcgcgcgatcttggctgtgcgatcagtcacgggggattactggatttagcctgcgcggttgaaatggtgcatgctgcctcgctgattctggatgatatgccctgcatggacgatgcgcagatgcgtcgggggcgtcccaccattcacacgcagtacggtgaacatgtggcgattctggcggcggtcgctttactcagcaaagcgtttggggtgattgccgaggctgaaggtctgacgccgatagccaaaactcgcgcggtgtcggagctgtccactgcgattggcatgcagggtctggttcagggccagtttaaggacctctcggaaggcgataaaccccgcagcgccgatgccatactgctaaccaatcagtttaaaaccagcacgctgttttgcgcgtcaacgcaaatggcgtccattgcggccaacgcgtcctgcgaagcgcgtgagaacctgcatcgtttctcgctcgatctcggccaggcctttcagttgcttgacgatcttaccgatggcatgaccgataccggcaaagacatcaatcaggatgcaggtaaatcaacgctggtcaatttattaggctcaggcgcggtcgaagaacgcctgcgacagcatttgcgcctggccagtgaacacctttccgcggcatgccaaaacggccattccaccacccaactttttattcaggcctggtttgacaaaaaactcgctgccgtcagttaa

SEQ ID NO: 13564 - protein, 303 aa, Pantoea stewartii
MMVCAKKHVHLTGISAEQLLADIDSRLDQLLPVQGERDCVGAAMREGTLAPGKRIRPMLLLLTARDLGCAISHGGLLDLACAVEMVHAASLILDDMPCMDDAQMRRGRPTIHTQYGEHVAILAAVALLSKAFGVIAEAEGLTPIAKTRAVSELSTAIGMQGLVQGQFKDLSEGDKPRSADAILLTNQFKTSTLFCASTQMASIAANASCEARENLHRFSLDLGQAFQLLDDLTDGMTDTGKDINQDAGKSTLVNLLGSGAVEERLRQHLRLASEHLSAACQNGHSTTQLFIQAWFDKKLAAVS

SEQ ID NO: 13565 - DNA, 870 bp, Rhodospirillum rubrum
  CDS (1)..(870)
atggatgttcggcaacatatcgacaacgttcttgaagccacgatgacccgggcggatctgcccgacgcgccacccttgctggccaaggccatgcgccacgccgtgtttcccggtggtgggcgcctgcggccgcggttgaccctggccgtcgccgccgcctgcggcaatgacctgcccgccgccgccgatgccgccgccgccgccatcgaactgctccattgcgcctcgctcgtccacgatgatctgccctgcttcgacgacgcccactcccgccggggtcaggcctcggtccatgtcgcctatggcgagccgctggcggttctggccggcgacgccctgatcgtcatggccttccagggcttggccagcggtctggccatggttcccgagcggttgcccctgctgctgggcatcgtcgccgacgcggtgggcatgcccgccggcatctgcgccggtcaggcctgggaaagcgaaccgacggttaaactggccgaataccagcgggccaagaccggcgccctgttcgccgcctcgaccatggccggcgccgcggcggctggccgcgaggcgcggtcctggcggatgttgggcgaatgcctgggcgaggcctatcaggtggccgatgatctgcgcgatgtcgccgccgatccggccgaactgggcaagccggtgggtcgcgacgcggcgctgggacggcccaacgccgttggtcatctgggaatcgtcggcgccgtgcgccggctggaaagtctggtcgccgatgcggtggcctcggtgcccgattgcgccggagccggggcgttgcgcgcgcttattcacaaggaagccgaacgcttcctgcccaaggaactggcgcgctacgccgcctga

SEQ ID NO: 13566 - protein, 289 aa, Rhodospirillum rubrum
MDVRQHIDNVLEATMTRADLPDAPPLLAKAMRHAVFPGGGRLRPRLTLAVAAACGNDLPAAADAAAAAIELLHCASLVHDDLPCFDDAHSRRGQASVHVAYGEPLAVLAGDALIVMAFQGLASGLAMVPERLPLLLGIVADAVGMPAGICAGQAWESEPTVKLAEYQRAKTGALFAASTMAGAAAAGREARSWRMLGECLGEAYQVADDLRDVAADPAELGKPVGRDAALGRPNAVGHLGIVGAVRRLESLVADAVASVPDCAGAGALRALIHKEAERFLPKELARYAA

SEQ ID NO: 13567 - DNA, 1326 bp, Arabidopsis thaliana
  CDS (38)..(1120)
acttttataaagttctattagagacggtggataggccatggctactactgttcatctcaactcattctccctcttcatccaatccagaggaagaagagacaactccatatcttccgtcaagagtctcaaaaaacgcacaggtttgtctccctcttctgccctcacctcacaaggtggcagagacatgattccaccagagggaaaatgcaatgatcacaactctgcttttgatttcaagttgtatatgatccgcaaagccgaatctgtaaatgcggctctcgacgtttctgtaccgctccgagaacccctcactgtccaggaagccgtgcggtactcattgctagcgggcggaaaacgtgtgaggcctctgctctgcattgccgtctgcgagcttgtgggaggcgacgaggctactgccatgtcagctgcttgcgcggttgagatgatccacacaagctctcttattcatgacgatcttccgtgcatggacaatgccgacctccgcagaggcaagcccaccaaccacaaggtatatggagaagacatggcggttttggcaggtgatgcactccttgcattggcgtttgagcacatgacggttgtgtcgagtgggttggtcgctcccgagaggatgattcgcgcggtggttgagctggccaggaccatagggactacagggctagttgctggacaaatgatagacctagccagcgaaagactgaatccagacaaggttggattggagcatctagagttcatccatctccacaaaacggcggcattgttggaggcagcggcggttttaggggttataatgggaggtggaacagaggaagagatcgaaaagcttagaaagtatgctaggtgtattggactactgtttcaggtggttgatgacattctcgacgtaacaaaatctactgaggaattgggaaagactgcaggaaaagacgtaatggctggaaagctgacgtatccaaggctgataggtttggagagatcaaaggaagttgcagagaaactgaggagagaagcagaggaacaacttctagggtttgatccaagtaaggcggcgcctctggtggctcttgctagctacatcgcttgcagacacaactgaatggactgatcatatcctcaatgcatcaatctcctaacaagtccttttacttagatctatggtcttgtttcttataaatcatctatgccgtgtgatcatctctctcatttgttttcaagttgtattatgtttttgaatcttaataatgtaatgttcgaaaaatatcaataagatttgctcataggaaaaaaaaaaaaaaaaaaaat

SEQ ID NO: 13568 - protein, 360 aa, Arabidopsis thaliana
MATTVHLNSFSLFIQSRGRRDNSISSVKSLKKRTGLSPSSALTSQGGRDMIPPEGKCNDHNSAFDFKLYMIRKAESVNAALDVSVPLREPLTVQEAVRYSLLAGGKRVRPLLCIAVCELVGGDEATAMSAACAVEMIHTSSLIHDDLPCMDNADLRRGKPTNHKVYGEDMAVLAGDALLALAFEHMTVVSSGLVAPERMIRAVVELARTIGTTGLVAGQMIDLASERLNPDKVGLEHLEFIHLHKTAALLEAAAVLGVIMGGGTEEEIEKLRKYARCIGLLFQVVDDILDVTKSTEELGKTAGKDVMAGKLTYPRLIGLERSKEVAEKLRREAEEQLLGFDPSKAAPLVALASYIACRHN

SEQ ID NO: 13569 - DNA, 1496 bp, Sulfolobus shibatae
  CDS (221)..(1216)
ttaccagtgttaaaaagtgctatagaaggtaaggaaagtttagaacaattctttagaaagataatatttgaattgaaggccgccatgatgcttactggttctaaagacgttgatgcgttaaagaagaccagtattgttattttaggtaaacttaaagagtgggcagaatatagggggataaatttatctatatacgagaaagttagaaagagagaataaaatgagtgacgaattaagttcgtattttaatgatatagttaacaatgtaaattttcatataaaaaattttgtaaagagcaatgttagaacgcttgaggaagcatcgtttcatttatttacagctgggggcaaaagacttagacccttaattctggtttcatcgtcagacttaattggcggggacaggcaaagggcatataaggcagcagctgccgtggagattcttcacaactttactctagttcatgacgatataatggatagggattacctaagaagaggattaccaactgttcatgtaaagtggggtgaaccaatggcaatacttgcaggtgattacttacacgccaaggcttttgaagccttaaatgaggctctaaaaggtcttgacgggaatacgttttataaggctttttccgtatttattaattctattgagataatatcggaaggtcaagcaatggatatgtcatttgaaaatagagtagatgtaactgaggaagagtacatgcaaatgataaaaggaaagactgcgatgctattttcatgttctgctgcattaggcggtataattaacaaggctagcgatgatataattaaaaatttagtcgaatatggattaaatctaggcatatcattccaaatagtggatgatatcttaggaattattggagaccaaaaggaattagggaaaccagtttacagtgatattagggaaggtaagaaaacaattcttgttataaaaactttaagtgaagctactgacgatgaaaagaaaattctggtttctacgcttgggaatagggaggctaaaaaggacgatcttgagagagcgtcggaaataataaggaagtattcattgcaatatgcatacaatttagctaaaaagtactcagatcttgcattagaacatttgcgtaaaattccagtttacaatgaaactgctgaaaaggctttaaaatatctagcgcagtttaccattgaaaggagaaagtaaatgagcatatcagggatattgctttcaatttttatatcctttttcataagctatattacaacagtctgggtaataagacaggcaaaaaagagtgggcttgtaggtaaggatgtaaataaaccagataaaccggaaataccactaatgggtgggataagtataatagccgggtttatagcgggatccttctccttattactaactgatgtaagaagtgagcgagtaattccatctgtaatactctcctcattgcttatagcatttcttggactattagatg

SEQ ID NO: 13570 - protein, 331 aa, Sulfolobus shibatae
MSDELSSYFNDIVNNVNFHIKNFVKSNVRTLEEASFHLFTAGGKRLRPLILVSSSDLIGGDRQRAYKAAAAVEILHNFTLVHDDIMDRDYLRRGLPTVHVKWGEPMAILAGDYLHAKAFEALNEALKGLDGNTFYKAFSVFINSIEIISEGQAMDMSFENRVDVTEEEYMQMIKGKTAMLFSCSAALGGIINKASDDIIKNLVEYGLNLGISFQIVDDILGIIGDQKELGKPVYSDIREGKKTILVIKTLSEATDDEKKILVSTLGNREAKKDDLERASEIIRKYSLQYAYNLAKKYSDLALEHLRKIPVYNETAEKALKYLAQFTIERRK

SEQ ID NO: 13571 - DNA, 975 bp, Chlorobium tepidum
  CDS (1)..(975)
atggatattaatgtggtaacattttctgttacggaagagctgaaacagttccaggagcgctacaaaacggtgcttcattcaagcaacagcctggttgacaaggtcacgcgctatgtgctccggcagcagggcaagcagatcaggccgacgctggtgattcttgcggccaaggtgtgcggcggcgtccacgacgtcacctatcgcggcgcgatcatggtggagctgctgcattcggccacgctgatccacgacgatgtggtggacggtgccgaaatgcgccgggggattccctcgatcaacgctctgtggaaaaacaagatatcggtgctgatcggtgactatctactctccaagggtctgctctactccctcgaaaacaaggattaccggtcgctgcatttggtctcggaggcggttcgccgcatgagcgagggggagattctccagatccagaaaactcgcagccttgacatcaccgaggaggattatctgagtgtcattgccgacaaaacaggctcgctcatcgccacctcgtgcgccatcggcgcggccagctccaccgactccgaagacgagatcgccagcctgaagagctatggcgaatttctcggcctggccttccagatcagggatgacctgctggactacaccggggattccaaaaaaaccggcaagcagctcggcatcgatatcaaggatcgcaagattactcttccgctgatctacgctcttcgtcaatcggacaaatcggagcagaacaagatcaagtcgattctgaaaagctcccggaagcgttcggtcaggagcggcgaagtaattgactttgtcacccggaagggggggcttgattatgccgccgaagttgcggaaggctttgcggacaaggcgctcgaatcgattgcccattttcccgaaagtgacgccaagcgttcactccagcttcttgtcgattttgtcatgaaacggcagcattga

SEQ ID NO: 13572 - protein, 324 aa, Chlorobium tepidum
MDINVVTFSVTEELKQFQERYKTVLHSSNSLVDKVTRYVLRQQGKQIRPTLVILAAKVCGGVHDVTYRGAIMVELLHSATLIHDDVVDGAEMRRGIPSINALWKNKISVLIGDYLLSKGLLYSLENKDYRSLHLVSEAVRRMSEGEILQIQKTRSLDITEEDYLSVIADKTGSLIATSCAIGAASSTDSEDEIASLKSYGEFLGLAFQIRDDLLDYTGDSKKTGKQLGIDIKDRKITLPLIYALRQSDKSEQNKIKSILKSSRKRSVRSGEVIDFVTRKGGLDYAAEVAEGFADKALESIAHFPESDAKRSLQLLVDFVMKRQH

SEQ ID NO: 13573 - DNA, 999 bp, Chlorobium tepidum
  CDS (1)..(999)
atgtcctcaccgattacccaagcacaggttgaaagcaagtaccggcaataccatgcaaagatcaacgaagcgcttgccgcctgctttccgaaagagaagccggcaaccctttacgaccctgcgcgctacattctcgaaggaaagggtaagcgaatccgtccgttcctgactttgcttgccgccgaagcggtcagcggcaagtccgacaacgcgcttggcgttgccctcggtatcgaggtgctgcacaacttcaccctgatgcacgacgacatcatggaccaggccgatctgcgccatggccgtcccaccgtgcacaagcagtggaatgtcaacgcggcgattctttcgggtgacatgatgatcgcctacgcctacgagctggcactcaaggcgatcagttcgcgccacgccgaaataatccacatcttcaacgatgccaacatcacgatctgcgaagggcaggcgctcgacatggagctcgaacagcgcaaggatgtcaccatcgccgactacctcgacatgatctccaaaaagacggggcgactcatctcggcggcgctcgaagcgggcggcgttgcgggcgacggcacgccggagcagatcgcagcgttggtcaccttcggcgaaaagatcggacgagctttccagattcaggatgactatctcgacatcatggccggagacggcaagtcgggcaaggtgccgggcggcgacgtcatcaacggcaaaaagacctggctgctgctccgttcgctcgaactggccgaaggcgctgaccgcgagcttttacaatcgatcttcgacaacaacggcacctcgcccgacaacgtcccagcggtcaaggcgatcttcgagaagtgcggtgtgctcaacgagaccagggcgaaaatcaacgaggataccgaagcagcgctggcagcgctcgacgcccttccgttcgaggagggacgcggctatctgagaggctttgccaacattctcatgaagcgcgatttctga

SEQ ID NO: 13574 - protein, 332 aa, Chlorobium tepidum
MSSPITQAQVESKYRQYHAKINEALAACFPKEKPATLYDPARYILEGKGKRIRPFLTLLAAEAVSGKSDNALGVALGIEVLHNFTLMHDDIMDQADLRHGRPTVHKQWNVNAAILSGDMMIAYAYELALKAISSRHAEIIHIFNDANITICEGQALDMELEQRKDVTIADYLDMISKKTGRLISAALEAGGVAGDGTPEQIAALVTFGEKIGRAFQIQDDYLDIMAGDGKSGKVPGGDVINGKKTWLLLRSLELAEGADRELLQSIFDNNGTSPDNVPAVKAIFEKCGVLNETRAKINEDTEAALAALDALPFEEGRGYLRGFANILMKRDF

SEQ ID NO: 13575 - DNA, 975 bp, Rhizobium loti
  CDS (1)..(975)
atgaacgacatgcagaccgattccacgctacacgacgacgcgcaggcgcgtggcgcatccggcaggctgccgccggagatctggatgcaggacggcgcaaggcgggtcgaacaggcgctggcgcgtcttctctgcgccgaagacgacggtgagaccgagctgatggcggcgatgcgctacgccaccttgcatggcggaaagcgcactcgcgccttgctctgtctggctaccggcgcactggccgacacgccggcgcccatgctcgacgatgtcggcgccgccatcgagatgatgcacgcctgtaccctggtccacgacgacctgcccgcaatggacgatgacgtgcttcgccgcggccttccgaccgtgcacgtcaagttcggcgaagccactgcgatcctggtcggcgatgcgctgcaggcgcacgccttcctgaccctggcgagcctggatgcgccgggcgacaaccgtatcgcgctcgtgcgcgaactggcgcaggcggtgtccgccgagggtgccgcaggcgggcaggccatggatctgtcgctggtaggaaagcacgtcgagctggacaggatcgtggcgatgcaccggatgaagagcggagcactagtgcgcgcgtccgttcgcatgggcgcgctatgcgccatcgcggaggatgccgcccacgctgcgctgtactgtgcgctcgatcgctactccgcctgtttcggcctggcgttacaggtggtcgacgacattctcgacgcgacagcggataccgcgacgttgggcaagacccccggcaaggacgcggcggcgcagaagccgacctgtgcgtcgatcatggggctgcaggcagcgcgccagttggcgctggatctgttgcgcgacgccggggaggccatcgccccgctgggaacgcgtgcggaacggttggcgcagatgctgcagcgggccaacgcgtatctgttcaagcacgcgccatgcgcatga

SEQ ID NO: 13576 - protein, 324 aa, Rhizobium loti
MNDMQTDSTLHDDAQARGASGRLPPEIWMQDGARRVEQALARLLCAEDDGETELMAAMRYATLHGGKRTRALLCLATGALADTPAPMLDDVGAAIEMMHACTLVHDDLPAMDDDVLRRGLPTVHVKFGEATAILVGDALQAHAFLTLASLDAPGDNRIALVRELAQAVSAEGAAGGQAMDLSLVGKHVELDRIVAMHRMKSGALVRASVRMGALCAIAEDAAHAALYCALDRYSACFGLALQVVDDILDATADTATLGKTPGKDAAAQKPTCASIMGLQAARQLALDLLRDAGEAIAPLGTRAERLAQMLQRANAYLFKHAPCA

SEQ ID NO: 13577 - DNA, 930 bp, Rhizobium etli
  CDS (1)..(930)
atgatttcgaatcaccaagccgacgtggttggcgatagcgacaagctcatcgagcaagcgctgcgagctgccatggatactgctctaagtccggctgcgccggctcacctgcgtggagcgctggacgcggcagtgtttccagggggctcccggatgcgccccaagctctgcttgaaagtctcctatgtgtgcggcgaaaaagatcctgagctggcgacaagagccgcggcagcaattgaattgctgcactgtgcctcgttggtgcatgacgacttgccttgcttcgataacgcggcgctacgccgcggcagaccaacggtgcaccggcttttcggagagcctatcgccgttttgaccggcgatgccttgattgtgatggctttcaaatacctcagcttgcaggctgcgctaacacctgagttgggcgcgcgcatgatcgaggtggttgcggaggcggtcggccccagtcacggactgatcgccggacagtcgatggaggcaatgacgcacgtcccaatcgaccgctatcaccattacaagaccggctccctctttgtcgcggcggccacttgcggtgccctggcaagtggtgcagatccggccccatggtctaaggtgggggaattgctcgggcacgcgtatcagatcgccgacgacatcgcagatacagtcggccgcgcagaagtgcttggcaaattgcctgccgtggacacgcagctgaatcgacccagtatcgttcgcggccaaggattggacagcgcagccgccagattttatgcgtatctcgaacagataggtgacaccattcctgccagccctcaaaaacggtccttcgttgactggcttaatcatgcactttgcaaaggcgtggctggaccgggaaaagccggtctgattcaacaaacggcgctggattgcgcgcctttgtaa

SEQ ID NO: 13578 - protein, 309 aa, Rhizobium etli
MISNHQADVVGDSDKLIEQALRAAMDTALSPAAPAHLRGALDAAVFPGGSRMRPKLCLKVSYVCGEKDPELATRAAAAIELLHCASLVHDDLPCFDNAALRRGRPTVHRLFGEPIAVLTGDALIVMAFKYLSLQAALTPELGARMIEVVAEAVGPSHGLIAGQSMEAMTHVPIDRYHHYKTGSLFVAAATCGALASGADPAPWSKVGELLGHAYQIADDIADTVGRAEVLGKLPAVDTQLNRPSIVRGQGLDSAAARFYAYLEQIGDTIPASPQKRSFVDWLNHALCKGVAGPGKAGLIQQTALDCAPL

SEQ ID NO: 13579 - DNA, 888 bp, uncultured proteobacterium
  CDS (1)..(888)
atggggtttagtacccgaattgaagcggcgatatcagatgccgtaaacttggggcaaaccgccccgtcccctgccaaacttgcctctgcattgcgctatgcggtcagccccggtggcgcgcgtattcgcccaaccatcttaatgagtgtcgccgcggcctgcggtgatgatcgcccagaattgaccaatgcggccgcggccgctttagaatgtattcactgcgcctctttggtgcatgatgatctgccgtgctttgacgatgctgaaacgcggcggggcaaaccctcccttcaccgtgcttatagtgagccgcttgcggttttggctggcgacagtctcatcgtgatggcttttcaaattctcacgcgccatgcctccattgatccacagcgcgcaattgggttgatgaacatcctggccgagcagaccggaatgcccaatggcatatgcgccggacagggctgggaaagtgagcaaaaaatagatttgcgtgcctatcacagagcaaaaactggtgcccttttcgtcgccgcaacgcaaatgggcgcgattgctgctggccaagatggtgcacaatgggatgagctgggatctcgtattggcgaagcctttcaagtggccgatgacctacgcgatgcgctttacaatgaagccgagttgggcaagcccgccgggcaagacgacctgcatgggcggccaaacgcggttgcggaatacggcatcgagggcgcgatttcccatatgaaaaatatcttaggcggcgccatctcttctattccgcgctgccccggcgaagccatgttggccaaaatggtcaatgcccaagcagaaatgttaactcccgtgaaatggcgcagcaaacactcaaatcttcaccctggtgagtaa

SEQ ID NO: 13580 - protein, 295 aa, uncultured proteobacterium
MGFSTRIEAAISDAVNLGQTAPSPAKLASALRYAVSPGGARIRPTILMSVAAACGDDRPELTNAAAAALECIHCASLVHDDLPCFDDAETRRGKPSLHRAYSEPLAVLAGDSLIVMAFQILTRHASIDPQRAIGLMNILAEQTGMPNGICAGQGWESEQKIDLRAYHRAKTGALFVAATQMGAIAAGQDGAQWDELGSRIGEAFQVADDLRDALYNEAELGKPAGQDDLHGRPNAVAEYGIEGAISHMKNILGGAISSIPRCPGEAMLAKMVNAQAEMLTPVKWRSKHSNLHPGE

SEQ ID NO: 13581 - DNA, 879 bp, uncultured proteobacterium
  CDS (1)..(879)
atggaaaacgggctccttgattgtgaacagtacctagaagaagcaatggcagaacatgcgaccgcgcaatgccctccattgctcgcgcaagcccttaactacgcggtttttcccggcggtgcgcgggtgcgtcccaagatctgcaaggccgtcgctctggcgaataactcaagtgacgttggacttgccaatgccgcagcaagcgccatcgaactgctccactgcgcctcgctggttcatgacgacctcccctgcttcgatgatgcaactcagcgcagagggaaaccctccgttcatgcaaaatttggcgagcgcattgccgttctcacgggtgatgcactcattgtcgccgcttttcaaaccttagccactcatgcgatacatgcggttcgtacggagcgtgtcccgctcgtgaccgccatcgttgcgcgtggggttggtgcgccgcacggcatctgtgcgggacaagcatgggagtgcgagcgaagcgtcgacctttcacgatatcaccgcgcaaaaacgggcgccttgtttgttgccgcaacctgcgcaggtgccgccgcggcgggcgttgatccgggtccttgggtcaatcttggggcgagtataggagaagcctatcaggtcgcagatgacattaaagacgcgatctctgatcccgagactctcggtaagcccactggaatagacgttaaactcgatcgccccagcgctgttcgcgaactcggtcttgacggagcggttacgcggcttaagcagtgcctggaggctggcttagacagtatgccagcctgtgccggccaagatttgctacagaaaattgttcgcgcacaggcgagtcgatttgtacccgagaagattgctcaagtcgccgcgtaa

SEQ ID NO: 13582 - protein, 292 aa, uncultured proteobacterium
MENGLLDCEQYLEEAMAEHATAQCPPLLAQALNYAVFPGGARVRPKICKAVALANNSSDVGLANAAASAIELLHCASLVHDDLPCFDDATQRRGKPSVHAKFGERIAVLTGDALIVAAFQTLATHAIHAVRTERVPLVTAIVARGVGAPHGICAGQAWECERSVDLSRYHRAKTGALFVAATCAGAAAAGVDPGPWVNLGASIGEAYQVADDIKDAISDPETLGKPTGIDVKLDRPSAVRELGLDGAVTRLKQCLEAGLDSMPACAGQDLLQKIVRAQASRFVPEKIAQVAA

SEQ ID NO: 13583 - DNA, 1612 bp, Paracoccus zeaxanthinifaciens
  CDS (295)..(1158)
ccatggcatccgggtcggatgccgtctatgttggcccgaacaggcagcaggaggccccatgagcgatatccagaccctctcgttcgaggaagccatgcgcgagctggaggcgaccgtcggcaagctggaaaccggcgaggcgacgctcgaggactccatcgcgctctatgaacgcggggcggcgctgcgcgcccattgcgaaacccgcctgcgcgaggccgaggagcgggtcgagaagatcaccctggccgcgaacgggcagccgtccggaaccgagcccgccgagggcctgtgatgcaggcccgcctggccgagatccggcccctggtcgaggccgagctgaacgccgccatcgacgcgctgcccgcgggcgatctgtcggatgcgatgcgctatgccgtgcagggcggcaagcggctgcgcgcgttcctggtgatggagtcggcgcgcctgcacgggctggacgacgacgcatcgctgcccgtcgccgccgcggtcgaggcgctgcacgcctacagcttggtccatgacgacctgcccgcgatggatgacgacgacctgcggcgcggtcagcccaccgtccacgtcaaatggaccgaggcgaccgcgatccttgcgggcgatgcgctgcagacgctggccttccagctgctggccgatccgcgcgtgggcgacgatgcggcgcggatgcggctggtcggttcgctggcgcaggcatcgggggctgcgggcatggtctggggccaggcgctggacatcgcggccgagacctcgggcgtgccgctggatctggacgcgatcatccgcctgcagggtggcaagaccggcgcgctgatccgctttgccgcgaccgccgggccgctgatggcgggggcggaccctgccgcgctggacgattatgcgcaggccgtcgggctggccttccagatcgcggacgacatcctggacgtcgagggctgcgaggccgcgaccggcaagcgcgtcggcaaggatgcggatgccaacaaggcgaccttcgtctcgctgctgggcctcgagggggcgcggtccgaggcgcgtcgcctggccgatgcggggcaggacgcgctggcgggttacggcgatgctgcggggaaccttcgggacctggcgcgcttcgtgatcgaacgcgacagctgatcgccgccttcccgccaaggggcaagatgatgaccgacggacccgcaaccccgatcctggaccgcgtccagcagccatccgacctggcatcgctggacgatgcgcagctgcgcctgctggcggacgagctgcgggccgagaccatcgacatcgtcagccgcacgggcggtcacctgggcgcggggctgggcgtggtcgaactgacggtcgccctgcacgccgtctttcgggcgccgcgcgacaagatcgtctgggacgtggggcatcaatgctatccccacaagatcctgacgggcaggcgggaccggatgcgcacgctgcgcatgggcggcgggctgtcggggttcaccaagcggcaggaaagcgcgttcgatccgttcggtgcggggcacagctcgacctcgatctcggcggcgctgggcttcgcgatggcgcgtgaacttggcggggatcc

SEQ ID NO: 13584 - protein, 287 aa, Paracoccus zeaxanthinifaciens
MQARLAEIRPLVEAELNAAIDALPAGDLSDAMRYAVQGGKRLRAFLVMESARLHGLDDDASLPVAAAVEALHAYSLVHDDLPAMDDDDLRRGQPTVHVKWTEATAILAGDALQTLAFQLLADPRVGDDAARMRLVGSLAQASGAAGMVWGQALDIAAETSGVPLDLDAIIRLQGGKTGALIRFAATAGPLMAGADPAALDDYAQAVGLAFQIADDILDVEGCEAATGKRVGKDADANKATFVSLLGLEGARSEARRLADAGQDALAGYGDAAGNLRDLARFVIERDS

SEQ ID NO: 13585 - DNA, 1298 bp, Abies grandis
  CDS (90)..(1253)
attgattcatacatatggtatcgaaattggtgagagctatgtattagattgattctaaggtagacagcaggaacaaatataggaactacatggcttacagtggtatggtacgtagcttccaaggcgtgtattttatggctgttgctcttgatcgaaaccgtaatctgaagagaattgacattccatcaaaacgttttgatggagtttcgacctcatttgtggcttgtaatggcgagcatctgggccttcccgtaaatttgaagaaagagttcttatcatgcatacaacgggcatcgtcctctagatcctcaaacacaatcgtccagtttgctaatttgcctgaacaagggaagaaggtcgttgaatttgatttcaataagtacatgctttccaaggcaatggcagtgactgaggcattggataaggctatcccacatagttatccccagaaaatacatgaatccatgaggtattctcttctggcaggggggaagcgcgttcgtcctgttctgtgcattgctgcgtgtgaacttgtgggaggaagggaggagctcgccatgccaactgcctgcgcaatggaaatgatccacacaatgtctttgattcatgatgacttaccttgcatggacaacgatgatttacggcgaggtaagcctacaaaccataaggtcttcggccaggacactgctcttcttgcaggggatgcacttcatgcatttgcctttgagcacattgtagcctttacaagcaaatctgtggggagtgatgggattttgagggcggttactgaattggctagagcaacaggccctcaagggattatgggtggccagattgtcgatattgcgagcgagcgggatgcttttgttgaccttcagactctggaatggatccatattcacaagactgcggtgctcttcgagtgcgcgactgtgtgtggggcgatcatcggaggtgcttcgggggatgaaattgagagaattcgaaggtttgcccgttatttggggcttctgtttcaagtcgtggatgacatactcgatgtcacaaaatcttctgaagatttgggtaagactgcaggaaaggatttggttagtgataaggccacttatcccaagctgatgggtttagagaaagcaaagggattttctcttgaattgttgaacaaagctaaggaggagttatcatgcttcgatccaatgaaggctgcacctctgttcggtcttgcagattacatggcactcagacagaattgaaaagcctagtaaaatcgttcctacgtaaaaaaaaaaaaaaaaaaa

SEQ ID NO: 13586 - protein, 387 aa, Abies grandis
MAYSGMVRSFQGVYFMAVALDRNRNLKRIDIPSKRFDGVSTSFVACNGEHLGLPVNLKKEFLSCIQRASSSRSSNTIVQFANLPEQGKKVVEFDFNKYMLSKAMAVTEALDKAIPHSYPQKIHESMRYSLLAGGKRVRPVLCIAACELVGGREELAMPTACAMEMIHTMSLIHDDLPCMDNDDLRRGKPTNHKVFGQDTALLAGDALHAFAFEHIVAFTSKSVGSDGILRAVTELARATGPQGIMGGQIVDIASERDAFVDLQTLEWIHIHKTAVLFECATVCGAIIGGASGDEIERIRRFARYLGLLFQVVDDILDVTKSSEDLGKTAGKDLVSDKATYPKLMGLEKAKGFSLELLNKAKEELSCFDPMKAAPLFGLADYMALRQN

SEQ ID NO: 13587 - DNA, 1524 bp, Abies grandis
  CDS (122)..(1267)
gattttccctgctacaaaaatctatgtattgtttcttcagttgcattcaaagatctatagaatttcgagctttgaatttgttttaagagtttatagcaggagctaatcatataaagaggacatggcttacagtgctatggcaaccatgggttacaatggtatggcagctagctgccataccctgcatcctaccagcccattaaaaccttttcatggagcttcaacctcactggaagcttttaatggcgagcatatgggcctcctccgagggtattcgaagaggaagctatcttcatataaaaatccggcatctagatcctcaaacgctacagttgcccagttgcttaatcctccacaaaaagggaagaaggccgttgaatttgatttcaacaagtacatggattccaaggcaatgacagtgaatgaggcgttgaataaggctatcccacttcgttatccccagaaaatatatgaatccatgaggtattctcttctggcaggagggaaacgagttcgtcctgttctgtgcattgcagcatgtgagcttgttggaggaaccgaggagcttgcgattccaactgcctgtgcaatcgaaatgatccacacaatgtctttgatgcatgatgacttgccttgcatagacaatgatgatttacggcgagggaaacctacaaaccataagatcttcggggaagatactgctgttactgcagggaatgcgcttcattcttacgcctttgagcatattgcagtttccacaagcaaaactgtgggggctgataggattttgaggatggtatctgaactgggtagagcaacaggctctgaaggggttatgggtggccagatggtcgatattgccagcgaaggggatccttctattgaccttcagactctggaatggattcatattcacaagactgcaatgctcttggagtgctcggttgtgtgtggggcgatcatcggtggtgcttcggagattgtgatcgagagagctcgaaggtatgcccgttgcgtggggcttctttttcaggttgtggatgacatactcgatgtcacgaaatcatcagacgaactgggcaagactgcaggaaaggatttgattagtgataaggcaacttatccaaagctcatgggtttggagaaagcaaaggagttttctgatgaattgttgaacagagctaagggagagttatcttgcttcgatccagtgaaggcagcacctctgttgggtcttgcagattacgtggcattcagacaaaattgaagagcctcctcaaagcgttcttgtttgttagagtggataatcttggtttaatagttttttaaagtaacagagttagacctgcgttccctgccctccgtatactatctatgatgtagcactgcaacttcttgtattgtgaaaacttgagcacagcattttaattgtgaaatctagtccaactgcaaactcaaaccggatattcagtcgatggcccgtctacaggccgactggccgtgattcaaggcgagcaatactca

SEQ ID NO: 13588 - protein, 381 aa, Abies grandis
MAYSAMATMGYNGMAASCHTLHPTSPLKPFHGASTSLEAFNGEHMGLLRGYSKRKLSSYKNPASRSSNATVAQLLNPPQKGKKAVEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 13589 - DNA, 1289 bp, Abies grandis
  CDS (83)..(1234)
gtgcgctgttcaatgcaacgatcaatattagaatcaccagagttgatagcaggaaccattaaaacagaaatagaacaaagatatggcttacagttgtatggcagctagctgccatggcctgcattttatgaatattgcttctcaggaatgtaatttgaaaagaggtattatcccatcaaaacgtctgcatggaatttcatcctcattgtgggcttctaatggcttccaaggccatttggaaagggacttatcggcatatagacatctggtatcatcatccagatgcttaaacacaatcgccatgttgagtaatctgtctgaacaagcaaaggaaaaggccactgaatttgatttcaaggagtacttgcattccaaagcaatatcagtgaatgaggcactggagagggctgtcccacttcgctatcctgaaaaaatacatgaagctatgaggtattctcttctagcaggagggaagcggattcgtcctattctgactattgcagcatgtgagcttgtgggagggagtgaggagctcgccatgccaactgcctgtgcaatggagatgatccacacaatgtctttgattcatgatgatttgccttccatggacaatgatgatttacgccgaggtaagcttacaaaccacaaggtctttggcgaaggcactgctgttcttgcaggggatgcacttctttcatttgcatttgagcacattgcagtgtccacaaggaaaactgtggcgagtcatagggttttgagggtggtatctgaattgggtaaggcaataggctctcaaggggttgctggtgggcaggttgctgatattaccagtgaaggggatccatctgttgggcttgagactctcgaatggattcacattcacaagactgcagtgctcttggagtgcgccgttgtgagtggggcgatcatcggtggcgcttcagagaatgaaattgagagaactggaaggtatgcccgttgcgttgggcttctgtttcaggttgtggatgacatactcgatgtcaccagatcatcagaagaattgggaaagactgcaggaaaggatttggttagtgataaggccacttatcccaagctgatgggtttggagaaagcgaaggaatttgctgatgaattgttggacagagctaaggaggagttatcttgcttcaacccagctaaggctgcacctctgttgggtcttgcagattacattgcattaagacagaactgaaaagcctgcgaaatgtgttcttatgtatgccgtttgtgcttttgcttttgcatct

SEQ ID NO: 13590 - protein, 383 aa, Abies grandis
MAYSCMAASCHGLHFMNIASQECNLKRGIIPSKRLHGISSSLWASNGFQGHLERDLSAYRHLVSSSRCLNTIAMLSNLSEQAKEKATEFDFKEYLHSKAISVNEALERAVPLRYPEKIHEAMRYSLLAGGKRIRPILTIAACELVGGSEELAMPTACAMEMIHTMSLIHDDLPSMDNDDLRRGKLTNHKVFGEGTAVLAGDALLSFAFEHIAVSTRKTVASHRVLRVVSELGKAIGSQGVAGGQVADITSEGDPSVGLETLEWIHIHKTAVLLECAVVSGAIIGGASENEIERTGRYARCVGLLFQVVDDILDVTRSSEELGKTAGKDLVSDKATYPKLMGLEKAKEFADELLDRAKEELSCFNPAKAAPLLGLADYIALRQN

SEQ ID NO: 13591 - DNA, 1311 bp, Cistus incanus subsp
  CDS (116)..(1225)
acctcccctatcggagattttcaatatattttccatttctaaacaatattatcctcttaagaaacattagcatttcagtcacttaccatagtggattctccggtgaccgggaaaaatgagtactgtgaatgtgaatctgggttcatggagtcagcctacctgctttgtatttaaccagaaaactagatccagaatccctaattttagttccttcaagggattcatggcttcttcgtcgaatttccgttctgtttcttcttcttcttcttcctcctcctcctttattgcctcagttctttctgggaaagatactatgaagggagaagaagaaaattccggttttgatttccagtcttatatggatcagatggcggattccgttaatcaagcgctggaatcagcggtttcgctccgggaaccgttgaagatccatgaagcaatgcggtactcgcttttggccggagggaaaagggtgaggccgcttttgtgtattgccgcgtgtgagctcgtcggcggggatgtttccgtggcgatgcccgcggcttgcgccgtggaaatgattcacaccatgtcgttaatccacgatgacctcccatgtatggataacgacgatctccgccgcggaaaaccgacgaatcacaaggcattcggcgaggatatcgccgtattagccggggacgcgctgctgtccttcgcattcgaacacgtggcggtgtccacggtgggggcctcgccggataaaattgtccgggcggtgggggaattagcaaaagcagttgggaaagaagggttagtagccggacaagtagtggatataaccagtgagggactaaacgacgtcggattggatcatttggagtacatccatgtccacaagaccgccgtattactcgaggccgcggtggtgctcggggcgattttgggcggaggaacggatgaggaagtggagaggttgaggaaatttgcgatatgcattggtctattgtttcaagtggtggatgatatcttggatgtgacgaaatcttccgtggaattggggaaaaccgccggaaaagatttagtcgcggataaggtgacgtatccgaagctaatggggctggagaagtcgagggagttcgccgagaagctgagggatgatgcggtggagcagttgcgggtgtttgatcaggtgaaggcggcgccgttgattgctttagcacattacattgcttataggcaaaactagtttcatttgttgttaagaaaactatgaatgaaagaagcataaaagattatagttcaaaaaaaaaaaaaaaaaaaaaaaaaaaaaaa

SEQ ID NO: 13592 - protein, 369 aa, Cistus incanus subsp
MSTVNVNLGSWSQPTCFVFNQKTRSRIPNFSSFKGFMASSSNFRSVSSSSSSSSSFIASVLSGKDTMKGEEENSGFDFQSYMDQMADSVNQALESAVSLREPLKIHEAMRYSLLAGGKRVRPLLCIAACELVGGDVSVAMPAACAVEMIHTMSLIHDDLPCMDNDDLRRGKPTNHKAFGEDIAVLAGDALLSFAFEHVAVSTVGASPDKIVRAVGELAKAVGKEGLVAGQVVDITSEGLNDVGLDHLEYIHVHKTAVLLEAAVVLGAILGGGTDEEVERLRKFAICIGLLFQVVDDILDVTKSSVELGKTAGKDLVADKVTYPKLMGLEKSREFAEKLRDDAVEQLRVFDQVKAAPLIALAHYIAYRQN

SEQ ID NO: 13593 - DNA, 1456 bp, Cistus incanus subsp
  CDS (168)..(1262)
gatacaaatccatttcacctgattaataaaacctaaaatctagattatcttccttaatcccctccattctatcccctcactccgacataagaaaacctcagcaattatcacaactatctttccgccgcccacgattctctaaatccaaacctccggcaagtccgaaaatgactactgttagcatcagttcgtgggttcaaacctactgtgtctttaaccaggcaaccagatccagatccagatccagatccccttctttcaatagattcaatctcccgataattccggtctcaaaaccgttccgcttcttccgcccctctaatcgcctcggtactcaccagagaaggcgaatcgaacaagatcccccaaaatgggccttcgatttaaagtcctacatgattcagaaggcgaattccgtgaatcaagccctagaaaccgccgtttcgctccgggagccgctgaagatccacgaggcgatgaggtactcggttttggccggcgggaagcgagttcggccggtgctgtgcatcgccgcatgcgagctcgtcggcggtgaggaatccatggcgatgcccgcggcttgcgccgtggaaatgattcacaccatgtcgctcatccacgacgaccctccctgtatggataacgacgatctccgccgcggaaaaccaacaaaccacaaggtattcggcgaggatatcgcggtgttagccggggacgcgcttctcgctttctcattcgagcacatgacggggtccacagttggcgtatcccccgcccgaattgtgcgggcggttggggaattagcgaaatcgattggttcggaaggattggtagctggccaagttgtggatatctgcagtgagggccttacagatgtaggcttggaacatttagagttcatccatgtgcataaaacggcggccttactcgaaggctcggtggttctgggagcaattcttgggggcggatcggatgaggaagtggagaaattgaggaaatttgcgaggtgcattggattattgtttcaggtagtggatgatattctggatgtgacgaaatcttcaacagaattggggaaaacggctgggaaagatctggtggcggataaggtgacatatccgaagctaatggggatcgagaaatcgagggagtttgcggaggagctgaagaatgatgcggtggagcagttgagagggtttgatcaggagaaggcggcgcctttgattgctttggctaattacattgcttataggcagaattagttgtacaacttggtggattggatcattgaaagtggaatttaatttagcggattcgtgttgtagtagatgattattaagttctatagcgactgcaatgagacagatgtattgctttcttgattgaaagcaatgaatattaatgtgggaatgataagaaattccctttttgatgaaaaaaaaaaaaaaaaaaaaaa

SEQ ID NO: 13594 - protein, 364 aa, Cistus incanus subsp
MTTVSISSWVQTYCVFNQATRSRSRSRSPSFNRFNLPIIPVSKPFRFFRPSNRLGTHQRRRIEQDPPKWAFDLKSYMIQKANSVNQALETAVSLREPLKIHEAMRYSVLAGGKRVRPVLCIAACELVGGEESMAMPAACAVEMIHTMSLIHDDPPCMDNDDLRRGKPTNHKVFGEDIAVLAGDALLAFSFEHMTGSTVGVSPARIVRAVGELAKSIGSEGLVAGQVVDICSEGLTDVGLEHLEFIHVHKTAALLEGSVVLGAILGGGSDEEVEKLRKFARCIGLLFQVVDDILDVTKSSTELGKTAGKDLVADKVTYPKLMGIEKSREFAEELKNDAVEQLRGFDQEKAAPLIALANYIAYRQN

SEQ ID NO: 13595 - DNA, 1243 bp, Corynebacterium glutamicum
  CDS (101)..(1216)
atgatgcctgggtatcttagtgtgatgagagtgttttgttgggactgcctctggcatttattcacctccaccaaaattcagcccgcatccccctattcgaatgaaggacgtctccttgagcagtttcgatgcccatgaccttgacctcgacaaatttccggaggtcgtgcgagatcgtttgacgcagttcctcgatgctcaagagctaacaattgctgatatcggcgctcctgtcacagatgctgtggcccatcttcgcagtttcgtgctcaatggaggaaagcgaatccgtcctctttatgcgtgggctggtttcctggcggcgcaaggccataagaattcttctgaaaaacttgagtccgtccttgacgccgcagcgagtctcgaattcatccaggcttgtgccttgattcatgacgatattatcgattcttctgatacccggcgcggagcccccacagttcaccgggctgtggaagctgatcaccgcgccaataatttcgaaggcgatcccgagcactttggcgtttcagtctcgattttggctggcgatatggcattggtgtgggcagaagacatgctgcaggattccggtttgagtgcagaggcattggcccgcacgagggatgcttggcgtggcatgcgtactgaggttattggcggccagctgcttgatatttatctagagtcgcacgccaacgagtcggtggagcttgcggattctgtcaaccgcttcaaaacggccgcttacacgattgcgcgcccattgcacctgggcgcctccattgctggcggttcgccgcagcttatcgacgcgctcctccactacggccacgacatcggcattgcattccagttgagggatgatctgcttggtgtgtttggggatcccgctatcaccggcaaaccagctggagacgatatccgtgaaggcaagcgcactgttcttcttgcgctcgctctacaacgcgctgataagcaatctcctgaagctgcaacggccattcgcgcaggtgttggaaaggtgacttcaccagaagatattgctgtcattacagagcatattcgagctactggtgctgaagaagaagttgagcagcgaatttcccagctgactgaatccggtttggctcacctcgatgatgtagacatccccgatgaggtgcgcgcacagttgcgggcactggctatccgctcaaccgaacgtcggatgtagtagacgcgtatgacactttttcaacgt

SEQ ID NO: 13596 - protein, 371 aa, Corynebacterium glutamicum
MKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 13597 - DNA, 873 bp, Streptococcus pyogenes
  CDS (1)..(873)
atggacaaattagctagaattgacgaagccattcgtcgctactataagacgactagtaacggtgtatctgaagagttgattgatgctatcttgtattctgttgacagtggtggcaagcgcattcgcccacttatcttattagagatgattgagggatttggggtatcgttacagaatgctcattttgatttggctgcagcccttgaaatgattcatacaggaagtctgattcacgatgatttgccagccatggataatgatgattaccgacgtggtagactgaccaatcacaaacaatttggagaggctactgctattttggcgggagatagcttatttttagacccctttgggttaatagctcaagctgaattaaatagcgaggttaaagtagccttaatccaagaactttccctagcttcaggaacttttggcatggttggtggtcagatgctagatatgaaaggggaaaatcaagctttgagtctctctcagttgtcactgattcacctcaataaaaccggaaaattattaacttttccttttaaagcagcagctcttgtaacagaacaggctattactgttcgtcaacaactagagcaggcgggaatgctcatcgggcatgcctttcagattagggatgatattttagacgtgacagctagctttgaagatcttggaaaaacgcctaaaaaggacttattcgcagaaaaagctacttacccaagtttactggggttagaagcctcttaccaactgttgacagagagtttagatcaggctttgacgatttttcagacactagaaagcgatgtaggctttaagcctcaaataattacaaaactgatagaagggttacgacttaatgcctaa

SEQ ID NO: 13598 - protein, 290 aa, Streptococcus pyogenes
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLSQLSLIHLNKTGKLLTFPFKAAALVTEQAITVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 13599 - DNA, 999 bp, Xanthomonas campestris
  CDS (1)..(999)
atgaccatcgcccaagacctccccaccgtactgggcctgccccagatccagtccctcgccgcgcccgacatggcggcggtcgatgccttgatccgccgccgtctggcgtcggacgtcgtgctgatcaaccagattgccgatcacatcatctccgccggcggcaaacgcctgcgcccgatgctggtgatgctggccggccacgccgcgggcggctccgggccggagcaccaccagctcgcggcgatcatcgagttcatccatacctccacgctgctgcatgacgacgtggtggacgaatcagacctgcgccgcggccgcagcaccgccaatgcgctatggggcaacgcgcccagcgtgctggtgggcgatttcctgtattcgcgcagcttccaactgatggtcgaactggaccgcatggaagtaatgcagatcctggccgacaccaccaaccgcatcgccgaaggcgaagtgctgcagctcttgcatgtacacaaccccgacaccgatgaagccgcgtacctgcgcgtgatcgagcgcaagaccgcggtgctgtttgccgccggcacgcgcctgggcgcactggcctcgggcgcggatgcgcaggtgcagcagtgcctgtacgactacggcatgcagctgggctttgcgttccagatcgccgacgacgtgctcgactacgccgcagatgccaccgacctgggcaagaacctgggcgacgacctggccgagggcaaggccaccctgccgctgatccacgccattgcgcattccgatgccgccacccagcagcgcctgcggcagatcgtcgaacagggcgatgccgaggcgatgccggaggtgttgacggccatccgcgcaaccggcgggctcgattacagccgccagcgcgctgccgaatatgccgccgccgccgaacaggccctggacggcttgccgccgagcccggcagtggccgcattacgcggcctggcgcgttatgcggtggaacggacgcactga

SEQ ID NO: 13600 - protein, 332 aa, Xanthomonas campestris
MTIAQDLPTVLGLPQIQSLAAPDMAAVDALIRRRLASDVVLINQIADHIISAGGKRLRPMLVMLAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGADAQVQQCLYDYGMQLGFAFQIADDVLDYAADATDLGKNLGDDLAEGKATLPLIHAIAHSDAATQQRLRQIVEQGDAEAMPEVLTAIRATGGLDYSRQRAAEYAAAAEQALDGLPPSPAVAALRGLARYAVERTH

SEQ ID NO: 13601 - DNA, 876 bp, Xanthomonas campestris
  CDS (1)..(876)
atgagcgcggcgttgtttgagcgctgggttgctcgcaccgaacggcagctggacgcctgccttcccagccccgccctcgccccgcagcgtctgcacgcggccatgcgccacgccgtgctcggtggcggcaagcgcatgcgtccgctgttggtctatgcaagcggtgccttgttcggcgccgaagaaggcagcctggatgcgccggcggtggcggtggaactgatccacgcgtattcgctggtgcacgatgacctacccgcgatggacgatgacgcgctgcgtcgcggccaccctacggtgcacatcgccttcgacgaagccactgcgatcctggccggcgatgccttgcaggcacgcgcattcgaactgctggccgaggcaccggcagatgcggcactgcgggtgggctggttgcagagcctggcatctgccgccggtgcggccggcatgtgtggcgggcaggcgctggatatcgacgccaccgggcaggtgcaggcgctggaggcactgcagcgcatgcatgcactcaagaccggtgcgctgatccgcgccgcggtgcgcatgggcgtgctgacaggcggcgcgggtattgccgaccagcagcgcctggatgcgtttgccgacgcgctggggctcgcgttccaggtgcgtgacgacatcctggatgtggaatcaagctccgcccagctcggcaagactgccggcaaggatgcggcgcagtccaagtccacctaccccgccttgctgggcatggacggcgccaaaaccaagctggcggaactggccagccatatgcatgcgctgttgctgccctacggcgaatccggcgccaccttggccagcctcggccgcttcgcggtcgaccgcgcccactag

SEQ ID NO: 13602 - protein, 291 aa, Xanthomonas campestris
MSAALFERWVARTERQLDACLPSPALAPQRLHAAMRHAVLGGGKRMRPLLVYASGALFGAEEGSLDAPAVAVELIHAYSLVHDDLPAMDDDALRRGHPTVHIAFDEATAILAGDALQARAFELLAEAPADAALRVGWLQSLASAAGAAGMCGGQALDIDATGQVQALEALQRMHALKTGALIRAAVRMGVLTGGAGIADQQRLDAFADALGLAFQVRDDILDVESSSAQLGKTAGKDAAQSKSTYPALLGMDGAKTKLAELASHMHALLLPYGESGATLASLGRFAVDRAH

SEQ ID NO: 13603 - DNA, 999 bp, Xanthomonas axonopodis
  CDS (1)..(999)
atgaccatcgccgaagacctccccaccgtgctgggcctgccccagatccagtccctcgccgcgcccgacatggccgcggtcgacgcactgatccgccgccgtctggcctcggacgtcgtgctgatcaaccagatcgccgatcacatcatctccgccggcggcaaacgcctgcgcccgatgctggtgatgctggccggccatgccgctggcggctccggcccggagcaccaccaactggcggcaatcatcgaattcatccatacctccacgctgctgcacgacgacgtggtggacgaatcggacctgcgccgcgggcgcagcaccgccaacgcgctatggggcaatgcgcccagcgtattggtgggcgacttcctgtactcgcgtagcttccagttgatggtcgaactggatcgcatggaagtcatgcagatcctggccgacaccaccaaccgcatcgccgaaggcgaagtgcttcagctgttgcatgtgcataaccccgacaccgacgaagcggcgtacctgcgcgtgatcgagcgcaagaccgcagtgctgttcgccgccggcacgcgtctgggtgcgcttgcctccggcgcaagcgcgcaggtgcagcagcagctgtacgactacggcatgcagctgggcttcgccttccagatcgccgacgacgtactcgactacgccgccgaggccgcggacctgggcaagaacctgggcgacgatcttgccgagggcaaggccaccctgccgctgatccacgcgatggcgcactcggatgcgaccacccgtgagcgcctgcgacagatcgtcgagcaaggcgatgccgcggcgatgccggaagtgctggccgccatccgtgccaccggcgggttggactacagccgtcaacgcgcggccgaatacgccgccgccgccgaacaggctctggaaaccctgccgcacagcgctgccgtggcggcgctgcgcggcctggcgcgctacgcggtcgagcgtacccactga

SEQ ID NO: 13604 - protein, 332 aa, Xanthomonas axonopodis
MTIAEDLPTVLGLPQIQSLAAPDMAAVDALIRRRLASDVVLINQIADHIISAGGKRLRPMLVMLAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGASAQVQQQLYDYGMQLGFAFQIADDVLDYAAEAADLGKNLGDDLAEGKATLPLIHAMAHSDATTRERLRQIVEQGDAAAMPEVLAAIRATGGLDYSRQRAAEYAAAAEQALETLPHSAAVAALRGLARYAVERTH

SEQ ID NO: 13605 - DNA, 876 bp, Xanthomonas axonopodis
  CDS (1)..(876)
atgagctcggcgttgttcgaccactggatcgcccgcaccgaacgcagcctggaggccggcttgccgagcgccacgcatgcgccgcagcgcctgcatgcagcgatgcgccacgccgtgctgggcgggggcaagcgcatgcggccgctgctggtctacgcaagcggcgcattgttcggtgccgctgaggatcaactcgacacgcccgcggtggcagtagagctgattcacgcttattcgctggtgcacgacgatttgccggcgatggacgacgacgcgctgcgacgcggccagcccaccgtgcatatcgccttcgacgaggccaccgcgattctggccggcgatgccttgcagacgcgcgcgttcgaattactcgccgctgcctctgccagcgccgaactgcgcgtgggctggatgcagagcctggccaccgcggcgggcgcggccggcatgtgcggcggccaggcgctggacatcgatgcgaccgggcaactgcaatcgctgcagcacctgcagcgcatgcatgcgctcaagaccggcgcgttgatccgcgcagcggtacggatgggcgcactgaccggaggcgcagcgttggccgaccagcagcgcctggacgaatttgccgacgcgctgggcctggccttccaggtgcgcgacgacatcctggatgtggaatcgagctcggcgcagctgggcaagaccgccggcaaggacgcggcgcaatccaaatccacctaccccgccctgctggggatggacggcgccaaggcgaagctggccgaactggccgcgcgcatgcatgacgtcctgcagccctacgggcaaccaggcgagacattagccaccttggcccggtttgcggtgaaccgcgcgcactag

SEQ ID NO: 13606 - protein, 291 aa, Xanthomonas axonopodis
MSSALFDHWIARTERSLEAGLPSATHAPQRLHAAMRHAVLGGGKRMRPLLVYASGALFGAAEDQLDTPAVAVELIHAYSLVHDDLPAMDDDALRRGQPTVHIAFDEATAILAGDALQTRAFELLAAASASAELRVGWMQSLATAAGAAGMCGGQALDIDATGQLQSLQHLQRMHALKTGALIRAAVRMGALTGGAALADQQRLDEFADALGLAFQVRDDILDVESSSAQLGKTAGKDAAQSKSTYPALLGMDGAKAKLAELAARMHDVLQPYGQPGETLATLARFAVNRAH

SEQ ID NO: 13607 - DNA, 975 bp, Methanosarcina mazei
  CDS (1)..(975)
atgatgcttatgacgcttgttgatgaaattaaaaatcgaagttcccatgttgatgctgcaatcgacgaattgcttccggtaacccggcctgaagagctgtataaagcttcccgttacctcgtggacgccggtgggaagcgccttcgtccggcagtcctcatcctggctgctgaagctgtcggttccaatctcaggtctgttttgcccgcagcagtcgcggtggaacttgtgcacaatttcactctgatccatgacgacattatggatagggatgatatccgcaggggaatgcctgcagttcacgtaaaatggggagaagccggagcaattcttgccggcgacaccctttattccaaagccttcgaaatcctctcaaaagtcgaaaacgagcctgtgagggttttaaagtgcatggatgtcctttcaaagacctgcaccgaaatctgcgaaggccagtggctcgatatggatttcgaaacccggaaaaaggttactgaatccgagtaccttgagatggtggaaaagaagacctctgtcctctatgcagccgcagccaaaatcggcgcccttttaggaggggcttctgacgaagttgccgaggctttatccgagtacggacgcctcataggaataggcttccagatgtatgatgacgtccttgatatgaccgcacctgaagaagttcttggaaaggtaaggggcagcgaccttatggaaggaaaatacacccttattgtcataaatgctttcgagaaaggcgtgaagctggatattttcggaaaaggtgaagcaactctcgaagagaccgaagcggcagtcaggactcttacagaatgcgggtctctcgattatgtgaaaaaccttgcaatttcatatatagaagaaggcaaagaaaaactggatgtcctcagggactgtcctgaaaaaacccttctcctgcagattgctgactatatgatctcacgagaatactaa

SEQ ID NO: 13608 - protein, 324 aa, Methanosarcina mazei
MMLMTLVDEIKNRSSHVDAAIDELLPVTRPEELYKASRYLVDAGGKRLRPAVLILAAEAVGSNLRSVLPAAVAVELVHNFTLIHDDIMDRDDIRRGMPAVHVKWGEAGAILAGDTLYSKAFEILSKVENEPVRVLKCMDVLSKTCTEICEGQWLDMDFETRKKVTESEYLEMVEKKTSVLYAAAAKIGALLGGASDEVAEALSEYGRLIGIGFQMYDDVLDMTAPEEVLGKVRGSDLMEGKYTLIVINAFEKGVKLDIFGKGEATLEETEAAVRTLTECGSLDYVKNLAISYIEEGKEKLDVLRDCPEKTLLLQIADYMISREY

SEQ ID NO: 13609 - DNA, 885 bp, Thermoanaerobacter tengcongensis
  CDS (1)..(885)
atgtttaaagaaaaattcaaaaatttacaacagatggtggaggaagagcttcacaggatactggatgtacaggagaagccggagataatatacgaggcgatgagatacagcgtttttgcaggggggaaaagattgaggcctgttttgtgcctctctgcctgtgaacttttgggaggggatttaaaaaaagctttgccagtagcctgctctattgaactcatacacacttattctcttatccacgatgaccttcctgctatggataatgatgatttgagaagaggcaagcctacaaatcacaaggtatttggagaggccatagccattcttgccggggatggacttttaaacctgggatatgaggttttgataaggcatgctctggaaaatcccgaagattatgagaaaattttaaaagctgcgaatgaaatagctactgcttcaggttgtaagggaatcataggagggcaggtagaagatatactttctcaaaacacagaacttacctatgaagagctaaaatacatccacgaacacaagaccgcagctttgatagaggcttctgtctgtgcaggagcccatatggctggggctagtgaaaaagaagtggagcttttgagagaatacgctgggctaatagggctggcatttcagataaaagacgacatactggatgtaataggagatgaaaaaacgcttggcaaaaaagtggggagcgacagggaaaaaggcaagtttacttttgtcaacatattcggcgttgaaaaatcccaagaaatggtaaaggagcttacagatgaagctataaagattttggacacttttggcgaaagggcacagtttcttaaagacctctctaattatttgattgagagagtaaactga

SEQ ID NO: 13610 - protein, 294 aa, Thermoanaerobacter tengcongensis
MFKEKFKNLQQMVEEELHRILDVQEKPEIIYEAMRYSVFAGGKRLRPVLCLSACELLGGDLKKALPVACSIELIHTYSLIHDDLPAMDNDDLRRGKPTNHKVFGEAIAILAGDGLLNLGYEVLIRHALENPEDYEKILKAANEIATASGCKGIIGGQVEDILSQNTELTYEELKYIHEHKTAALIEASVCAGAHMAGASEKEVELLREYAGLIGLAFQIKDDILDVIGDEKTLGKKVGSDREKGKFTFVNIFGVEKSQEMVKELTDEAIKILDTFGERAQFLKDLSNYLIERVN

SEQ ID NO: 13611 - DNA, 894 bp, Fusobacterium nucleatum
  CDS (1)..(894)
atgaatgatttccaagtttatttaaaagaaaaaactgatttttttgaaactgaattaaaaaaagaattaaaagaactttcctatcctgaaactattgctaagggtatggaatatgctattttaaatggtggaaagagattaagaccttttttactttttgtaacattagaattgttaaatgagaatataaataaaggtgtaaaatctgcaatagcattagagatgatacattcatattctcttgttcatgatgatttgccagctcttgacaatgatgattataggagagggaaattaacaacacataaagtttttggtgaagcagagggaatacttataggagattcacttttaacttatgctttttatgttctttctcagaaaaatttagaattgttgtcttctaaacagattgtgaatattatttcaaaaacttctgaatatgcaggaatagatggaatgataggtggacagatgatagatattcaaagtgaaaacaaaaaaatagatttggaaactttaaaatacattcatagtcataaaacaggaaagcttattaaacttcctattgagatagcttgtatcattgctaatttagaaaaagataaaagagaagttttagaagaatatgcagatttaattggtttggcttttcaagttaaagatgatattctggatgttgaaggaacttttgaagatttaggaaaacctgtgggcagtgatgttgatttacataaggctacttatccaagtattttagggatggaagaaagtaaaaaaattttaaataatactgttgaaaaagctaaggaaattattaaaaataaatttggagaagaaaaaggaaaagttttaatttctcttgcagattttataaaagatagaaaaaaataa

SEQ ID NO: 13612 - protein, 297 aa, Fusobacterium nucleatum
MNDFQVYLKEKTDFFETELKKELKELSYPETIAKGMEYAILNGGKRLRPFLLFVTLELLNENINKGVKSAIALEMIHSYSLVHDDLPALDNDDYRRGKLTTHKVFGEAEGILIGDSLLTYAFYVLSQKNLELLSSKQIVNIISKTSEYAGIDGMIGGQMIDIQSENKKIDLETLKYIHSHKTGKLIKLPIEIACIIANLEKDKREVLEEYADLIGLAFQVKDDILDVEGTFEDLGKPVGSDVDLHKATYPSILGMEESKKILNNTVEKAKEIIKNKFGEEKGKVLISLADFIKDRKK

SEQ ID NO: 13613 - DNA, 942 bp, uncultured proteobacterium
  CDS (1)..(942)
atgaacatcttatatgtcttgtttactttacaacaaaccttcccatcaatggaggcttatgccatggggaaagagtcactcgattgtgaacacaccctctcccttgccatacgcgaggctacaggacagggctgcccgccactgcttgcaaaagcgctggactatgctgtctttccgggcggcgctagggtacgacctcgcttgtgcctcgctgtagcactcgccaatggcaattcagagccgcgactggcgtctgctgctgccgcggctatcgagttgctgcattgcgcatcgctcgttcacgacgacctaccctgctttgatgatgccattgaacgtcgcggtaaaccctccctccatgctgctttcgggcaacgcatcgccgtactttcgggtgatgccctcatcgtggccgcttttcagcaattggcagagctcggttctagcgtgacccacccagtccgaatggcacaagtcactgcaattgtcgctgcgggagtgggcggacccatgggcatatgcgcaggacaggcgtgggaatgtgaaccccgagtcgagcttgagcactaccaccaagccaagacgggggccttgtttgttgcggcaacctgcgcgggcgcagctgcagcaggtgtgccctcagaaccctggcgcgaacttggcaacagcattggtgaagcctatcaggttgctgacgacattcaggacgccattgccgataccgccaccatcggcaaaccaacgggcattgatgtcgccctcgatagacccagtgccgtgcgggaactgggcctacagggtgcggtaaaacgtctagagcgttgtatcgaaaaagggctggactccatccccgcctgtaagggccgcgccctgctacatgacgttgtccaacaacaatcaaaccgttttttcccacagggcattaaacatacggcggcctaa

SEQ ID NO: 13614 - protein, 313 aa, uncultured proteobacterium
MNILYVLFTLQQTFPSMEAYAMGKESLDCEHTLSLAIREATGQGCPPLLAKALDYAVFPGGARVRPRLCLAVALANGNSEPRLASAAAAAIELLHCASLVHDDLPCFDDAIERRGKPSLHAAFGQRIAVLSGDALIVAAFQQLAELGSSVTHPVRMAQVTAIVAAGVGGPMGICAGQAWECEPRVELEHYHQAKTGALFVAATCAGAAAAGVPSEPWRELGNSIGEAYQVADDIQDAIADTATIGKPTGIDVALDRPSAVRELGLQGAVKRLERCIEKGLDSIPACKGRALLHDVVQQQSNRFFPQGIKHTAA

SEQ ID NO: 13615 - DNA, 975 bp, Methanosarcina acetivorans
  CDS (1)..(975)
atgatgcttatgatgcttattgatgagatcaaaaagagaagttcccatgttgatgctgcaattaacgaactgctcccggtaacccatccggaggagctttacaaagcttcccgctatctcgtggatgccggcggaaagcgccttcggccggcggtccttatcctggcagcagaagctgttggctccgatctcaagtccgttttgcctgcagccgtggcagtggagcttgtacataatttcactctgatccatgacgacattatggataaggacaatatccgcagagggatgcctgcagtccatgtcaaatggggtgaagccggagctatccttgccggagataccctttactccaaagctttcgagatcctctcaaaggtcgaaaacgatccggtaaggattttaaagtgtatggatgtcctttcaaagacctgtaccgaaatctgtgaaggccagtggcttgatatggacttcgaaaaaagagacagggtaactgaacttgaatatctcgaaatggtggaaaagaagacctccgtcctttacgcagccgcagccaagatcggagcccttctcggaggggcctcggacgaggtcgccgaatccctatccgaatatggacgccttatagggatcggtttccagatgtacgatgatgtcctggacatggtcgctcctgaagaagtgctcggaaaggttcgaggcagcgaccttatggaaggaaagtataccctcattgtcattgaagcctttggcaaaggcgtaacactggacattttcggaaaaggagaagccaccgtcgaagaaaccgaagctgccgtccggactctgaccgagtgcggatccatcgattacgtgaaaaatcttgcaatctcatatatcaatcagggaaaggcaaaactggacgtcctcagagactgtcccgaaaaagaccttctccttcagattgccgactatatgattgcaagggaatactga

SEQ ID NO: 13616 - protein, 324 aa, Methanosarcina acetivorans
MMLMMLIDEIKKRSSHVDAAINELLPVTHPEELYKASRYLVDAGGKRLRPAVLILAAEAVGSDLKSVLPAAVAVELVHNFTLIHDDIMDKDNIRRGMPAVHVKWGEAGAILAGDTLYSKAFEILSKVENDPVRILKCMDVLSKTCTEICEGQWLDMDFEKRDRVTELEYLEMVEKKTSVLYAAAAKIGALLGGASDEVAESLSEYGRLIGIGFQMYDDVLDMVAPEEVLGKVRGSDLMEGKYTLIVIEAFGKGVTLDIFGKGEATVEETEAAVRTLTECGSIDYVKNLAISYINQGKAKLDVLRDCPEKDLLLQIADYMIAREY

SEQ ID NO: 13617 - DNA, 975 bp, Methanopyrus kandleri
  CDS (1)..(975)
atgcggagtgagatactgaaagagctgaaccgtgcacgcgagctcgtcgacgccaagattgaggaggtactacccagaggaggcccagaggacctctacgatgcgtgttggcacctaatcgaagcgggaggtaagcgaatccgacccctcctcgccatcaaatcgtgtctcatgttaggtggatcggaagaggacgtactccctgaagcggtcgcggtcgagctgattcatacgttcactctaattcacgacgacatcatggacgaagacgacgaacgacgcggagtcccggcggtacacgtgaagtggggagtaccggtagccatactggcgggagacaccctgttctccaaagccttcgaagtggcggcggaaggcggagacgtagaggcagtgaaagaactcgcccgcgcctgcacggagatctgtgagggccaagccatggacatcgggttcgagaacaggactgaagtcaccgaggatgagttcctcgaaatgatccggaagaaaacggcagcgctcatacggacatcgtgcgtcgtaggcgggcttaaagccggggcgaaccgcgagcaactggaagcgcttcgggagtacggcgagaacttggggatcgcgttccagatacaggacgacgtcctcgaccttgtcggagacgagtccgaactcggtaagcccgtgggcagcgacatcgtcgaggggaagaagacgctgatcgtgatcaagggcctggagctcgccgatgaggagcagcgggagcgcatactttcggtcctcgggaacgaggatgcttcacgcgaggacgttcgcgaggttattcagatactcgaagatctcggtgcgatagattacgctaaaaagcgggcccgagagtacgccgatcgcgctaaggctgcgctgcgcgagctccccgagaacgagcatcgggagttcctagaaaagttggcggatttcgttgtagagagggagttctga

SEQ ID NO: 13618 - protein, 324 aa, Methanopyrus kandleri
MRSEILKELNRARELVDAKIEEVLPRGGPEDLYDACWHLIEAGGKRIRPLLAIKSCLMLGGSEEDVLPEAVAVELIHTFTLIHDDIMDEDDERRGVPAVHVKWGVPVAILAGDTLFSKAFEVAAEGGDVEAVKELARACTEICEGQAMDIGFENRTEVTEDEFLEMIRKKTAALIRTSCVVGGLKAGANREQLEALREYGENLGIAFQIQDDVLDLVGDESELGKPVGSDIVEGKKTLIVIKGLELADEEQRERILSVLGNEDASREDVREVIQILEDLGAIDYAKKRAREYADRAKAALRELPENEHREFLEKLADFVVEREF

SEQ ID NO: 13619 - DNA, 1023 bp, Pyrococcus furiosus
  CDS (1)..(1023)
atgtatgatgagctttttaaaaagataaaggagaaggctaagtttgttgatgaaaaactgctctctctaatccctgaaaaggaaccaaagattctttatgaagccgcaaggcactatcccctggctggtggaaaaagggttaggccatttgttgttttaacggcaactgaagctgtggggggagagtgggaaaaggcaatatacccagctgtagctatagaactaattcataattactccttagtgcatgacgatattatggatatggatgaaactaggaggggaaggcccacagttcataaggtttggggaatcaacatggcaatattagctggagatctgctcttcagcaaggcctttgaggctatttcgagggcagagataccaccggaaaagaaggcaagagttcttgaaacagttgtaaaggcatcaaatgagctttgtgaaggtcaagctatggatttagaatttgagaagagggacaccgtaacaatagaagagtacatgaggatgataagtgggaagacaggggctttgtttgatgcatctgcaaaggttggaggaatagttgggactgacaacgaagaatacattaatgcactatcaacttggggaagaaacgttggaatagcctttcagatttgggacgatgtccttgacttgattgccgacgaggagaagctcggaaagcctgtggggagcgatattagaaagggcaagaaaaccctaatagttgcccacttcttcgaaaacgccgatgaaaaagataagcagaagttcctgaaagttttcggaaagtacgctggagatgtaaagggggaggggataatagaggaagacatcaaggcagaagtcatggaggcaatagatttgcttaagaaatatggaagtatagattatgccgccaacattgctagagagatggtaaagaaggcaaatgaagcccttaaggttcttcctgagagtgaggctaggaaagatttagaactgctagctagattcattgttgaaagggagtattaa

SEQ ID NO: 13620 - protein, 340 aa, Pyrococcus furiosus
MYDELFKKIKEKAKFVDEKLLSLIPEKEPKILYEAARHYPLAGGKRVRPFVVLTATEAVGGEWEKAIYPAVAIELIHNYSLVHDDIMDMDETRRGRPTVHKVWGINMAILAGDLLFSKAFEAISRAEIPPEKKARVLETVVKASNELCEGQAMDLEFEKRDTVTIEEYMRMISGKTGALFDASAKVGGIVGTDNEEYINALSTWGRNVGIAFQIWDDVLDLIADEEKLGKPVGSDIRKGKKTLIVAHFFENADEKDKQKFLKVFGKYAGDVKGEGIIEEDIKAEVMEAIDLLKKYGSIDYAANIAREMVKKANEALKVLPESEARKDLELLARFIVEREY

SEQ ID NO: 13621 - DNA, 912 bp, Pantoea agglomerans pv
  CDS (1)..(912)
atgatgacggtctgtgcagaacaacacgtcaatttcatacacagcgatgcagccagcctgttgaacgacattgagcaacggcttgatcagcttttaccggttgaaagcgaacgtgacttagtgggcgctgccatgcgcgacggtgcgctggcaccaggaaagcgtatccgtccactgctgttgttgctggcagcgcgcgatctgggctgcaacgccacgcctgccggcctgctcgatctcgcctgcgcggtagagatggtgcatgccgcatcactgattctggatgacatgccctgcatggatgatgcgcaactgcgtcgcggacgtccgaccattcattgccagtatggtgaacatgtcgcgattctggccgcggtggccctgctgagtaaggcattcggcgtggtcgctgcggcagaaggcttaacggcaaccgccagagccgacgctgtggcagaattatcccacgcagtcggcatgcaggggctggtgcaggggcaatttaaggatctctccgagggtgacaagccacgcagcgctgacgccattctgatgaccaatcactataaaaccagcacgctgttctgcgcctccatgcagatggcctctatcgtggctgaagcctcaggtgaagcccgcgaacagctgcaccgtttttcgcttaatcttggtcaggctttccagctactggacgatctcactgacggcatggccgacaccggtaaagatgcccatcaggatgacgggaaatcaacgctggtgaatctgctgggaccacaggcggttgaaacgcgactgcgcgatcatctgcgctgcgccagcgagcatctgttatcggcctgccaggacggttatgccacacaccattttgttcaggcctggtttgagaaaaaactcgctgccgtcagttaa

SEQ ID NO: 13622 - protein, 303 aa, Pantoea agglomerans pv
MMTVCAEQHVNFIHSDAASLLNDIEQRLDQLLPVESERDLVGAAMRDGALAPGKRIRPLLLLLAARDLGCNATPAGLLDLACAVEMVHAASLILDDMPCMDDAQLRRGRPTIHCQYGEHVAILAAVALLSKAFGVVAAAEGLTATARADAVAELSHAVGMQGLVQGQFKDLSEGDKPRSADAILMTNHYKTSTLFCASMQMASIVAEASGEAREQLHRFSLNLGQAFQLLDDLTDGMADTGKDAHQDDGKSTLVNLLGPQAVETRLRDHLRCASEHLLSACQDGYATHHFVQAWFEKKLAAVS

SEQ ID NO: 13623 - DNA, 1548 bp, Abies grandis
  CDS (58)..(1209)
tctgcttctgttggagttgatagcaggaaaaaatcaaagtagaaatagaacaaagatatggcttatagcggtatggcgactagctaccatggcctgcattttatgaatattgctactcaagaatgtaatttgaagagactttctatcccatcgagacgttttcatggagtttcaccatcattgtgggcttctaatggcttccaaggccatttaaagagggagttatccgcaaattcatttctggtatcatcatctagatactcaaacacaattgctaagtttactaatctgcctgaaaaagtaaaggagaaggtcattgaatttgacttcaaggagtatctacgttccaaggcaatggcagtgaatgaggcactggatagggctgtaccacttcgttatcctgaaagaatacatgaagctatgaggtattctcttctagcaggagggaagagggttcgtcctgttctgtgcatttcagcatgtgagcttgtgggagggaccgaggaagtcgccatgccaactgcctgtgcaatggagatgatccacacaatgtctttaattcatgatgacttgccttgcatggacaatgatgattttcgcagaggtaagcctacaaaccacaaggtcttcggggaaggcactgctattcttgcaggggatgcactgctttcatttgcatttgaacacattgcagtatccacaagcaaatctgtggggactgataggattttgagggtggtatctgaattgggtagaacaataggctcccaagggcttgtgggtgggcaggttgctgatattacgagtgagggcgatgcttctgttgaccttgacactctggaatggattcacattcataagactgcagtgctattggagtgctcagttatgtgtggggcgatcattagtggtgcttcagacaatgagattgagagaattcaaagatatgcccgtagcgtggggcttctgtttcaggttgttgacgacatactcgacgtcacgaaatcatcaaaagagttgggcaaaactgcaggaaaggatttgatcagtgataaggccacttatccgaagctgatgggtttagagaaagcaaaacaatttgcttcggatttgttgatcagagctaaggaggatttatcttgcttcgacccaatgaaggctgcaccattgttgggtcttgcagattacattgcattcagacaaaactgaagagcctctaaaagtgttcttatgtatgcgttctgtgctttgtttttacatctactacaacctagaaaataacatatgtaacatcatgtctctttgagttgtgatgatggataatagaatggttccaataggaagtaatgcctggatctaggtccaaggaaccagtcccatgttcttatgtaggagttcctttaacctttagaccaatttatctttgatgttattcttgttgccagagaaaagagttctcacagctaagcttagcctggagaatatcggctggttgcttgattcaagtaaatatagtttaacctatgttaaatgaaaaaaaaaaaaaaa

SEQ ID NO: 13624 - protein, 383 aa, Abies grandis
MAYSGMATSYHGLHFMNIATQECNLKRLSIPSRRFHGVSPSLWASNGFQGHLKRELSANSFLVSSSRYSNTIAKFTNLPEKVKEKVIEFDFKEYLRSKAMAVNEALDRAVPLRYPERIHEAMRYSLLAGGKRVRPVLCISACELVGGTEEVAMPTACAMEMIHTMSLIHDDLPCMDNDDFRRGKPTNHKVFGEGTAILAGDALLSFAFEHIAVSTSKSVGTDRILRVVSELGRTIGSQGLVGGQVADITSEGDASVDLDTLEWIHIHKTAVLLECSVMCGAIISGASDNEIERIQRYARSVGLLFQVVDDILDVTKSSKELGKTAGKDLISDKATYPKLMGLEKAKQFASDLLIRAKEDLSCFDPMKAAPLLGLADYIAFRQN

SEQ ID NO: 13625 - DNA, 1482 bp, Gentiana lutea
  CDS (88)..(1191)
ttcacctttctttcctcctcgtaatcaaacaaatcttcctttcttgcttcacgaaattcgtattcttgaaaacatcagatctatgacatggtggattcatgggtggttcaaagccactctgtatttcatacccctatatccctttttagatcttttcttggatttctgtgcaaacccatgaattacaacaaaattggatcgaatttgatagagaaaaagaagctcatttcatcgttttcagtagcatctttgattactaaagaagaagaagccatgggaggtccaaaagcttccaattatttcgattttaaggcctatttgattgaaaaagctaataaagtaaatgaagctttggatcaagcggtttctgtgaagaacccaccgatgattcatgaagcaatgcgctattccttgttagccggcggcaaaagagttcgtccaatactttgtatcgcagcgtgtgagctcgtcggaggtgaagaatcaaattctgttccggcagcttgtgcggtggagatgatacacaccatgtcgttaattcacgacgatttgccgtgttatggacaacgagatctccgacgaggaaaagcccacgaaaccacaaagtcttcgtgcgaggacgtagcggtcctcgccggcgattcccttctagcattctcattcgaatacatcgccaccgccactaaaaacgtctctccggcgaagaattttagccgcagtaggcgaattagcaaatcaattgggacagaaggcttagtagctggccaagtagctgattttgtcattaatggggaaaaccagatgtttggattagaccaattggagttcatccacatccacaaaacggcagctttactggaagcagcggtggtgctcggcgcaatcctgggcggcggaaacccagaagaggttgagaaattgagacgttttgctaggtgtattgggctattgtttcaagtggttgatgacattcttgatgtaacgaaatcatctgaagaattggggaaaactgcagggaaaagatcttgtggcggaaaaactacttatccgaaattaatgggtttagatggagctagagagtttgctgataaattgaacaaagatgcgaaaaatcagttgtcggaatttgatcgtgaaaaggccgctcctttgcttgctttggcggattatattgcgtataggcagaattagggggattttgattgaagaacgacccggatttggaagtcgggttcgggtttttgttgtttgttgtaacctttggtggtgttgtattagatttattttagtattaaaaaagggttaacaacggtatggaatgtaaggaatctaccttcaaaaaaaaatgtactgaatcattgaaatgattcagtcattttcttgtgtttagattgatttcggtttggaatatgctactatcataaatcttgtgtcaaaataagtaatatatattgatgatttttgaaaaaaaaaaaaaaaaaa

SEQ ID NO: 13626 - protein, 367 aa, Gentiana lutea
MVDSWVVQSHSVFHTPISLFRSFLGFLCKPMNYNKIGSNLIEKKKLISSFSVASLITKEEEAMGGPKASNYFDFKAYLIEKANKVNEALDQAVSVKNPPMIHEAMRYSLLAGGKRVRPILCIAACELVGGEESNSVPAACAVEMIHTMSLIHDDLPCYGQRDLRRGKAHETTKSSCEDVAVLAGDSLLAFSFEYIATATKNVSPAKNFSRSRRISKSIGTEGLVAGQVADFVINGENQMFGLDQLEFIHIHKTAALLEAAVVLGAILGGGNPEEVEKLRRFARCIGLLFQVVDDILDVTKSSEELGKTAGKRSCGGKTTYPKLMGLDGAREFADKLNKDAKNQLSEFDREKAAPLLALADYIAYRQN

SEQ ID NO: 13627 - DNA, 906 bp, Clostridium perfringens
  CDS (1)..(906)
atgaaaaagaggaagactttggaggatacagcaatgaatattaatagcttaaaagaggaagttgatcaatctttaaaagcttattttaataaagatagagaatacaataaagttttatatgattcaatggcatatagcataaatgtagggggaaaaagaataagaccaatcttaatgcttttatcttactatatttataaaagtgattataaaaaaatattaacacctgcaatggccatagaaatgatacacacttattctttaatacatgatgatttaccatgtatggacaatgatgatttaagaagaggaaaacctacaaatcataaggtttttggagaagctattgctgttttagctggagatgcccttttaaatgaagctatgaaaattttagttgattattctttagaagaaggaaaaagtgcattaaaggcaactaaaataattgcagatgcagcaggatcagatggaatgattggtgggcaaattgttgatataataaatgaagataaggaagaaatttctttaaaagaattagattatatgcatttaaagaaaactggagaacttataaaagcttcaataatgtctggagcggttttagcagaagcttcagagggagatattaaaaaattagagggttttggatataagttaggcttagcatttcaaataaaagatgatatattagatgtagtgggaaatgcaaaagatttagggaagaatgttcacaaagaccaagaaagcaataaaaataattatataaccatttttggattagaagaatgtaagaaaaaatgcgtgaatataactgaggaatgtatagagatattaagttcaataaaaggaaatacagagcctctaaaagttttaaccatgaaacttttagagagaaaattttaa

SEQ ID NO: 13628 - protein, 301 aa, Clostridium perfringens
MKKRKTLEDTAMNINSLKEEVDQSLKAYFNKDREYNKVLYDSMAYSINVGGKRIRPILMLLSYYIYKSDYKKILTPAMAIEMIHTYSLIHDDLPCMDNDDLRRGKPTNHKVFGEAIAVLAGDALLNEAMKILVDYSLEEGKSALKATKIIADAAGSDGMIGGQIVDIINEDKEEISLKELDYMHLKKTGELIKASIMSGAVLAEASEGDIKKLEGFGYKLGLAFQIKDDILDVVGNAKDLGKNVHKDQESNKNNYITIFGLEECKKKCVNITEECIEILSSIKGNTEPLKVLTMKLLERKF

SEQ ID NO: 13629 - DNA, 969 bp, Ralstonia solanacearum
  CDS (1)..(969)
atgcccgcctccgtcctgctcgcccccgtcgccgaagacatgcacgccgtcgatgccgtgatccggcgccgactcggctcggaggtcgcactgatcaaccagatcggcgaatacatcatcagcgcgggaggcaaacgcctgcgtccggtgatcctgctgctgatggcaaacgcactgggctatcgcggccagcaccattacgaactggcggcggtggtcgagttcatccataccgccacgctcctgcacgacgacgtggtcgacgaatccgagctgcgccgcggccgccagaccgccaacgcggtgttcggcaacgcagccagcgtgctggtgggcgacttcctctactcgcgcgccttccagatgatggtgcaggccgacagcatgcgcgtcatgcagatcctggccgatgccaccaacgtcatctccgaaggcgaggtgctgcaactgctcaacatgcacgacccggacgtgacggaggagcgctacctgcaggtgatccgctacaagaccgccaagctgttcgaggccgcggcgcagatcggagccgtgctctcgggcgccgacgccgccaccgaagccgccgccgccgaatacggccggcgcatcgggaccgcgttccagatcgtcgacgacctgctcgactacaccgcgaccgccgaccagatgggcaagaacgccggcgacgacctgcgcgaaggcaaaccgaccctgccgctgatctatctgctgtcgcacggcaccgagacgcagcgcgcgctggcgcgccaggccatcgaacagggcggcaccgagcacttcgatgccatcttcgccgccatccaggcatcgggcgcgctcgagtacacgcgcaaggccgccgagcacgaggcttccgcagccgcggaagcaataattgcattacccccttcccaattccgccaaacgctgatagagttatgtgctttctcgctgcaacgtcagtcctga

SEQ ID NO: 13630 - protein, 322 aa, Ralstonia solanacearum
MPASVLLAPVAEDMHAVDAVIRRRLGSEVALINQIGEYIISAGGKRLRPVILLLMANALGYRGQHHYELAAVVEFIHTATLLHDDVVDESELRRGRQTANAVFGNAASVLVGDFLYSRAFQMMVQADSMRVMQILADATNVISEGEVLQLLNMHDPDVTEERYLQVIRYKTAKLFEAAAQIGAVLSGADAATEAAAAEYGRRIGTAFQIVDDLLDYTATADQMGKNAGDDLREGKPTLPLIYLLSHGTETQRALARQAIEQGGTEHFDAIFAAIQASGALEYTRKAAEHEASAAAEAIIALPPSQFRQTLIELCAFSLQRQS

SEQ ID NO: 13631 - DNA, 900 bp, Ralstonia solanacearum
  CDS (1)..(900)
atgagcgatttcgcccactggatggcctccgtcgttgcacggacggaaagcgcgctcgaacgcgccctgcccggcgaatcggtcgcgccgcagcgcctgcatgcggcgatgcgctatgccacgctgggggcgggcaagcgggtccgccccctgctcgcgcatgctgccggggcgctgggcgaggcatcgcccgaggcgctggacggcgtgagctgcgcggtggagatgatccacgcctattcgctggtccacgacgacatgccctgcatggacgacgatgacctgcgccgaggtcgcccgacggtgcatcgcgcctatgatgaagcgacggcgctgctggtcggcgacgctttgcagacccaggccttcatcgcgctggccgagctgggcgcggtgagcccggccacgcgcgccggactggtcggcgagttggcgcgcgcgtcgggttcgctcggcatggcgggcgggcaggcgatcgatctgcagagcgttggcgtggccctgtcgcaggatgcgctggagaccatgcaccgcatgaagaccggcgcgctgctgcgggcaagcctgcgcatgggcgccctgtgcgccggcgtgaatgccgcggcgctggaacaggtggacgcctacgcgggcgcggtcggactggcgttccaggtggtcgacgacattctcgacgtgacggccgacaccgccacgctgggcaagaccgccggcaaggacgaggccaacgacaagccgacctatgtgtcgatcctcggcctggagcgcgcgcgggcgctggccgatgcgttgcatgccgcggcgggcgcggcggtggcgcagctgtcccgcgaactgggtgaagcgcgcaccgccaggctggccgggatggccgacctgatcgtgtggcgtggccactga

SEQ ID NO: 13632 - protein, 299 aa, Ralstonia solanacearum
MSDFAHWMASVVARTESALERALPGESVAPQRLHAAMRYATLGAGKRVRPLLAHAAGALGEASPEALDGVSCAVEMIHAYSLVHDDMPCMDDDDLRRGRPTVHRAYDEATALLVGDALQTQAFIALAELGAVSPATRAGLVGELARASGSLGMAGGQAIDLQSVGVALSQDALETMHRMKTGALLRASLRMGALCAGVNAAALEQVDAYAGAVGLAFQVVDDILDVTADTATLGKTAGKDEANDKPTYVSILGLERARALADALHAAAGAAVAQLSRELGEARTARLAGMADLIVWRGH

SEQ ID NO: 13633 - DNA, 900 bp, Salmonella typhimurium
  CDS (1)..(900)
atggactttacgcagcagctacaggcttgcgtaacgcaagcgaatcaggcgctgagccgttttatcgcgccactgccctttcagaacactcccgtggtcgaagccatgcagtatggcgcattattaggcggtaaacgcctgcggccatttctggtttacgccaccggtcaaatgtttggcgtcagtacggcaacgctggatgcgccagctgcggcggtcgaatgcattcatgcctattcgctgatccatgacgacctgccagcaatggacgatgacgatttgcgtcgcggcctgccgacttgccatattaaatttggcgaagccaacgcaatcctggcgggagacgcgttgcagacgctggcgtttgccattatcagcgacgcgccgatgccggaagtcgccgatcgcgatcgtatcgcgatgatcgccgaactggcaaacgccagcggtatcgccggtatgtgcggcggtcaggcattggatctggcggcagaaggccagcggatcactctggacgcgctggaacgcattcatcgccataagaccggcgcgctcattcgcgccgccgttagacttggcgcattgagcgcgggcgataaaggacggaatactctgccgatacttgaccgctatgcagagagtatcggccttgccttccaggttcaggatgacattctggatgtggtgggcgatactgcaacgttaggtaaacgtcagggcgcagaccagcagcttggcaaaagtacctaccctgcacttctgggtcttgagcaagcccggaataaagcccgggacctgatagaggacgcccgtcagtcgttacatcagctggccgcgcaatcactggacacctcggcactggaagcgctagcgaactacataatccagcgtgataaataa

SEQ ID NO: 13634 - protein, 299 aa, Salmonella typhimurium
MDFTQQLQACVTQANQALSRFIAPLPFQNTPVVEAMQYGALLGGKRLRPFLVYATGQMFGVSTATLDAPAAAVECIHAYSLIHDDLPAMDDDDLRRGLPTCHIKFGEANAILAGDALQTLAFAIISDAPMPEVADRDRIAMIAELANASGIAGMCGGQALDLAAEGQRITLDALERIHRHKTGALIRAAVRLGALSAGDKGRNTLPILDRYAESIGLAFQVQDDILDVVGDTATLGKRQGADQQLGKSTYPALLGLEQARNKARDLIEDARQSLHQLAAQSLDTSALEALANYIIQRDK

SEQ ID NO: 13635 - DNA, 1005 bp, Pyrobaculum aerophilum
  CDS (1)..(1005)
atggacgtcctctcaaagctccacgcgaaatacggagaggcggtggagcaggcgttagaacggtacttgtccatcgacttggcgccggactttcgagacgccgttatgtaccaagtaaagacgggcggcaagaggctgaggcccctcctaactctggccacggcggaggcgatttccggccagtggaagccggcgcttccagccgccgccattgtcgagctaattcacaactactccctgatttacgacgacattattgacagaggagacttgcgcagagggatgcccacggtgagaaaggcctacggcgacaacgcggcgattctcatagggatttggtaccgcgaggccattgaagaggcagttttagacacgccaaagccaactctcttcgccagagaggtggctaaggtgattaaggcaatagacgagggagagaggctcgacatacttttcgaatacgcgggcagggaggatccctacttcgtcaaggccaggtggagggaggtgactttagacgactatataaaaatggtgtcgttaaaaaccggcgtgttaataggcgccgccgccaaatggggtgcgttgtcagtaagcgatgatgcagaaatagcagatgccgcgtggaacttcggcctaaacgccggggttgcctttcaagttattgacgacgtcctcgacatatacggagacccgaaaaaattcggcaaagaaataggcaaagacatcaaggaacacaagagggggaatgcagttgtggccgtggggctgtctaaactcccgccggacaaaagggacaggctgctccacatcttgtctctgcaaaacgtcggcgaggctgaggtgagggaggccgtgtcgttgttagattcagtaggcgcgagggaagaggcgttaaaaatcgcccacaagtacagggaagaggcggagcgccacttggccagaataccgaataacgagactctgagagagctactgtacttcatactggaaagacagtattaa

SEQ ID NO: 13636 - protein, 334 aa, Pyrobaculum aerophilum
MDVLSKLHAKYGEAVEQALERYLSIDLAPDFRDAVMYQVKTGGKRLRPLLTLATAEAISGQWKPALPAAAIVELIHNYSLIYDDIIDRGDLRRGMPTVRKAYGDNAAILIGIWYREAIEEAVLDTPKPTLFAREVAKVIKAIDEGERLDILFEYAGREDPYFVKARWREVTLDDYIKMVSLKTGVLIGAAAKWGALSVSDDAEIADAAWNFGLNAGVAFQVIDDVLDIYGDPKKFGKEIGKDIKEHKRGNAVVAVGLSKLPPDKRDRLLHILSLQNVGEAEVREAVSLLDSVGAREEALKIAHKYREEAERHLARIPNNETLRELLYFILERQY

SEQ ID NO: 13637 - DNA, 915 bp, Rhizobium meliloti
  CDS (1)..(915)
atgaaagacgagagatcatcctttccggcgcgcctcaagaccaacgcggtcgcggtcgaagcgctgctcgagacattgctcggtccggccgtgggcacgggcgaaatcgcccgcccggcaaacctgctcggagccatgcgccatggcgtgctcaacggcggcaagcggctgcggccttttctcgtcgccgaaagcacggccctcctcggcggcgatgcggaagcggcgctcagaacaggcgccgcgctcgaatgcatccactgctattcgctcgtccatgacgacctcccggccatggacgacgacgacatgcgccgcggaaagccgacggtgcacgtcgccttcgacgaggcgacggcgatccttgcgggcgacagcctgctgaccttcgccttcgacatcgtcgcggcgccggaaacggcgctctccgaccgtcagaagacgacgctcgtgctggcgctcgcgcgcgccgcggggcatgggggcatggccggcggtcaggcgctcgacctagccgccgaaaagagcgcccccgacgaagcgggcatcgtcctcttgcagtcgatgaagacaggtgccctcatccgcttcgcctgcgaggcgggcgcgatcatcgccgatgcgccggcagaggaccgccgacggctgcgcgccttcggggacaagatcggcctcgccttccagcttgccgacgacctgctcgacctcaccgccgatgccgcaatcgtcggcaaggcgaccggcaaggatgccgcacgggggaagggcacgcttgtctccctgcatggccagccctgggccgagcggcggctcgaaagcctggtggccgaggcggaaggcctgctcgaaccctacggaccacgctcggcgatccttgccgaaaccgcccgcttcatcgccaaccgcaggaactga

SEQ ID NO: 13638 - protein, 304 aa, Rhizobium meliloti
MKDERSSFPARLKTNAVAVEALLETLLGPAVGTGEIARPANLLGAMRHGVLNGGKRLRPFLVAESTALLGGDAEAALRTGAALECIHCYSLVHDDLPAMDDDDMRRGKPTVHVAFDEATAILAGDSLLTFAFDIVAAPETALSDRQKTTLVLALARAAGHGGMAGGQALDLAAEKSAPDEAGIVLLQSMKTGALIRFACEAGAIIADAPAEDRRRLRAFGDKIGLAFQLADDLLDLTADAAIVGKATGKDAARGKGTLVSLHGQPWAERRLESLVAEAEGLLEPYGPRSAILAETARFIANRRN

SEQ ID NO: 13639 - DNA, 1017 bp, Rhizobium meliloti
  CDS (1)..(1017)
atgggcgtagtgataccgctggaagacaataaaaacaaacaggcatctgtgaagccgcttgtcgacctgacgctgtccgacatggagcgggtcaaccagctcattctttccaaggcgggctccgacgtccagatgatcccggaagtcgccaaccacctgatttcctcgggcggcaaacggctccggccgatgctgacgctcgcagccgcttcgatgttcggctacgagggagatggtcacatcaagctcgcgaccagcgtcgagttcatgcacacggcgacccttttgcacgacgacgtggtcgacgagagcgacctgaggcgcggcaaatcgacggcgcggacgatctggggcaaccaggcaagcgtgctcgtcggcgatttcctgctcgggcaggctttccgcatgatggtcgacgtcggctcgatcgatgcgctcgacgtcctttcgaccgccgcatcggtgatcgcggagggcgaggtcctgcagctttcggtcgccaagaacatggagacgaccgaggacgactatctgcaggtcatccgcgccaagacagcggccctcttcgccgccgcctccgaggtcgggccgatcgtcgcaggcggaagcaaagccgaccgcaacgcgctgaagtcctacggcaccaatctcggccttgccttccagctggtcgacgacgttctcgattatggcggcacgtcgagcgatctcggcaagaatgtcggagacgattttcgcgaaggcaagatcacactgccggtcattctctcctatcgccgcggcacgccgcaagaccgggcgttctggcgcgaggcgatcgagggcggcgcaagcgatgcggcaaatctcgaaaaggcgctgggtctcatccgtcgctacggggggcttacggatacgatcgcccgtgccaagcactacggcacgatcgcccgcgacgcgctcgcgccgctgccggcttcgccatggaaatcggcgctcgtcgaggtgatcgatttctgcatcgatcgggtaagctga

SEQ ID NO: 13640 - protein, 338 aa, Rhizobium meliloti
MGVVIPLEDNKNKQASVKPLVDLTLSDMERVNQLILSKAGSDVQMIPEVANHLISSGGKRLRPMLTLAAASMFGYEGDGHIKLATSVEFMHTATLLHDDVVDESDLRRGKSTARTIWGNQASVLVGDFLLGQAFRMMVDVGSIDALDVLSTAASVIAEGEVLQLSVAKNMETTEDDYLQVIRAKTAALFAAASEVGPIVAGGSKADRNALKSYGTNLGLAFQLVDDVLDYGGTSSDLGKNVGDDFREGKITLPVILSYRRGTPQDRAFWREAIEGGASDAANLEKALGLIRRYGGLTDTIARAKHYGTIARDALAPLPASPWKSALVEVIDFCIDRVS

SEQ ID NO: 13641 - DNA, 1681 bp, Xanthobacter sp
  CDS (348)..(1427)
ttccggcaacgcgcaatggacgaagcgcacccggtcaaagcccgcatccaagcgcgaggccacacgcccgcccgcgagcacgatgtcgatatggtcttccttgcgccgacccgcgccgctttcgtccatcgaccctcgccggcacccgccttcaaaacgacaacgcgttttgcctgaagccgcggcggtgacgccacacgccggcagaatctgtcgcgcggcgtgccgcgcgctctggcatccttccttaaggggtgatctaaagtcgttcaaggcaacgtattttggcaacctatcttgccagcaggggtacgccccagcagcacagcttaagatgaggggcgtggatggggcagaagggcggacgggaccggcggacctcggaaggttcgcacgacgtgctgcggccaggctcgtcccacggcgcgtcgcaaggtggttccaccctggtgctggccgtggcggagccggagacccgggcaccggaaggtcgcgtgcaggagctggaagagccggcaaccgccgccttcccgccgcgctcgcgcgacctatccttcctgcgggcggtgatcgatcgccggctcggcctgctggtgccgcccgccgcgtcccacccggccgtgctgcatgccgccatgcggcacatcctgctctcgcccggcaaacggctgcgaccccttctcacccttgccgccgcgatccagctcaacgcctccgagcatgcggtgctggattttggctgcgcgctggagatgatccacgcctcctcgctgatcgtggacgacctcccgtgcatggacgacgccgccatgcgccgcgcccagcccaccacccatgtgcagtacggcgaggatgtcgcggtgctggcctccattggccttttgtcgcgcgccttcggggtggcggcggcagcgccgggggtgagcgagcgtgcgcgcctagaagcggtcgccatcctctccatggcggtgggctcgctgggcctgtgcggcggccagtatgatgacctgcgcccgagccccggccgcagcctgtccgctaccgaggacgtgaaccgccgcaagaccggcgtgctgttctcggccgctgtggagatcgccggccatgtggcggccgccgacgagacccagatgggccacctgaaggccctggccggccatgtcggccgcgcatatcagatcctcgacgacattctggatgcctccgcctcttccgccagcctcggcaaggacgtgggcaaggatgcccacaaggccaccgtcatcgcctccctcggcgcgccgcgcgcgcgcaagctcctgtccgagcacctggcgggcgcccttgccacctctcaggagctgggacccaacacggaaggccaggagcccctgcgcgatttcatgaccgccgccttcggcgaactgatggggccgctggcgccgtgagcgccgcgtcccgatacgacctccaggtggaagacccggccccggcactcacaccggccccgcccctcgccatctcgggccttcacgtgggctatggcgcgcgcgcggtgctggcgggggtcgatctggtcgtgcccgaaggtacggtgaccgcgctgaccggccccaatggcgcgggcaagaccaccctggtgcgcgccatctgcggccgcatcgctccccgcgccgggacggtgacggtgtgcggtgttccg

SEQ ID NO: 13642 - protein, 359 aa, Xanthobacter sp
MGQKGGRDRRTSEGSHDVLRPGSSHGASQGGSTLVLAVAEPETRAPEGRVQELEEPATAAFPPRSRDLSFLRAVIDRRLGLLVPPAASHPAVLHAAMRHILLSPGKRLRPLLTLAAAIQLNASEHAVLDFGCALEMIHASSLIVDDLPCMDDAAMRRAQPTTHVQYGEDVAVLASIGLLSRAFGVAAAAPGVSERARLEAVAILSMAVGSLGLCGGQYDDLRPSPGRSLSATEDVNRRKTGVLFSAAVEIAGHVAAADETQMGHLKALAGHVGRAYQILDDILDASASSASLGKDVGKDAHKATVIASLGAPRARKLLSEHLAGALATSQELGPNTEGQEPLRDFMTAAFGELMGPLAP

SEQ ID NO: 13643 - DNA, 1151 bp, Xanthobacter sp
  CDS (148)..(1074)
caatcggcttgacccggccttctggttggggcacccggtggcccccgtcaacggcgcgcccggcccgggcgttccctcccgccccgtttgtggcccgcaggcgtcggcccgcaggttctggcccttttgccccaaggtgacccgatcatgaccttttccctcaaggaccggctcgacgcctccgccgcggccaccgaggcccgcctcgccctcgccctcgccgacgccgcgctccccggcgagcggctacggcccgagcggctgatggccgccatgcgccacggcgcgctcggcggcggcaaacggctgcggccgttcctggtgatcgaaagcgctgccctgttcggcatcccggccgatcaggcggtgacggccgccaccgccatcgagtgcatccattgctattccctggtccatgacgatctgccagccatggacgacgacgatctgcgccggggccggcccaccgtgcaccgggcctttgacgaggccaccgccatcctcgccggcgacggcctgctcaccctcgccttcgaccttctggcgggggaggatgcccatcccgatccggccgtgcgcatcgcactggtgcgggcgctggcccgcgcttcgggcatcggcggcatggtgggcgggcagatgctggacctcgccgccgagggccgcttctccggcggcacccccctcgccctggcggaagacgccatccgcgacctccaggccatgaagaccggcgcgcttttggcggtctccgtggaggccggcgcgcttttgggtggcgccacggcggacgagcgcgcggcgctcctggcctatggccgggcgctgggcgccgccttccagatcgccgacgacatcctcgacgtggaaggcaccgccgaggaggtgggcaagaaggtgggcaaggacgccgccgccggcaaggcgaccctggtctcccgcctcggcctgcccgccgcccgcaccctgctcgaccggctggtggcggatgcgtctgccgccctcgcccccttcggcgcgcgcggcgcggtgctggccgaggccgccctgttcgtggccaaccggcgcaactgagtttccgcgataccgcgcgcccgttccgcgcgcgatcatgtgacgggaacgcccatgaggccggttcaaccggggcc

SEQ ID NO: 13644 - protein, 308 aa, Xanthobacter sp
MTFSLKDRLDASAAATEARLALALADAALPGERLRPERLMAAMRHGALGGGKRLRPFLVIESAALFGIPADQAVTAATAIECIHCYSLVHDDLPAMDDDDLRRGRPTVHRAFDEATAILAGDGLLTLAFDLLAGEDAHPDPAVRIALVRALARASGIGGMVGGQMLDLAAEGRFSGGTPLALAEDAIRDLQAMKTGALLAVSVEAGALLGGATADERAALLAYGRALGAAFQIADDILDVEGTAEEVGKKVGKDAAAGKATLVSRLGLPAARTLLDRLVADASAALAPFGARGAVLAEAALFVANRRN

SEQ ID NO: 13645 - DNA, 1074 bp, Streptomyces coelicolor
  CDS (1)..(1074)
atgaccgagcagccgctcgaccgtgccgcccggatcgagcaccggttcaacgcgcgcttcgccgagtacttcgacacgctgggcacggcgctggacgccccggccttcagccggttcacccccgactgcgtcgggctgctgcgcgacctgtcgctgcgcggcggcaagcggatgcgggtcgtgctgctgcacgaggcggcgcgcctggtgaccgccgagccggtggacgggctggacgccgccgcgctgagcatcgaactgctgcagacccacggcctggtgcacgacgacctcatcgacgacagcgccacccgccggggcggccccaccacctactacgcctaccgggagcggttccccgggcgtccgcgggcggccctcggcctcaccgtgctcgcgggcgacctcgccctcgccctctccctgcgcgtactgctggaggccgagctgcccgtcgcggtgcgtcaggccatggtcgaggtccagacccgggcggcgaccgacaccttcgtgggccagatcgccgacctggaacgggacttcaccgccgcggtcccggacgcggagatgctgcacgacgtcgccgaccacaagaccgcccgctactcggtcctcgcaccgatgcgcctgggcctcctggcggcgggcgccgaaccgggcgcccacgaggacgagctgcgccggtacgcgcggctggtcggcatctgcgggcagatgcgcgacgactggctggacctgttcggcgacgaggggaccacgggcaagccgacgggcggcgacatccgcgagggcaggcacacgtacaccgtcgtccgcctgctgtccgccgtgagcggctccgagcgggacttcgtcgacagggccctgggcgatccggcctgcacgccggagaccattgccgagatccgtgcgatcggcgagcgcgccggcgtcgccgaccggatgcgtgccgacatgcggcagtacgccgagcgggcccggctggtggctcagggctggcgtccgcggtggcgcgaggacgccgtcgccttcttcgagctgctgccgcggtggagcgtcgaacgctccgcctga

SEQ ID NO: 13646 - protein, 357 aa, Streptomyces coelicolor
MTEQPLDRAARIEHRFNARFAEYFDTLGTALDAPAFSRFTPDCVGLLRDLSLRGGKRMRVVLLHEAARLVTAEPVDGLDAAALSIELLQTHGLVHDDLIDDSATRRGGPTTYYAYRERFPGRPRAALGLTVLAGDLALALSLRVLLEAELPVAVRQAMVEVQTRAATDTFVGQIADLERDFTAAVPDAEMLHDVADHKTARYSVLAPMRLGLLAAGAEPGAHEDELRRYARLVGICGQMRDDWLDLFGDEGTTGKPTGGDIREGRHTYTVVRLLSAVSGSERDFVDRALGDPACTPETIAEIRAIGERAGVADRMRADMRQYAERARLVAQGWRPRWREDAVAFFELLPRWSVERSA

SEQ ID NO: 13647 - DNA, 1450 bp, Hevea brasiliensis
  CDS (140)..(1252)
cggcacgaggttcattctctctcttgaaggtcatcctccatttctcctcctccgcattcaactatggctgaagcctgaggactaatccataatctctcatttctttcagctttctttctgtcctttcgttaatctcaagatgagttcagtgaatttgggctcatgggttcacacctcctacgtcttaaaccaagctaccagatccagatccaaatccaaatccttctctctacctttcaatcctctaaaaagtttagcaatttcctttgcttatagaaaatcagagcgacccatttcatctgtctctgcgattattaccaaggaagaagaaactcttcaagaagagcagaataatccaccaccctcttttgatttcaaatcctacatgctccaaaaaggcaattccattaaccaagctttagaagctgccattccactccaagaacccgctaaaattcacgagtctatgcgttattccctcttggccggcggcaagagggtacgaccggccctctgcctcgctgcgtgtgagcttgttggtgggaatgactccatggcgatgcctgctgcatgcgctgtggaaatgattcatactatgtctcttatccatgatgacctcccttgcatggataacgacgatctccgccgtggcaagcccaccaatcacatcgtgtttggagaggacgtggcggttctcgccggtgacgcactcctagcatttgcttttgaacacatcgctgtttctactttaaatgtttcttctgctagaattgtccgggcagttggggaattagcgaaggcgatcggggcagaagggttagttgctggccaagtagttgatataaattctgagggctcatctgaggtggatttagagaagcttgaatttattcacatccacaagaccgctaagttgttggagggggctgtggtgctaggggctatattgggcggaggaaccgatgaggaagtggagaaattgaggaaatatgctagggatattgggttgttgttccaagttgttgacgatattcttgatgtgactaaatcatcccaagaattggggaaaactgcaggcaaggacttggtggcggacaaggttacatatcccaagcttttggggattgagaagtcgagggaatttgcagagaagctgaataaggaagctcaggagcagctggctggatttgatcctgaaaaggcagctccattgattgctttggctaattacatcgctcacaggcaaaactaatgcattgttttatcaattgtttgttttgtatgttcacatgaaaaatttggactgctctttatatagctttaaagaagcttagctctgtatcaattctagcaaatacaattcaatagcaatttgtccacttattttacatctctttgaccatgcgcaattgctgatctcgaattttgaatttaaaaaaaaaaaaaaaaa

SEQ ID NO: 13648 - protein, 370 aa, Hevea brasiliensis
MSSVNLGSWVHTSYVLNQATRSRSKSKSFSLPFNPLKSLAISFAYRKSERPISSVSAIITKEEETLQEEQNNPPPSFDFKSYMLQKGNSINQALEAAIPLQEPAKIHESMRYSLLAGGKRVRPALCLAACELVGGNDSMAMPAACAVEMIHTMSLIHDDLPCMDNDDLRRGKPTNHIVFGEDVAVLAGDALLAFAFEHIAVSTLNVSSARIVRAVGELAKAIGAEGLVAGQVVDINSEGSSEVDLEKLEFIHIHKTAKLLEGAVVLGAILGGGTDEEVEKLRKYARDIGLLFQVVDDILDVTKSSQELGKTAGKDLVADKVTYPKLLGIEKSREFAEKLNKEAQEQLAGFDPEKAAPLIALANYIAHRQN

SEQ ID NO: 13649 - DNA, 1128 bp, Eucommia ulmoides
  CDS (125)..(991)
tcttcttcttcttcttcttcttcttcttctttctcaatctctgcaattcttacccagaaacaaacgggttgctccccatgaagaaaccccatttcgttcgccggcgttcgatttcaaggcctacatgctcggaaaagccgattccgtcaacaaggcgttggaggctaccgttttgctccggtatccaattaagatccacgagtctatgcggtactccatacttgccggcggaaagcgcgtccgtccactcctatgcatcgctgcctgtgagctcgtcggtggccaagagtccaccgccatgcctgcggcctgcgcagtggagatgatccacaccatgtccctaatgcacgacgacctcccctgtatggacaacgacgaccttcgccgcggcaaacccacgaaccacatggtatttggcgaggacgtcgccgtcttggccggcgactcgctcctcgccttcgcgttcgagctcatcgccacttccaccacgggcgttccggccgacagaatagtccgcgtcatcggcgaactggcgaaatcaatcggttccgaaggcttagttgccggccaggtgatcgacatatgctccgaaggaatgaccgacgtgggtctcgagcaccttgagttcatacacgtccacaagacggcggcgctgcttgaaggctcggtggttctcggggcaattctgggcggcgccaccgacccagaagtcgaaaagctccgaaaattcgcgaggtgtatcggtttcttgtttcaggttgtggacgacattctcgacgtgacgaaatcttcccaagaactggggaagacggccggaaaggatcttgtcgccgacaagaccacttatccgaagctgattgggcttgagaaatcaagggaatttgcagagaaattgaacagggaggctcaagatcagcttgccgcatttgacatagaaaaggccgctcctttgattgctttagcaaattacattgcttacaggaacaattgacgattgataattgatatgtttgcatgtctggttttcgggatctttgatagttacacataaatcacaattgatgattaattgttgggtccaataaataagggattcaagaaagacttgcaattgctgcaattttcatc

SEQ ID NO: 13650 - protein, 288 aa, Eucommia ulmoides
MLGKADSVNKALEATVLLRYPIKIHESMRYSILAGGKRVRPLLCIAACELVGGQESTAMPAACAVEMIHTMSLMHDDLPCMDNDDLRRGKPTNHMVFGEDVAVLAGDSLLAFAFELIATSTTGVPADRIVRVIGELAKSIGSEGLVAGQVIDICSEGMTDVGLEHLEFIHVHKTAALLEGSVVLGAILGGATDPEVEKLRKFARCIGFLFQVVDDILDVTKSSQELGKTAGKDLVADKTTYPKLIGLEKSREFAEKLNREAQDQLAAFDIEKAAPLIALANYIAYRNN

SEQ ID NO: 13651 - DNA, 990 bp, Sulfolobus tokodaii
  CDS (1)..(990)
atgagttttgaagattattttaataggatagtcgaaaacgttaacataaatatagaaaaatacttaaaaggagatatacaagagttatatgaagcttctttttatttatttaaagctggaggtaaaagattaagaccattaattctagtttcatcagctgaccttttaggaggagatttaaatagagcttacttagctggtgcatctgtagaagttcttcatacttttactttgattcatgatgatataatggatgaagacacaacaagaagaggaatgcctacagttcatgtaaaatggggtataccaatggcaattttggctggtgacttattacatgccaaagcttttgaaattttgaatgaggcttttagaggtatgagtagtaacaaaataactagagctttcgaaatttttacgaaagcaataataattatttctgaaggtcaagctttagatatgcaatttgaagataaagttacggtaagtgaggaagaatatttagatatgataaaaagaaaaacagcaatgttattttcttcatctgcagctttaggtggtttaatagctactgataacgaaaaagaaattcaagcattagcagattacggcttaaatttaggtatttcatttcaaatagttgacgatattttaggcctcatagcagacgagaaagaattaggaaaaccggtttatagtgatattagggaaggcaagaaaacactactagtaattaagactatgaaagaagctactgatgaggaaaagaaaatacttctaaaagcattaggaaataaaaacgctagcaaagatgagcttataactgcagctgaaattataaggaaatattctctagaatatgcctataataaagctgaagaatatgcgagaaaagcgatagaagcattagagtctattgattggaaaaatgatgaggctggaaaggctttaaaatatttagcagagtttacggtaaaaaggagaaaatga

SEQ ID NO: 13652 - protein, 329 aa, Sulfolobus tokodaii
MSFEDYFNRIVENVNINIEKYLKGDIQELYEASFYLFKAGGKRLRPLILVSSADLLGGDLNRAYLAGASVEVLHTFTLIHDDIMDEDTTRRGMPTVHVKWGIPMAILAGDLLHAKAFEILNEAFRGMSSNKITRAFEIFTKAIIIISEGQALDMQFEDKVTVSEEEYLDMIKRKTAMLFSSSAALGGLIATDNEKEIQALADYGLNLGISFQIVDDILGLIADEKELGKPVYSDIREGKKTLLVIKTMKEATDEEKKILLKALGNKNASKDELITAAEIIRKYSLEYAYNKAEEYARKAIEALESIDWKNDEAGKALKYLAEFTVKRRK

SEQ ID NO: 13653 - DNA, 1017 bp, Rhizobium loti
  CDS (1)..(1017)
atgggtgtcgttctcaacatcgaaaacgggaagcgggagcccgcctccatcaaggatctgatcgatctgacggcggccgatatgggacgcgtcaacgaattgatcctgtccaaggccggctccgacgtcgagatgattccggaggtcgccaaccatctgatctcgtccggcggcaagcggctcaggccgatgctgacgctcgccgccgcgcagatgttcggctatgccggcgaaggccacgtcaagctcgccacctcggtggaattcatgcacaccgcgacgctgctgcacgacgacgtcgtcgacgagagcggcatgcgccgcggcaagaagaccgcccgcatgatctggggcaaccaggcgagcgtgctggttggcgatttcctgcttggccaggccttccgtatgatggtcgatgtcggctcgctcgaagcgctcgacatcctgtcgagcgccgcctcgatcatcgccgagggcgaggtcatgcagctcgccgccgccaagaacctcgaaaccaccgaagacgagcacttcgccgtcatcaaggccaagaccgcagcacttttttcggcggccgccgaagttggaccggtcatcgcccaggcgacccgcaatgatcgcgcagcactgcgctcctacggcatgaatctcgggcttgccttccagctcatcgacgatgcgctggactatggcggcaccagcaaggatctgggcaagaatgtcggcgacgatttccgcgagggcaaggtgaccttgccggtcatcctcgcctatcggcgcggcaccaaggccgagcgcaccttctggaagcgcgccatcgaggacaatgtcgttgacgatgcgggcctggaaaaggcgatcggcctgatgacccggcacggcgccatcgccgacacgatcggccgtgcccggcatttcggcgagatcgcccgcgacgcgctcgcgccgctcgaagaaacgcgtcagaaatcggcgctgatcgacgtcatcgatttctgcatcagccgggtgaactga

SEQ ID NO: 13654 - protein, 338 aa, Rhizobium loti
MGVVLNIENGKREPASIKDLIDLTAADMGRVNELILSKAGSDVEMIPEVANHLISSGGKRLRPMLTLAAAQMFGYAGEGHVKLATSVEFMHTATLLHDDVVDESGMRRGKKTARMIWGNQASVLVGDFLLGQAFRMMVDVGSLEALDILSSAASIIAEGEVMQLAAAKNLETTEDEHFAVIKAKTAALFSAAAEVGPVIAQATRNDRAALRSYGMNLGLAFQLIDDALDYGGTSKDLGKNVGDDFREGKVTLPVILAYRRGTKAERTFWKRAIEDNVVDDAGLEKAIGLMTRHGAIADTIGRARHFGEIARDALAPLEETRQKSALIDVIDFCISRVN

SEQ ID NO: 13655 - DNA, 918 bp, Rhizobium loti
  CDS (1)..(918)
atgacgaatgacgacgaaatggcgttcgaaatggcgctcatcaggcgggcagccgccgtcgaggtgctgctgcggcgcttgctcgacgatcgcccgctttcgggagagatcgcgcggcccgaccgcctgatggcggcgatgcgccatggcgtgctgaacggcggcaagcgcctgcgccccttcctggtcatggaaagtgccgcccttttctccgccgatggcgaagcagcactgcgcgtcgcggcggcactcgaatgcgtgcattgctattcactgatccatgacgacctgccggcgatggacgatgatgatctgcgccgcggccagccgaccgtgcacaaggccttcgacgaggcaaccgcgatcctggccggcgacgccttgctgacgctggccttcgacatcgtcgccagcgaggcgaccgtcctgccggcggatcggcgagcggccttggtgctggcgcttgcccgtgcggccggagccggcggcatggtcggtggccagaagctcgacctcgaagccgagcagacaccgcccgacgaagcgggcatcataacgctgcaggcgatgaagaccggcgccctgatccgcttcgcctgcgaggccggcgccatcatcgccggcgctccggccgaggaccgcgaaaggctggccgagttcggctcggccatcggccttgccttccagcttgccgacgacctgctcgatttgaccgccgacgccggccagatgggcaaggcgaccggcaaggacgccgccgccggcaagggaacgctggtggcgttgcatggcgcgaattgggcgcacagccagttgcacggccttgtcgggcaggcccacgcgctgctcgacccctatggcgaccgggcggcgctgctgaaggaggctgcgaccttcgtcgcgacgcgcaacagttga

SEQ ID NO: 13656 - protein, 305 aa, Rhizobium loti
MTNDDEMAFEMALIRRAAAVEVLLRRLLDDRPLSGEIARPDRLMAAMRHGVLNGGKRLRPFLVMESAALFSADGEAALRVAAALECVHCYSLIHDDLPAMDDDDLRRGQPTVHKAFDEATAILAGDALLTLAFDIVASEATVLPADRRAALVLALARAAGAGGMVGGQKLDLEAEQTPPDEAGIITLQAMKTGALIRFACEAGAIIAGAPAEDRERLAEFGSAIGLAFQLADDLLDLTADAGQMGKATGKDAAAGKGTLVALHGANWAHSQLHGLVGQAHALLDPYGDRAALLKEAATFVATRNS

SEQ ID NO: 13657 - DNA, 888 bp, Pasteurella multocida
  CDS (1)..(888)
atgtaccaactttcacaagacttaccccaactccaacaacgtattaatacttttttagcgcaacaattgaatgtggacagcagcccctctcctcttgccgaagccatgcgttacggtgtgctccttggtggtaaacgtatccgtcctttcctagtgtatgcaacaggacgaatgctcggcgcagacttaaaccaactcgattatgccgcggcgagtgtagaagccgttcatgcctattcattaattcacgacgatctccctgcgatggatgatgatcatttacgtcgtggacaaccaacttgccatattgcttttgatcacgccaccgcgattttagccggtgacgcgttgcaagcctttgcttttgaaatattaactcaagcacctgcattgcaagcagagcaaaaacttgcgttggtacaaacgctaagtcaagcagctggtgtaaaaggaatgtgtttggggcaaagtctcgatctgatttctgagcaaaaacacattagcttaatcgaattagaacaaattcaccgcaataaaacgggggcaatgctttccgcagcgattcagcttgggcgaatttgttctccgcattttaaaaatgatacgctagcacagcaattacaacggtattcggaagccattggcttagcctttcaagtacaagacgatattttagatattgaaggcgagagtgacattattggtaaaaccgtgggttctgatttattagcagataaaagcacctaccccaaattattaggcttagcgggtgccaaacaaaaagcgcaagaactgtatcaaaacgcaatcgcggaattagaaagtattccttttgatacaagtgcacttcgtgctatcgctgaatttgtggtaaatagaaaaagttaa

SEQ ID NO: 13658 - protein, 295 aa, Pasteurella multocida
MYQLSQDLPQLQQRINTFLAQQLNVDSSPSPLAEAMRYGVLLGGKRIRPFLVYATGRMLGADLNQLDYAAASVEAVHAYSLIHDDLPAMDDDHLRRGQPTCHIAFDHATAILAGDALQAFAFEILTQAPALQAEQKLALVQTLSQAAGVKGMCLGQSLDLISEQKHISLIELEQIHRNKTGAMLSAAIQLGRICSPHFKNDTLAQQLQRYSEAIGLAFQVQDDILDIEGESDIIGKTVGSDLLADKSTYPKLLGLAGAKQKAQELYQNAIAELESIPFDTSALRAIAEFVVNRKS

SEQ ID NO: 13659 - DNA, 1011 bp, Streptomyces coelicolor
  CDS (1)..(1011)
atgaccgtcgtcgggccgttcgggctgagcgtgcgggaccaggctctggaagccgatgtccaggccggattggttgctgtcgaggaagggttgcttgaggcaaccaaaagcgaggtgccgttcatcacggaggccgcccagcacctggtgcgggccggcgggaaacggttccggccgctgctggtgatgctctcggcccagttcggagacccctacgcccccgggatcgtgccctcggccgtggtcgtggagctgacccacctggccacgctgtaccacgacgacgtgatggacgaggccgccgtgcggcgcggggtgcccagtgcgaacacccgctgggacaactcggtcgcggtcctcaccggcgacttcctgttcgcccgtgcctcccagatcctcgccgacctcggccccgaggcggtccgtgtccaggccctcgccttcgaacggctggtcaccggtcagatcctggagacggccggcccgcaggacggccgcgacccggtcgaccactacctggacgtgctgggcggcaagacgggctccctggtggcggtctcctgccggttcggcgcgatgatgtccggcgccgacgagacggtggtggacgtcctcacccagtacggcgagcggctcggcgtcgccttccagctcgccgacgacgtcctggacatcgcctccgactccgacgagtccggcaagacgcccggcacggacctgcgcgagggcatccccaccctgcccgtgctgcggctgcgcgagcgggcggcccggctggggctcgccgaggacctcgcgctgtgcgagctgctcgactccgacctgagcgacgacgcgcggcacgccgaggcgctgcgcctgctgcgcgcccacccggcgctggagcaggcccgccgggacaccgtccggtacgcggaggaggcccgggcggcgctcgccccgctgcgcgaatgcgacgcgaaggccgcgctggtggagctgtgcgacgcggtggtccaccgggccggctga

SEQ ID NO: 13660 - protein, 336 aa, Streptomyces coelicolor
MTVVGPFGLSVRDQALEADVQAGLVAVEEGLLEATKSEVPFITEAAQHLVRAGGKRFRPLLVMLSAQFGDPYAPGIVPSAVVVELTHLATLYHDDVMDEAAVRRGVPSANTRWDNSVAVLTGDFLFARASQILADLGPEAVRVQALAFERLVTGQILETAGPQDGRDPVDHYLDVLGGKTGSLVAVSCRFGAMMSGADETVVDVLTQYGERLGVAFQLADDVLDIASDSDESGKTPGTDLREGIPTLPVLRLRERAARLGLAEDLALCELLDSDLSDDARHAEALRLLRAHPALEQARRDTVRYAEEARAALAPLRECDAKAALVELCDAVVHRAG

SEQ ID NO: 13661 - DNA, 1161 bp, Streptomyces coelicolor
  CDS (1)..(1161)
atgacggagacccggcgcggcgccaccgcgacgtgccgtcccaccggggcgccggaaaggcacgggcccatcggcacacagcgcgagaaggagccgggggagccgtccgacgggcagggggaggcggtggtcgaagggcacgaggcggccctgctcctgagcgagtcacgagcgtcggtcgatcccgaactgcggtccgccatcgcgacgctgccggagtcgatgcgccgggtcgcgctctaccacttcggctggcagcacgcggacggcacgcccgcggcgggcaacgcgggcaaggcgatccgccccgcgctcgtcctcaccgcggcggccgcgctcggcggcccgggggcccgcgcggcggccgtccgtgccgcggcggcggtggagctggtccacaacttcaccctgctgcacgacgacgtgatggaccgcgacgccacccggcggcaccggccgaccgcgtggaccgtgttcggcgacgccgacgcgatcctggccggggacgcacttcaggcgctcgccctgcggctgttcgccgccgacccgcatccggcgtccgcggcggcggccacccggctcgccgactgcgtcatggagctgtgcgagggccagcacgcggacacggcgatggagcggcgcccgccggacgaggtgaccctcgacgagacgctcgtcatggccgaggccaagacgggtgccctgctgggctgcgcctgtgccgtcggcgcgctgtacgcgggcgccgccacggaggacgtcgaggccctggacgccttcggccgtgaggcggggatggccttccagctcatcgacgacgtcatcggcatatggggcgacccgcgccacaccggcaagccggccggtgcggacctggccgcccgcaagaagtcactgccggtggtcgccgccctcacctccggcaccccggccgccgccgaactggccgagctgtacacaggcccgtacgacgagaacaaggaggacctggagcgcaccgccctggccgtggagcgggccggcggccgggactgggcacaggcccaggcggccgaccggatggcgagggccatgcaggagctggcgcgtgccgtgcccgagccggaggcggcgggcggcctgctcgccctggccgagttcgtgacgcggcgcagcacctga

SEQ ID NO: 13662 - protein, 386 aa, Streptomyces coelicolor
MTETRRGATATCRPTGAPERHGPIGTQREKEPGEPSDGQGEAVVEGHEAALLLSESRASVDPELRSAIATLPESMRRVALYHFGWQHADGTPAAGNAGKAIRPALVLTAAAALGGPGARAAAVRAAAAVELVHNFTLLHDDVMDRDATRRHRPTAWTVFGDADAILAGDALQALALRLFAADPHPASAAAATRLADCVMELCEGQHADTAMERRPPDEVTLDETLVMAEAKTGALLGCACAVGALYAGAATEDVEALDAFGREAGMAFQLIDDVIGIWGDPRHTGKPAGADLAARKKSLPVVAALTSGTPAAAELAELYTGPYDENKEDLERTALAVERAGGRDWAQAQAADRMARAMQELARAVPEPEAAGGLLALAEFVTRRST

SEQ ID NO: 13663 - DNA, 1176 bp, Tagetes erecta
  CDS (50)..(1135)
ggcacgaggtttctctaaacctcaatttctgcaataaaattcatacaaaatgagtcttgtaaatcccacatctttgttctatggatcccccattatgaccagatccccaatcttcctcaacccgacccgaaaatcccaacccgtttcatctttctccgcatccaatttcccccaaatctctgcaattttgacaaaagaacatcaatcaaacgcaccagaagacaaaatcaaagaaacccaatccaaattcgagttcgatttcaaatcatacatgttggagaaagcgaatttggtgaatcaagcactagatttagcggttccgttgaaagacccgataaagatccatgaatcgatgcggtactcgcttctcgccggaggaaaacgagtccggccggtgttatgtatcgccgcttgtgaactcgtcggaggagacggtttaaccgccatgccggcggcctgtgcggtggagatgattcacaccatgtcgttaatgcacgacgatcttccatgcatggataacgacgactttcgccgtgggaaacccacaaaccatatggtgtacggcgaagaaatcgccgtacttggcggtgacgctatgctctcatttgcttttgagcatatggccaccgctacaaaaggagtatcctcggacaggatactccgtgcaattggcgaactcgctaaatgcatcggctccgaggggcttgtcgccggtcaggtggtggacatatgctccgaaggagccgatgtcggattagagcatttggaatttatacatttacacaaaaccgcggcgttgcttgagggttccgtggtgcttggtgccatcttgggcggtgggtcggacggagaaattgagaaactgcggaaatttgcgaggtcgatcggacttttatttcaggtggtggatgatattcttgatgtgacgaaatcgtctgaggaattggggaaaaccgctggaaaagatttggtgtcggataagacgacgtatccgaaactgttggggattgagaaatcgcgagaatttgcggaggaattgaacaaggatgcacaagaacagttatcggagtttgatccccggaaagccgcaccgttaattgcacttgctaattacattgcttataggcaaaattgatcatacaatgtatgttatgttatggtatcgatcttttatta

SEQ ID NO: 13664 - protein, 361 aa, Tagetes erecta
MSLVNPTSLFYGSPIMTRSPIFLNPTRKSQPVSSFSASNFPQISAILTKEHQSNAPEDKIKETQSKFEFDFKSYMLEKANLVNQALDLAVPLKDPIKIHESMRYSLLAGGKRVRPVLCIAACELVGGDGLTAMPAACAVEMIHTMSLMHDDLPCMDNDDFRRGKPTNHMVYGEEIAVLGGDAMLSFAFEHMATATKGVSSDRILRAIGELAKCIGSEGLVAGQVVDICSEGADVGLEHLEFIHLHKTAALLEGSVVLGAILGGGSDGEIEKLRKFARSIGLLFQVVDDILDVTKSSEELGKTAGKDLVSDKTTYPKLLGIEKSREFAEELNKDAQEQLSEFDPRKAAPLIALANYIAYRQN

SEQ ID NO: 13665 - DNA, 951 bp, Bradyrhizobium sp
  CDS (1)..(951)
atgcacaaacccgtcgacctcaccgatacggcggccttcgagacccagctcgatcgttggcggggacgcatcggcgaagcggttgccgaggccatggcattcggcacgacggttccggccccgctgcaggcgggcatgagccacgcagtcctggcgggcggcaagagataccgcggcatgctcgtgctcgcgctcggatcggacctcggcgtgcccgaggagcagcttttgtcgtcggctgtggctattgagaccattcatgcagcctccctcgtggtcgatgatcttccctgcatggacgacgcgcggcggcgacggtcgcagccggcgacgcatgtcgcgttcggcgaggccacagcaatcctcagcagcatcgccctgatcgcccgcgcgatggaggtcgtggcgagggaccggcaactttcgcccgcctcccgcagttccatcgtggacactctgtcgcacgccatcggcccgcaggccctttgtggcgggcaatatgacgatctctatcctccctactacgcgaccgagcaggatctgatccatcgctatcaacgcaagaccagcgcgctgtttgtcgcagcgttccgctgccccgcgctcctcgcggaggtggatccggagacgctgctgcgcatcgcccgcgcgggccagcggctcggcgtcgcatttcagatattcgacgatctcctcgacctgacaggcgatgcccatgcaatcggcaaggatgtcggccaggaccatggcaccgtgacgctcgccacgctgctcggacccgcgcgggcggccgaacgggcggcggatgagcttgcggccgtgcagaaggaactgcgcgagacggtcggccccgggcgcgccctcgacctgatcaggcggatggccgcacgcatcgccggcaccggcaagaaatccgccggacgcgacgatctgcggccgcatgccggctga

SEQ ID NO: 13666 - protein, 316 aa, Bradyrhizobium sp
MHKPVDLTDTAAFETQLDRWRGRIGEAVAEAMAFGTTVPAPLQAGMSHAVLAGGKRYRGMLVLALGSDLGVPEEQLLSSAVAIETIHAASLVVDDLPCMDDARRRRSQPATHVAFGEATAILSSIALIARAMEVVARDRQLSPASRSSIVDTLSHAIGPQALCGGQYDDLYPPYYATEQDLIHRYQRKTSALFVAAFRCPALLAEVDPETLLRIARAGQRLGVAFQIFDDLLDLTGDAHAIGKDVGQDHGTVTLATLLGPARAAERAADELAAVQKELRETVGPGRALDLIRRMAARIAGTGKKSAGRDDLRPHAG

SEQ ID NO: 13667 - DNA, 1569 bp, Rhodovulum sulfidophilum
  CDS (181)..(1050)
cgcgctcgaacgcggcgaggtgcgctggaagagtcgattgcgctctcggaacgcgcgatgaagcttgcggcagcattgcgaagccaagctgcgggatgccgaggccaagatcgaggcgatgacgcttgacggcgcgggcaaccccaccgggacgaaaccggccgaaggtctttgacagcgatgttccagtccagcctgaaatccgccgccgagcggatcgagacgcgtttgaccgaggctttggccggcgccgccgaccagcccgtcacgcaggcgatgcgctatgccgtctcgggcggcaagcggctgcgcgggttcctggtgctcgagtcggccgcgctttacgacatcgcgcccgaggcggcggtcgatgccgcggccgcggtcgaggcgctgcatgcctacagccttgttcatgacgacatgccctgcatggatgatgacgacctgcgccgcgggcagccgaccgtgcatgtgaaatgggatgacggcaccgcgctgttgaccggcgacgcgctgcagacgctggccttcgagctgctgtccgcgcccgcctgccatcccgacccggcggtgcggatcgatctggtggcctctctggcccgggcctcgggcatcgacggcatggtgctgggccaggcccaggacatcgccgccgagaccgccggccggtcgctgacgctcgatgagatcaccgagctgcaggccaacaagaccggtgcgctgatccgctggtcggccgaggcgggcgcgcgtctggcccgcgccgatatcgcgccgctcaccgcctattccaccgcgctgggccttgccttccagatcgccgacgacattctcgacgtcgagggcgatgccgccaagaccggcaagcgggtccacaaggatgccgaggccggcaaggcgaccttcgtgtcgcttctggggctcgacggcgcccgcgcccgggccctggccctggtcgaagaggccgaggccgcgctggatccctttggcgggcgggccgatccgttgaaggccgccgcccgtttcgtcatttcccgagagtcgtaatcaggtaacgcccaaggagggctgccccagtgaataaacgcccgaataccccgcttctcgacgggatcgtcagcccttcggatctcaaggcgctctcggatgcccagcttgggcaggtcgcgcaggaactccggcaggaggtgatctcggcggtctcggaaaccggcgggcatctgggcgcggggctgggcgtggtcgagctgacggtggcgctgcatgcggtcttcgacacgccgcgcgacaagctgatctgggatgtcagccatcagtgctatccgcacaagatcctgaccggcgccgcgaccgatccggacctgcgccagcaggcggctgtcggctctgcagcgctcgaagcgatacaccgttcgcgcggcacagctcgacctcgatctcgcgcgctggcttgcgtcgccgcgacctggcacggcccagcgggtggcatgcatcgcgcgatcgcgacggtcgttcgccgcatggctatgagctgacatgcgcatgcagcgtgacggatctgacgac

SEQ ID NO: 13668 - protein, 289 aa, Rhodovulum sulfidophilum
MFQSSLKSAAERIETRLTEALAGAADQPVTQAMRYAVSGGKRLRGFLVLESAALYDIAPEAAVDAAAAVEALHAYSLVHDDMPCMDDDDLRRGQPTVHVKWDDGTALLTGDALQTLAFELLSAPACHPDPAVRIDLVASLARASGIDGMVLGQAQDIAAETAGRSLTLDEITELQANKTGALIRWSAEAGARLARADIAPLTAYSTALGLAFQIADDILDVEGDAAKTGKRVHKDAEAGKATFVSLLGLDGARARALALVEEAEAALDPFGGRADPLKAAARFVISRES

SEQ ID NO: 13669 - DNA, 1441 bp, Rhodobacter capsulatus
  CDS (213)..(1079)
ttcggcatacgtcgagcagcgatgccgcgctgacagtgtcacgcagctgaacgcggcgagtgcgctgatcagtcggtccggctctccgaacgcggcgcgaagctgaaagagcgctgcgcgatgctgctcaaggaagccgaggaacgggtcgaaaagatcctgctgggcgaaggcggggtgcccgcgggcaccgttgcggtggaaggactctgatgttttccgaacgtttgaaagaagtgcaggacggcgtcgaagcggcgatggcggcggcgatcgggcgtctgcccgcgggtgatctgcgcgatgcgatggcctatgcggcacagggcggcaagcggctgcgggccttccttgccatcgaatccgccgcgatccacgggatttcgatggaacaggcgatgcccgcggcgctggcggtcgaggcgctgcatgcctacagcctcgtccatgacgacatgccctgcatggacaatgacgatctgcgccgcggcctgccgaccgtgcaccgcaaatgggacgaggccaccgccgttctggcgggcgacgcgctgcagaccctcgcctttgagctttgcaccgatccggtgctgggatcggccgaaaaccgggtcgcgctggtcgccgctctggcgcaggcctcgggggccgaggggatggtctacggtcaggcccttgatattgctgccgaaaccgccgcggtgccgctgacgcttgacgaaatcatccggctgcaggcgggcaagaccggcgcgctgatttcctttgccgcgcaggccggcgcgatcatcgcgggcgccgaccgcgcactgctggccgcctatgccacggcgcttggcctggccttccagatcgccgacgacattctggatgtcgaaggcgacgaggaagcggcgggcaagcgtctgggcaaggatgccgaggcgcacaaggccactttcgtctcgctgctgggtctgccgggggcaaaagcccgcgccgccgatctggtcgccgaggccgaagccgcccttgcgccctatggcgaggccgccgctacccttcgcgcctgcgcgcgctatgtgatcgaacgcgacaagtgaagcgagccccatgagccagcccccagtgaccccgatcctcgaccgcgtgcgtctgccctccgacatgaaagggctgagcgaccgcgacctgcaccgactggccgatgaactgcgcgccgagacgatctcggccgtgtcggtgacgggcggccatctgggcgcggggctgggcgtggtcgaactcaccgtggcgctgcatgcggtcttcgactgcccgcgcgacaagatcgtctgggacgtggggcaccaatgctacccgacaagatcctgaccggtcggcgcgaccgcatccgacgctgcgcataggggcggctctcggcttaccaacgctccaaagccctatgacgccttcggggccggca

SEQ ID NO: 13670 - protein, 288 aa, Rhodobacter capsulatus
MFSERLKEVQDGVEAAMAAAIGRLPAGDLRDAMAYAAQGGKRLRAFLAIESAAIHGISMEQAMPAALAVEALHAYSLVHDDMPCMDNDDLRRGLPTVHRKWDEATAVLAGDALQTLAFELCTDPVLGSAENRVALVAALAQASGAEGMVYGQALDIAAETAAVPLTLDEIIRLQAGKTGALISFAAQAGAIIAGADRALLAAYATALGLAFQIADDILDVEGDEEAAGKRLGKDAEAHKATFVSLLGLPGAKARAADLVAEAEAALAPYGEAAATLRACARYVIERDK

SEQ ID NO: 13671 - DNA, 1477 bp, Rhodobacter sphaeroides
  CDS (400)..(1170)
atgatctggctgccctcgccgcgagcagcgcggcgcatgtgggcgtccttctggagcggagcgcatgacggaaaaagcagtggcagagatgacgttcgaagaggcgatggcggcgctggaggcggtcgtcacggctttggagaaaggcgacgtgccgctggaagactccatccgcctctatgagcgcggctcggcgctcaaggcgcattgcgcgcagaagctgaaggacgccgaggacaaggtggagctgatccgtgccgccgaggggcgcgcgacggcggcggttccggcggagggattgtgagtttttccaaggctttgacggatgcggccgcgcgcgttcaggggcggctcgatgcggcgctggcggatcgcgaggatctgccggtcgtccatgccatgcgctatgcggtgcagggcggcaagcggctgcggggtttcctcgtgctcgaatccgcccggctgcacgggatcgcgcccgaggcggcggtgagtgctgcggcctctatcgaggcgctgcatgcctacagcctcgtgcatgacgacatgccctgcatggacgatgacgacctgcgccgcggcctgccgaccgtgcatcgcaagtgggacgaatgcaccgccgtgctggcgggcgacgcgctgcagactctcgccttcgagctcttggccgatccggcgctcggacccgccgcggtgcggatcgaactggtggcgagccttgcgaaagcctcgggcgccgagggcatggtgctgggccaggcactcgacatcgcggccgagacggctgccgtgcccctcacgctcgatcagatcacccaccttcaggccggcaagactggcgcgctgatccgctggtccgccgaagcgggggcgatcctcgggcaggcggaccgggtgccgctgcgccgatacgccacggccctcgggcttgcgttccagatcgcggacgacattctcgatgtcgagggcgatgcggagaaggcgggcaagcggctccagaaagatgccgaagccgggaaggccaccttcgtctcgcttctcgggctcgacggcgccaaggcgcgggcgcgggctctggtggaggatgccgaggcggcgcttgcgccctatgggccagaggcaggaacattgatcgaggcggcgcgcttcgtcatctcgcgtgaaagctgaaggaagagcatgaccgacagaccctgcacgccgacgctcgaccgggtgacgctcccggtggacataaagggcctcacggaccgtgagttgcgctcgctggccgacgagctgcgggccgaaacgatctcggccgtgtcggtgacgggcgggcatctgggcgcaggcctcggcgtggtggagttgacggttgcgctgcatgcgatcttcgatgcgccccgcgacaagatcatctggacgtgggccaccagtgctaccccacaagatctgaccggcgggcgaccgatcgaccctgcgagggccggggttt

SEQ ID NO: 13672 - protein, 256 aa, Rhodobacter sphaeroides
MRYAVQGGKRLRGFLVLESARLHGIAPEAAVSAAASIEALHAYSLVHDDMPCMDDDDLRRGLPTVHRKWDECTAVLAGDALQTLAFELLADPALGPAAVRIELVASLAKASGAEGMVLGQALDIAAETAAVPLTLDQITHLQAGKTGALIRWSAEAGAILGQADRVPLRRYATALGLAFQIADDILDVEGDAEKAGKRLQKDAEAGKATFVSLLGLDGAKARARALVEDAEAALAPYGPEAGTLIEAARFVISRES

SEQ ID NO: 13673 - DNA, 1083 bp, Arabidopsis thaliana
  CDS (1)..(1083)
atggctaatactgttcatctcagctcatcctctctcttcatccaaaccagaggacgaaaatacaactccatattatcattcaacaatctccaaaaacgcactgttttgtctctctcttgtgctctcacctcacaaggcggcaaagacatgattccaccaaaaggaaaaagcaatgatcgcaactttgcctttgacttcaagtcttatatgatccgtaaagccgaatctgtaagtatggctctcaacgtttcagtacctccccaagatcccctcgcaatccaagaggcggtgcggtactcattactagcgggcggaaaacgtgtgcgacctctgctctgcattgctgcctgtgagcttgtgggaggcgacgaggctactgccatgtcagccgcttgcgcggttgagatgatccacacgagctctctaatccatgacgaccttccgtgcatggacgatgccgacctccgtagaggcaagcccaccaaccacaaggtatttggagaacacatggcggttttggcgggcgatgcactccttgctttggcgtttgagcacatgacggttgtgtcaagtgggttggttgctcctgagaggatgatccgttctgtaactgagctggcaaaggccatcgggacaaaagggttagtggctgggcaagtgagtgacttatgtagccaaggattgaatccatatgacgtcgggttggagcgtctagaattcatccacctacacaaaacggccgccttgttggaggcagcggcggttttaggagctataatcggaggtggaacagaggaagagatccaaaagctaagaaagtatgggagatgtattgggcttttgtttcaggtagttgatgatattattgatgtaacagaatctactgaggaattgggtaagacagccggaaaagacgtaatggcaagaaagctgacgtatccaaggctgataggtttggagagatccagggaagttgcagagaaactgagaagagaagcagcggaacagcttctagggtttgattccaataaggtggcgcctctggtggctcttgctagctacattgcttgcagacacaactga

SEQ ID NO: 13674 - protein, 360 aa, Arabidopsis thaliana
MANTVHLSSSSLFIQTRGRKYNSILSFNNLQKRTVLSLSCALTSQGGKDMIPPKGKSNDRNFAFDFKSYMIRKAESVSMALNVSVPPQDPLAIQEAVRYSLLAGGKRVRPLLCIAACELVGGDEATAMSAACAVEMIHTSSLIHDDLPCMDDADLRRGKPTNHKVFGEHMAVLAGDALLALAFEHMTVVSSGLVAPERMIRSVTELAKAIGTKGLVAGQVSDLCSQGLNPYDVGLERLEFIHLHKTAALLEAAAVLGAIIGGGTEEEIQKLRKYGRCIGLLFQVVDDIIDVTESTEELGKTAGKDVMARKLTYPRLIGLERSREVAEKLRREAAEQLLGFDSNKVAPLVALASYIACRHN

SEQ ID NO: 13675 - DNA, 1333 bp, Arabidopsis thaliana
  CDS (72)..(1145)
gcttccaagcattcgaaacctattaagagctccacttaatataatattatatcggagaaggtggatcggccatggctactactctcagctcatcctctctcttcatccaattcagaggacggagatacaactccctatcatcattcaacaatctccaaaagcgcaccgttttgtcgctttcttgtgctctatcctcacaaggtggagacatgattccaccagagggaaaaagcaatgatcgcaactctgcctttgacttcaagtcgtatatgatccgtaaagccgaatccgtaagtgcggctctcaacgtttcggtacctctccaagaaccactcacgatacaagaggcggtgcggtactcattactagcgggcggaaaacgtgtgaggcctctcctctgcattgctgcttgtgagctcgtgggtggcgacgaggctactgccatgtcagccgcttgtgcagtcgagatgatccacacgagctcgctaatccatgacgacctcccgtgcatggacgatgccgacctccgtagaggcaagcccaccaaccataaagaatttggagaagacatggcggttttggcgggtgatgcactccttgctttagcgtttgagcacatgacgttcgtgtcaaatgggttggttgcccctgagaggatgatccgtgctgtaatggagctggcaaaggccatagggacaaaagggctagtggctgggcaagtgactgacttatgtagccaaggattgaatccagacgacgtcggattggagcgtctagagttcatccacctccacaaaacggccgccttgttggaggcagcggcagttttaggagccataatgggaggtggaacagaggaagagatcgaaaagctaagaaaatatgcgagatgtattgggctgttgtttcaggtggttgatgatattcttgacgtaacggaatctactaaggaattgggcaagacagccggaaaagatgtaatggccgggaagctgacgtatccaaggctgataggcttggagagatccagggaagttgcggagaaactgagaagagaagcagcggaacagcttctagggtttgattccgacaaggcggcgcctcttgtggctcttgctagctacattgcctgcagacacaactgatattttgcatgaactgaacatatcctcaaagcatctaatgtcctgacaagtccattcttagttttattattcaaaaataaaaataaggtccattagattgatccatggtcttctttcatatgaacctttgtcttgtgatcatcactttgtgttctcagcttgcattttagtattacgtttttgaattt

SEQ ID NO: 13676 - protein, 357 aa, Arabidopsis thaliana
MATTLSSSSLFIQFRGRRYNSLSSFNNLQKRTVLSLSCALSSQGGDMIPPEGKSNDRNSAFDFKSYMIRKAESVSAALNVSVPLQEPLTIQEAVRYSLLAGGKRVRPLLCIAACELVGGDEATAMSAACAVEMIHTSSLIHDDLPCMDDADLRRGKPTNHKEFGEDMAVLAGDALLALAFEHMTFVSNGLVAPERMIRAVMELAKAIGTKGLVAGQVTDLCSQGLNPDDVGLERLEFIHLHKTAALLEAAAVLGAIMGGGTEEEIEKLRKYARCIGLLFQVVDDILDVTESTKELGKTAGKDVMAGKLTYPRLIGLERSREVAEKLRREAAEQLLGFDSDKAAPLVALASYIACRHN

SEQ ID NO: 13677 - DNA, 1035 bp, Arabidopsis thaliana
  CDS (1)..(1035)
atggaaaatcgagaagtttttgtttacattgtcatctccatcttccgctctctccaattcttgttttggagattccgtccacgttacaatgatgttacgtctgcgttgacccgccctctgacttcggccgcaagctatgattttaagttcatgtcgtatatggtcaataaggctaagtccgtcaataaagcactagaagaggctgttcctctccgcgagccagaactcaagatccgtgaggccatgaggtacacgcttctctccgatgggaagcgtgtaagaccaatgctttgcttagctgcatgcgagctcgtggggggacaagagtcaaccgcaatgtccgctgcatgtgcgattgagatgctccacgcgtcgtctctcatcctagacgacctcccttgtatggacaacgacagcctccgacgtggaaaacccactaaccatatagtctttggcgagagtatagccatattagcttctcaagcgctcatagctttggctgtccaaaagaccacgtcatccacctttgcggacgttcccccagagaggattctcaagaccgttcaggagatggttaaagcagtggaagggcttgttgcaggtcaacaggcggatttggctggagaaggtatgagatttgatagtgacactggattagagcatcttgagtttatacatattcataaaacggcggcgttgcttgaagccgcagctgttatgggagctataatgggaggtgggtctgatgaagagattgagaggcttcggagttacgcaagatgtattgggttaatgtttcaggttgtggacgatgtgcttgatgtgaccaaatcgtcggaagagctcgggaaaaccgccggtaaagatttgatcgccggaaaactgacgtatccgagactgatgggagtggagaaatcgaaagaatatgctgagagattgaacatagaagcgcgggaacatcttctagggtttgatatagacaaggtggctcctttggtgtctctcgctgattacattgtcaacagacaaaactga

SEQ ID NO: 13678 - protein, 344 aa, Arabidopsis thaliana
MENREVFVYIVISIFRSLQFLFWRFRPRYNDVTSALTRPLTSAASYDFKFMSYMVNKAKSVNKALEEAVPLREPELKIREAMRYTLLSDGKRVRPMLCLAACELVGGQESTAMSAACAIEMLHASSLILDDLPCMDNDSLRRGKPTNHIVFGESIAILASQALIALAVQKTTSSTFADVPPERILKTVQEMVKAVEGLVAGQQADLAGEGMRFDSDTGLEHLEFIHIHKTAALLEAAAVMGAIMGGGSDEEIERLRSYARCIGLMFQVVDDVLDVTKSSEELGKTAGKDLIAGKLTYPRLMGVEKSKEYAERLNIEAREHLLGFDIDKVAPLVSLADYIVNRQN

SEQ ID NO: 13679 - DNA, 921 bp, Arabidopsis thaliana
  CDS (1)..(921)
atggctactactgttcatctcagctcattctccctcttcatccaatccagaggaagaagagacaactccatatcttccgtcaagagtctcaaaaaacgcacagaacccctcacggtccaggaagccgtgcggtactcattgctagcgggcggaaaacgtgtgaggcctctgctctgcattgctgtctgcgagcttgtgggaggcgacgaggctactgccatgtcagctgcttgcgcggtcgagatgatccacacaagctctctcattcatgacgatcttccgtgcatggacaatgccgacctccgtagaggcaagcccaccaatcacaaggtatttggagaagacatggcggttttggccggtgatgcgcttcttgctttggcgtttgagcacatgacggttgtgtcgagtgggttggtcgcttccgagaggatgatccgggcagtggttgagctggcaagggccatagggacaaaagggttagtggcagggcaagtggttgacctaagcagcgaaagattgaatccacacgacgttggattggagcgtctagagttcatccacctccacaaaacggcggcgttgttggaggcagcagcggttataggtgccataatgggaggtggaacagaggaagagatcgaaaagcttagaaagtatgctaggtgtattggactattgtttcaggttgttgatgatattcttgacgtaacaaaatctacagaggaattgggaaagactgcaggaaaagacgtaatggctggaaagctgacgtatccaaggctgataggtttggagagatccagggaagttgcggagaaactgagcagagaagccgaggagcagcttctagggtttgagtctgacaaggcggcgcctctggtagctcttgctagctacatttcttgcagaaacgactga

SEQ ID NO: 13680 - protein, 306 aa, Arabidopsis thaliana
MATTVHLSSFSLFIQSRGRRDNSISSVKSLKKRTEPLTVQEAVRYSLLAGGKRVRPLLCIAVCELVGGDEATAMSAACAVEMIHTSSLIHDDLPCMDNADLRRGKPTNHKVFGEDMAVLAGDALLALAFEHMTVVSSGLVASERMIRAVVELARAIGTKGLVAGQVVDLSSERLNPHDVGLERLEFIHLHKTAALLEAAAVIGAIMGGGTEEEIEKLRKYARCIGLLFQVVDDILDVTKSTEELGKTAGKDVMAGKLTYPRLIGLERSREVAEKLSREAEEQLLGFESDKAAPLVALASYISCRND

SEQ ID NO: 13681 - DNA, 1264 bp, Arabidopsis thaliana
  CDS (1)..(1083)
atggctactactgttcatctcagctcatcctccctcttcagccaatccagaggaagaagagacaactccatatcttccgtcaagagtctccgaaaacgcaccgttttatctctctcttctgccctcacctcacaagacgcagggcacatgattcaaccagagggaaaaagcaacgataacaactctgcttttgatttcaagttgtatatgatccgcaaagccgagtctgtaaatgcggctctcgacgtttccgtaccgcttctgaaaccccttactatccaagaagcggtcaggtactctttgctagcgggcggaaaacgtgtgaggcctctgctctgcattgccgcttgtgagcttgtggggggcgacgaggctactgccatgtcagccgcttgcgcggtcgagatgatccacacaagctctctcattcatgacgatcttccgtgcatggacaatgccgacctccgtagaggcaagcccaccaatcacaaggtatatggagaagacatggcggttttggcgggtgatgcactccttgcattggcgtttgagcacatgacggttgtgtcgagtgggttggtcgctcccgagaagatgattcgcgccgtggttgagctggccagggccatagggactacagggctagttgctggacaaatgatagacctagccagcgaaagattgaatccagacaaggttggattggagcatctagagttcatccatctccacaaaacggcggcattgttggaggcagcggcagttttaggggttataatgggaggtggaacagagcaagaaatcgaaaagcttagaaagtatgctaggtgtattggactactgtttcaggttgttgatgacattctcgacgtaacaaaatctactgaggaattgggtaagacagccggaaaagacgtaatggccggaaagctgacgtatccaaggctgataggtttggagggatccagggaagttgcagagaaactgaggagagaagcagaggaacagcttctagggtttgatccaagtaaggcggcgcctttggtggctcttgccagctacattgcttgcagacacaactgatacttttcatggactgatcaatgcatctaatcttctaacaagtccttttacttggatctatggtcttgttttttataaatcatcaatgctgtgtgatcatctctctcatgtgttttcaagttgtattatgtttttgaatcttaataatgtaatgttggaaaaatatcaatacggtttgctc

SEQ ID NO: 13682 - protein, 360 aa, Arabidopsis thaliana
MATTVHLSSSSLFSQSRGRRDNSISSVKSLRKRTVLSLSSALTSQDAGHMIQPEGKSNDNNSAFDFKLYMIRKAESVNAALDVSVPLLKPLTIQEAVRYSLLAGGKRVRPLLCIAACELVGGDEATAMSAACAVEMIHTSSLIHDDLPCMDNADLRRGKPTNHKVYGEDMAVLAGDALLALAFEHMTVVSSGLVAPEKMIRAVVELARAIGTTGLVAGQMIDLASERLNPDKVGLEHLEFIHLHKTAALLEAAAVLGVIMGGGTEQEIEKLRKYARCIGLLFQVVDDILDVTKSTEELGKTAGKDVMAGKLTYPRLIGLEGSREVAEKLRREAEEQLLGFDPSKAAPLVALASYIACRHN

SEQ ID NO: 13683 - DNA, 1161 bp, Streptomyces coelicolor A3
  CDS (1)..(1161)
atgacggagacccggcgcggcgccaccgcgacgtgccgtcccaccggggcgccggaaaggcacgggcccatcggcacacagcgcgagaaggagccgggggagccgtccgacgggcagggggaggcggtggtcgaagggcacgaggcggccctgctcctgagcgagtcacgagcgtcggtcgatcccgaactgcggtccgccatcgcgacgctgccggagtcgatgcgccgggtcgcgctctaccacttcggctggcagcacgcggacggcacgcccgcggcgggcaacgcgggcaaggcgatccgccccgcgctcgtcctcaccgcggcggccgcgctcggcggcccgggggcccgcgcggcggccgtccgtgccgcggcggcggtggagctggtccacaacttcaccctgctgcacgacgacgtgatggaccgcgacgccacccggcggcaccggccgaccgcgtggaccgtgttcggcgacgccgacgcgatcctggccggggacgcacttcaggcgctcgccctgcggctgttcgccgccgacccgcatccggcgtccgcggcggcggccacccggctcgccgactgcgtcatggagctgtgcgagggccagcacgcggacacggcgatggagcggcccccgccggacgaggtgaccctcgacgagacgctcgtcatggccgaggccaagacgggtgccctgctgggctgcgcctgtgccgtcggcgcgctgtacgcgggcgccgccacggaggacgtcgaggccctggacgccttcggccgtgagccgggaatggccttccagctcatcgacgacgtcatcggcatatggggcgacccggcgccacaccggcaagccggccggtgcgacctggccgcccgcaagaagtcactgccggtggtcgccgccctcacctccggcaccccggccgccgccgaactggccgagctgtacacaggcccgtacgacgagaacaaggaggacctggagcgcaccgccctggccgtggagcgggccggcggccgggactgggcacaggcccaggcggccgaccggatggcgagggccatgcaggagctggcgcgtgccgtgcccgagccggaggcggcgggcggcctgctcgccctggccgagttcgtgacgcggcgcagcacctga

SEQ ID NO: 13684 - protein, 386 aa, Streptomyces coelicolor A3
MTETRRGATATCRPTGAPERHGPIGTQREKEPGEPSDGQGEAVVEGHEAALLLSESRASVDPELRSAIATLPESMRRVALYHFGWQHADGTPAAGNAGKAIRPALVLTAAAALGGPGARAAAVRAAAAVELVHNFTLLHDDVMDRDATRRHRPTAWTVFGDADAILAGDALQALALRLFAADPHPASAAAATRLADCVMELCEGQHADTAMERPPPDEVTLDETLVMAEAKTGALLGCACAVGALYAGAATEDVEALDAFGREPGMAFQLIDDVIGIWGDPAPHRQAGRCDLAARKKSLPVVAALTSGTPAAAELAELYTGPYDENKEDLERTALAVERAGGRDWAQAQAADRMARAMQELARAVPEPEAAGGLLALAEFVTRRST

SEQ ID NO: 13685 - DNA, 876 bp, Paracoccus marcusii
  CDS (1)..(876)
atgagacgagacgtcaacccgatccacgccacccttttgcagaccagaattgaggagatcgcccagggattcggtgccgtgttgcagccgcttggcgcggccatggcggcgctgtcctcgggcaagcgtttccgcggcatgctgatgctgctggcggccgaggcttcgggcggggtctgcgacacgatcgtcgacgccgcctgcgcggtcgagatggtgcatgccgcatcgctgatcttcgacgacctgccctgcatggacgatgccgggctgcgccgcggccagcccgcgacccatgtggcgcatggcgaaagccgcgccgtgctgggcggcatcgccctgatcaccgaggcgatggccctgctggccggtgcgcgcggcgcgtcgggcacggtgcgggcgcagctggtgcggatcctgtcgcggtccctggggccgcagggcctgtgcgccggccaggacctggacctgcatgcggccaagaacggcgcgggggtcgaacaggaacaggacctgaagaccggcgtgttgttcatcgccggactggagatgctggccgtgatcaaggagttcgacgccgaggagcagacccagatgattgattttggccgtcagctgggccgggtgttccagtcctatgacgacctgctggaagttgtgggcgaccaggcggcgcttggcaaggataccggtcgcgatgcggcggcccccggcccgcggcgaggccttctggccgtgtcagacctgcagaaagtgtcccgccagtatgaggccagccgcgcccagctggaagggatggtgggcagcaagcgccttcaggctccggaaattgaggccctgctggaacgggttttgccttacgccgcgcgcgcctag

SEQ ID NO: 13686 - protein, 291 aa, Paracoccus marcusii
MRRDVNPIHATLLQTRIEEIAQGFGAVLQPLGAAMAALSSGKRFRGMLMLLAAEASGGVCDTIVDAACAVEMVHAASLIFDDLPCMDDAGLRRGQPATHVAHGESRAVLGGIALITEAMALLAGARGASGTVRAQLVRILSRSLGPQGLCAGQDLDLHAAKNGAGVEQEQDLKTGVLFIAGLEMLAVIKEFDAEEQTQMIDFGRQLGRVFQSYDDLLEVVGDQAALGKDTGRDAAAPGPRRGLLAVSDLQKVSRQYEASRAQLEGMVGSKRLQAPEIEALLERVLPYAARA

SEQ ID NO: 13687 - DNA, 897 bp, Zymomonas mobilis
  CDS (1)..(897)
atggcagttaatcttaagaccatgatggaacaggtcgctcaggatattgaccggctttttgctgaacaattaccggttccagaagacccccgtcgccgcttggtagaggccatgcgctatgccgcaatcggtggcggaaaaagactgcgtcctcttctggttgtcgccacctgcgccttgttcaatgtcgatcgcgaagccgctttacgggtcggcatggctatcgaatgtatccatgtctattctttgattcatgatgacatgccctgcatggataatgatgatttgcggcgtggcaaacccactgttcataaagcctttgatgatgcttctgcggttctttccggtgacgcgcttcaggctttggcttttgaaattctttcagaagaaaaaatccataccgatccccatgttcggctagaattgattcaggctttgctatcgcctccggtaaaagacggtatggtcggtggacaggccatcgatttggccgcagaaacctcgacggtgccttttgatcttccgaccatcacccgcttgcaacagcttaaaaccggcgccttattcggtttttgtttagaagccggtgctatcatgggtcgtcagaataaagacatccgtgatcgtctgaaggcctatgcccgtgatatcggtcttgctttccagattgctgatgatctgatcgatgccgaaggtgacgaagccgttgccggaaaagcagttggtaaagatgctgccgccggaaaagcgaccttcctgtctctgttaggtctcgaaaaagcccgttcacaggcacaggcattagtcgaccaggcgattgctcatctgtctgttttcggatcagaagccgattatttacggagtattgctcgctatatcgtagcgcgcgatcactaa

SEQ ID NO: 13688 - protein, 298 aa, Zymomonas mobilis
MAVNLKTMMEQVAQDIDRLFAEQLPVPEDPRRRLVEAMRYAAIGGGKRLRPLLVVATCALFNVDREAALRVGMAIECIHVYSLIHDDMPCMDNDDLRRGKPTVHKAFDDASAVLSGDALQALAFEILSEEKIHTDPHVRLELIQALLSPPVKDGMVGGQAIDLAAETSTVPFDLPTITRLQQLKTGALFGFCLEAGAIMGRQNKDIRDRLKAYARDIGLAFQIADDLIDAEGDEAVAGKAVGKDAAAGKATFLSLLGLEKARSQAQALVDQAIAHLSVFGSEADYLRSIARYIVARDH

SEQ ID NO: 13689 - DNA, 975 bp, Synechococcus elongatus
  CDS (1)..(975)
atggaacaacactaccgcgatacgattgagcaagcaattgcaagagcactcgaccgcaccgaattgcctccgatcctcgatgagcctgtccgctacgcgctagccagtgggggcaaacgtcttcggccgctgattacgctcttggctgccgaagcctgcgggagctcgcctgccgatgctgcgcctgttgcagccgcagtcgaaattctccacaacttcacgctcattcacgacgacatcatggatcgctcgccactgcgacgcggccgaccaacagtctatcgagcctgggacgatgcaacggcaatactagcaggggatacgatgatgggtattgcttaccgattgctcagcgagcattaccctgcggaggtctgccagcaccttgtggcggagtgctcttcggcatttgtggacgtgtgcatcggccaagcagaagatcttgcattccgcacaatgccatcggtaacgatggatgactacctccgcatgatcggacgcaagaccgctcggctctttgcgactgcagcagttgcagggggaatcgtcgctcgagcgccgcacgatgtgcttgctgcactccgcacctatggtacagcactcggcatggccttccaaatccgagacgatgtgctcgatctgttcggctcgccagagttcggcaaagagcttgggcaagacttgcgcgaagggaagaagaccttccccaccttgagcgctgctgcccatgcaactgatccaaatgatctcgccacattcgcagcgtacttcgctggcactccacctacggacagcgaagaaatcgcgcagatgagagaacggtgccgtcggcttggtgcgctcgaacatgccgagtcgctcatcgctcactatctctccactgcaaacgccgcgttagaatcgcacttgccatcaacttctgcacgtgatagactctgcgctctggcacgtgcaacgcgtaatcggcacctgtag

SEQ ID NO: 13690 - protein, 324 aa, Synechococcus elongatus
MEQHYRDTIEQAIARALDRTELPPILDEPVRYALASGGKRLRPLITLLAAEACGSSPADAAPVAAAVEILHNFTLIHDDIMDRSPLRRGRPTVYRAWDDATAILAGDTMMGIAYRLLSEHYPAEVCQHLVAECSSAFVDVCIGQAEDLAFRTMPSVTMDDYLRMIGRKTARLFATAAVAGGIVARAPHDVLAALRTYGTALGMAFQIRDDVLDLFGSPEFGKELGQDLREGKKTFPTLSAAAHATDPNDLATFAAYFAGTPPTDSEEIAQMRERCRRLGALEHAESLIAHYLSTANAALESHLPSTSARDRLCALARATRNRHL

SEQ ID NO: 13691 - DNA, 903 bp, Synechococcus elongatus
  CDS (1)..(903)
atgcccggaacgaacagcgatttccagtcctgggcgcgcagccgccaagccctggtggaagaggccttgaaccgactgttgccgccggcggaggtggcgccccagcggctgcaccaggcgatgcgttacgcggttctgggaggcggcaagcgggtgcggccactgctgtgctacgccgcgggcgaggtgagcggcgctgagctggagcgactgagcaccgctgcagccgccctggagctgatccacgtctattcgctggtgcacgacgacctgccctgcatggacgacgatgtcctgcgccgaggaaaacccacctgtcacgtggaatacgacgaggccaccgccctcctcgctggcgatagcctgcagagcctggcgttccagctgctggccgagtatcgggtggccgactccccccagacccagctgcgcatgctggagcatctggcccgagcggccggctcccgaggcatggcgggcggccaggcgatcgacctggaagccaccggcaagaccctaacgcttccggagctggaattcatgcacatccacaagaccggcgcgctgatccgtgcctccgtgatcctaggggcaaactgcggccgagcgcttgcgtccaaggacatggaccggctggaccacttcgccaagcgcatcggtctcgcctttcaagtggtcgacgacgtgctcgatgcccagtccaccaccgccaccctgggcaaaaccgccggcaaggacgcacgccagggcaaacccacttacgtgtccacggtgggggtggaggcggcccgggccatggcccaagagttgaagcgggaagcggtggaaagcctcgcccccttcggcgaacgggcccggcggctgcgggagctcgccgagtacatcgtgagccgcgagttttga

SEQ ID NO: 13692 - protein, 300 aa, Synechococcus elongatus
MPGTNSDFQSWARSRQALVEEALNRLLPPAEVAPQRLHQAMRYAVLGGGKRVRPLLCYAAGEVSGAELERLSTAAAALELIHVYSLVHDDLPCMDDDVLRRGKPTCHVEYDEATALLAGDSLQSLAFQLLAEYRVADSPQTQLRMLEHLARAAGSRGMAGGQAIDLEATGKTLTLPELEFMHIHKTGALIRASVILGANCGRALASKDMDRLDHFAKRIGLAFQVVDDVLDAQSTTATLGKTAGKDARQGKPTYVSTVGVEAARAMAQELKREAVESLAPFGERARRLRELAEYIVSREF

SEQ ID NO: 13693 - DNA, 1341 bp, Mentha piperita
  CDS (82)..(1215)
tgacgttgttgtttcttggcacagatttccagttgcagtgctgggttaatatttactaatatatctttttttgagggaaaaatgagtgctcttgttaatcctgtggcgaaatggcctcagacgatcggcgttaaagatgttcacggcggccggaggcggagatccagatccactctctttcaatcccatccacttcgcactgaaatgcctttctctctctacttctcatcccccctcaaagctcccgccactttttccgtttctgcagtttataccaaagagggcagcgaaattagggataaagatccggcgccttcgacttcgccggcgttcgatttcgacggatacatgctccggaaggcgaaatccgtcaacaaggcgttggaagcggcggtgcagatgaaggagccgctgaagatccacgagtccatgcggtactcccttctcgccggcggcaagagagtgcgtcctatgctgtgcatcgcggcctgcgagctcgtcggcggcgacgagtccacggcgatgccggcggcctgcgccgtcgagatgatccacacgatgtcgctgatgcacgacgacctcccatgcatggacaacgacgacctccgccgcggcaagccgacgaaccacatggctttcggcgagagcgtggcggtcctcgccggcgacgccctcctctccttcgcgttcgagcacgtggcggcggcgaccaaaggcgcgccgccggagcggatcgtgagggtcctcggcgagctggctgtctcgatcgggtcggaggggctggtggcggggcaggtggtggacgtctgctcggaggggatggcggaggtcgggctggaccacctcgagttcatccaccaccacaagacggcggcgctgctgcaggggtcggtggttctgggggcgattttgggcggcggaaaggaggaggaggtggcgaagctgagaaaattcgcgaattgcatcggattgctgtttcaggtggtggacgatatcctagatgtgacgaaatcgtccaaggaattggggaagacggcggggaaggatctggtggcggataaaaccacatatccgaagctaataggcgtggagaaatccaaggaattcgcggatcggttgaacagggaggcgcaggagcagctcctccattttcatcctcatagggcagctccattgattgctctcgccaattatattgcttatagggacaattgattccatcttcctcctctcacaatcttcacttcactcaataaacacaaacatgatgctcctttctactcacaaattattcaaataaaaaaatttaaatgcttgttattcaaaaaaaaaaaaaaaaaa

SEQ ID NO: 13694 - protein, 377 aa, Mentha piperita
MSALVNPVAKWPQTIGVKDVHGGRRRRSRSTLFQSHPLRTEMPFSLYFSSPLKAPATFSVSAVYTKEGSEIRDKDPAPSTSPAFDFDGYMLRKAKSVNKALEAAVQMKEPLKIHESMRYSLLAGGKRVRPMLCIAACELVGGDESTAMPAACAVEMIHTMSLMHDDLPCMDNDDLRRGKPTNHMAFGESVAVLAGDALLSFAFEHVAAATKGAPPERIVRVLGELAVSIGSEGLVAGQVVDVCSEGMAEVGLDHLEFIHHHKTAALLQGSVVLGAILGGGKEEEVAKLRKFANCIGLLFQVVDDILDVTKSSKELGKTAGKDLVADKTTYPKLIGVEKSKEFADRLNREAQEQLLHFHPHRAAPLIALANYIAYRDN

SEQ ID NO: 13695 - DNA, 1057 bp, Scoparia dulcis
  CDS (1)..(1056)
atgagccttgtaaaccccgtctccacatggccaaaccccacccggagctccgtattccgacccaaacccgccatcctcaacacgacccacttacccatctccttcctattcgccggaaaacccatctccgccgtcctcaccaaagagtacagccaccaaacctcctccaccttcgacttcaagaagtacatgctcgagaaagcctcctccgtcaacaaagccttagaatccgcagtctccctcaaagaacccctcaagatccacgaatctatgcgctactctcttctcgcggggggcaaaagggtccgccccatgctctgcctcgccgcctgcgagctcgtcggcggccacccctccaccgccatgcctgccgcctgctccatcgagatgatccacaccatgtccctcatgcacgacgacctcccctgcatggacaacgaccatctccgccgcggccatcccactaaccacatcgtcttcggagaggacgtcgctgtcctcgccggcgacgctcttcttgcctattccttcgaatacttagccaccgcgacagagggagtccttcctgaacggatagtcagagtgatcgccgagttggcgaaatgtatccgctcagaaggccttctggcggggcaggtggtggatatatgctctgaaggcgtgagcgagatcgggttggagcatttggagtacatacatttgcacaagacggcggcgttgctcgagggctcggtcgtcttgggcgcgattttgggtggcgggaatgatgaagaggttgaaaggttgaggaagtttgccaggtgtattgggctgttgtttcaggtggtggatgatattcttgatgttactaaaacgtcggtggagctggggaagacggccgggaaagatttggtggcggataagaccacgtatccgaagctgattgggattgagaagtcgagggagtttgcggagaagttgaaccgggaggcgcaggaacagcttgtagggtttgattcggataaggccgcgccgttgattgcgctcgcgaattatattgcgtatagggagaattgag

SEQ ID NO: 13696 - protein, 351 aa, Scoparia dulcis
MSLVNPVSTWPNPTRSSVFRPKPAILNTTHLPISFLFAGKPISAVLTKEYSHQTSSTFDFKKYMLEKASSVNKALESAVSLKEPLKIHESMRYSLLAGGKRVRPMLCLAACELVGGHPSTAMPAACSIEMIHTMSLMHDDLPCMDNDHLRRGHPTNHIVFGEDVAVLAGDALLAYSFEYLATATEGVLPERIVRVIAELAKCIRSEGLLAGQVVDICSEGVSEIGLEHLEYIHLHKTAALLEGSVVLGAILGGGNDEEVERLRKFARCIGLLFQVVDDILDVTKTSVELGKTAGKDLVADKTTYPKLIGIEKSREFAEKLNREAQEQLVGFDSDKAAPLIALANYIAYREN

SEQ ID NO: 13697 - DNA, 1107 bp, Croton sublyratus
  CDS (1)..(1107)
atgagttctgtgaatttaggttcatgggttcatacttcctctgttataagtcaagctaccagatccagatccaaatccaaacccttatcgttttctcctgtttcgattcctctgttttaccgaaactcaaaacgcagcgtttcgtatgtttcagcgatcgtgactaaggatgaggagacgattcaggaagaacagaataagaattcaagttcttctcttggttttgatttcaaatcttacatggttcaaaaggctagtgctattaatcaagctttggaagctgctgtttcgcttcgcgagcctcttaaaattcatgaatctatgcggtactcacttttggccggcggtaagcgagtccggccggctttatgtcttgctgcgtgtgaacttgttggcggagatgaatctatggcgatgcctgctgcttgtgctgttgaaatgatacatactatgtcgcttatacatgacgacctgccgtgcatggataacgacgatctccgtcgtggtaagccgacgaatcatattgtgtttggtgaaaatgtggcggttcttgcaggtgatgcgcttcttgcttttgcttttgaacatattgctgtttctactttaaatgtttctcctgtcagaattgttcggggggtaggtgaattggctaaggcgattggtgctgaaggattggttgctggacaggttgttgatatctgttctgaaggtttatctgaagtagatttagaaaagcttgaatttattcatattcataagacagcaaaattgctggaaggagcggtggtgttaggggcaattatgggcggaggaaccgatgaagaggtggaaaaattgaggaaatatgcaagggatattgggttgttgtttcaggtagtggatgatattcttgatgtgaccaaatcgtctcaagaattggggaaaactgcaggaaaggatttggtggcggataaggttacttatcctaagttaatggggattgagaaatcaagggaatttgctgagaagttgaataaagaagctcaggagcaattggctggtttcgatcctgagaaggcggctccattgattgctttagctaattacattgcatacaggcaaaactaa

SEQ ID NO: 13698 - protein, 368 aa, Croton sublyratus
MSSVNLGSWVHTSSVISQATRSRSKSKPLSFSPVSIPLFYRNSKRSVSYVSAIVTKDEETIQEEQNKNSSSSLGFDFKSYMVQKASAINQALEAAVSLREPLKIHESMRYSLLAGGKRVRPALCLAACELVGGDESMAMPAACAVEMIHTMSLIHDDLPCMDNDDLRRGKPTNHIVFGENVAVLAGDALLAFAFEHIAVSTLNVSPVRIVRGVGELAKAIGAEGLVAGQVVDICSEGLSEVDLEKLEFIHIHKTAKLLEGAVVLGAIMGGGTDEEVEKLRKYARDIGLLFQVVDDILDVTKSSQELGKTAGKDLVADKVTYPKLMGIEKSREFAEKLNKEAQEQLAGFDPEKAAPLIALANYIAYRQN

SEQ ID NO: 13699 - DNA, 1324 bp, Daucus carota
  CDS (84)..(1184)
cagtacatctctatatctgtacgaaccttcactaagctgcaacagaaaaattctctatacccagaacaaatccttactttggaatggcaagtgttatgaatctaagcataacccatttttgtagctctcatcttaagcagaaatcacctaacaaacttgttttccatggcctcaactcaaaccctaatttctcgaaatcaaagccaccacaaaatgtcatcccatattcatctctgtccatatcttccgtacaaacaactaaaatagtcatggattcatcgcccacaccctccacatttgatttcaagtcatacatgctcgaaaaggccatttctgtcaacaaagccctagacgcttcagtctcactccaagagcctgtcaaaatacacgagtcaatgcgttactccctccttgcagggggcaagcgtgtccgtcctcttcttagtattgcagcctgcgagctttttggagggcacgaggccgtggccatgccctccgcttgtgctgtggagatgatccacacgatgtccctcatgcacgacgatctcccttttatggacaatgatgatctgcgtcgaggcaagcctactaaccacaaagtctatggtgaaagcgttgctgttcttgctggagacgcgatgttagccctggcggctttccaccttgtagctactgagaccagaggagtctcgtcggatcaggtggttagagtgatcgttgagctggctaaggcaataggcgcagaagggttggttgcaggacagattgtggatgtatgttctgaaggtgatcctaatctcggattagaagatttggagtttattcatcggagcaaaactgcagcattactggaaggttcggttgtgatgggggcaattttgggaggtgcaaatgatgaggaagttgagaaagtgagaaagtatgctaggtgcattggattgttgtttcaagtagttgatgatattcttgatgtcacaaagtcttccaaagaattaggaaaaacggctgggaaagatttggtggccgataagacgacgtatcctaaacttattgggattgagaaatcaagagagttttctgatgagttgaaaagggaagctatagatcagcttgctggatttaattcagataagactgcgcctttgattgctatggctaattacattgcaaatcgagataactgaaatgtgtttaaaaatcagaactgcttaattctgttgctctagcatgtttaagaagaaaatgctgatatatttccagaactagttggttaatttttcatgaataatcagcacttatgttttttcaaaaaaaaaaaaaaaaa

SEQ ID NO: 13700 - protein, 366 aa, Daucus carota
MASVMNLSITHFCSSHLKQKSPNKLVFHGLNSNPNFSKSKPPQNVIPYSSLSISSVQTTKIVMDSSPTPSTFDFKSYMLEKAISVNKALDASVSLQEPVKIHESMRYSLLAGGKRVRPLLSIAACELFGGHEAVAMPSACAVEMIHTMSLMHDDLPFMDNDDLRRGKPTNHKVYGESVAVLAGDAMLALAAFHLVATETRGVSSDQVVRVIVELAKAIGAEGLVAGQIVDVCSEGDPNLGLEDLEFIHRSKTAALLEGSVVMGAILGGANDEEVEKVRKYARCIGLLFQVVDDILDVTKSSKELGKTAGKDLVADKTTYPKLIGIEKSREFSDELKREAIDQLAGFNSDKTAPLIAMANYIANRDN

SEQ ID NO: 13701 - DNA, 1316 bp, Daucus carota
  CDS (17)..(1120)
atcactaatacaaatcatggcgtttattcaaaccaatacagcccatgaaaactcactcttgtccaagaatttactgttcgatcatctcaaaaacactggtaaaaccccatcaagctactgcactagacatcatcctatgaagattcaaggcgcaaatgctgtgaattcaactcttgtccaatcagttaacgtccaagaactcctgacaaatccccgtgttacgcctggtccagagtttcattttgaaggttacatgaaaacctcaggtaaaaagataaacaaagcgctggacgaggctgttccagtgcaaaaaccagctatcatccacgaagcgatgcggtattcgcttctggccgggggcaaacgcgtccggccagtgctgtgcatcgcttcgtgtgagttggtaggagggctggagtcatgggctatgcccatggcctgcgccctcgaaatgatccacaccatgtctctaatccatgacgacctcccgtgcatggataacgacgacttgagacgtggcaaaccgacgaatcacaaggtttatggcgaagaaaccgcgattcttgcaggtgatgccttgctctccctagcattcgagcatgtagcggacgcaaccgatatggtgaccccgggtcgggtggttcgggctattgcggagctaggttcggctgtgggctcacaagggctcgtggcgggtcagataatggacatatgtaaccaaggaaaagacgtggatttgaacgacttggagtatattcatgtccacaaaacatcgaagcttctagaagcttcggtggtttgtggagctatattgggaggtgggaatgttattgaggtggagaggttgagaaaatatgcgaggtgtattggattgttgtttcaagtggttgatgatattttagatgttaccaaatcatctgcggagctcgggaagacagccgggaaagatttagtcaccgataagacgacgtatccgaagctaatgggattggagagggctaagagattcgcgacggagctggtggctcaggcggaggaggaactcagttattttggatcgtcagcaagggtggccccgttgtaccatctggctaagtatattgcttatagacaaaactgaggactactagattaatattattgtaccaactaccaagtagtactatgttatgtatgttgcttgttctgctgtatctcttgttggtttcttctccagatgaacattagaagcaaaagtaaaatatatatgtcatattgaattgctacgaactatgaagagcatgcaccaacagttgacaaaaaaaaaaaaaaaaaaa

SEQ ID NO: 13702 - protein, 367 aa, Daucus carota
MAFIQTNTAHENSLLSKNLLFDHLKNTGKTPSSYCTRHHPMKIQGANAVNSTLVQSVNVQELLTNPRVTPGPEFHFEGYMKTSGKKINKALDEAVPVQKPAIIHEAMRYSLLAGGKRVRPVLCIASCELVGGLESWAMPMACALEMIHTMSLIHDDLPCMDNDDLRRGKPTNHKVYGEETAILAGDALLSLAFEHVADATDMVTPGRVVRAIAELGSAVGSQGLVAGQIMDICNQGKDVDLNDLEYIHVHKTSKLLEASVVCGAILGGGNVIEVERLRKYARCIGLLFQVVDDILDVTKSSAELGKTAGKDLVTDKTTYPKLMGLERAKRFATELVAQAEEELSYFGSSARVAPLYHLAKYIAYRQN

SEQ ID NO: 13703 - DNA, 954 bp, Archaeoglobus fulgidus
  CDS (1)..(954)
atgctgaaggaggaaatagcgaaaagggccgaaataatcaacaaagccattgaagagcttctgcccgaaagggagccgattggactctacaaagccgcaaggcatctgatcaaagcaggtggcaagaggctaaggcctgtaataagcctcttagcagtcgaagcccttgggaaagactacagaaagattatcccggctgctgtcagcattgaaacaatccacaacttcaccctcgtgcatgacgacataatggacagggacgagatgaggaggggagttccgacggtacacagggtttatggggaagcgacggccattttagcaggcgacacactctttgctgaagccttcaagctgctgacaaagtgcgatgttgagagcgagggaatcagaaaagctacagaaatgctttcggacgtttgcataaaaatatgcgaggggcagtactacgacatgagctttgagaaaaaggagagcgtttccgaggaggagtatctcaggatggtcgagctgaagaccggagtgctgattgcagcttctgcagcattacctgcggtgctttttggggagagcgaggaaattgtaaaggcgctgtgggactacggagttcttagcggtattggcttccagatccaggacgacctgcttgacctgactgaggagaccggaaaggactggggaagcgacctgcttaaagggaagaaaaccctgattgtcataaaggcgttcgaaaagggagtgaagctaaagacgtttggaaaggaaaaggcggacgtctctgagattagagatgatatcgaaaagttaagagagtgtggtgcgattgattacgctgccagcatggcaagaaagatggctgaagaggcgaaaagaaagctcgaagttctgcctgaaagcaaagccaaggaaacactgctggaacttaccgacttcttggttacaagaaaaaagtga

SEQ ID NO: 13704 - protein, 317 aa, Archaeoglobus fulgidus
MLKEEIAKRAEIINKAIEELLPEREPIGLYKAARHLIKAGGKRLRPVISLLAVEALGKDYRKIIPAAVSIETIHNFTLVHDDIMDRDEMRRGVPTVHRVYGEATAILAGDTLFAEAFKLLTKCDVESEGIRKATEMLSDVCIKICEGQYYDMSFEKKESVSEEEYLRMVELKTGVLIAASAALPAVLFGESEEIVKALWDYGVLSGIGFQIQDDLLDLTEETGKDWGSDLLKGKKTLIVIKAFEKGVKLKTFGKEKADVSEIRDDIEKLRECGAIDYAASMARKMAEEAKRKLEVLPESKAKETLLELTDFLVTRKK

SEQ ID NO: 13705 - DNA, 1131 bp, Oryza sativa
  CDS (1)..(1131)
atgcacgtcctcgctcaatccacggccgtggccaaggtcgccgcctccggctgcctccgacgaagcccgaacccctccgtgacgttccagagatccccttcccttcttctctcgccggccgcgtgccgccgccgctgccgccgcgggtgctccgtctccgtcgacgtgaggtgctccctgggcgccatggtcacgccggagctgaacggcggcgacgtcggcgtcggcgtcggcggtggtagcttcgactttcagcggtatctgtctgccagggccgacgccgtgcacgacgcgctggaccgggccatgccgcgcggcttcccggagcggctctgcgagtccatgcgctactccgtcctcgccggcggcaagcgggtgcgccccgtgctcgcgctggccgcgtgcgagctcgtcggcggggacgccgcggcggccacgcccgtcgcctgcgcggtcgagatgatccacaccatgtcgctcatccacgacgacatgccgtgcatggacgacgacgccctccgccggggccgcccctccaaccacgtcgccttcggcgagttcaccgccctcctcgccggcgacgcgctccacgccctcgcgttcgagcacgtggcgcgcggctgcggcgaccacggcgtccccgcggaccgcacgctccgggcggtcgccgagctcgggagcgcctcgggcaccggcggggtcgccgccgggcaggtcgccgacaaggagagcgagggcctccccgtcagcctcgccatgctggagtacatccacgtgcacaagacggcgaggctcctcgaggccgccgccgtgtccggcgccatcgtcggcgggggcgcggacgccgaggtggagagggtccggcggtacgcgcgctgcgtcgggctcctcttccaggtggtcgacgacgtgctcgacatgacgagcacatcggagcagctcgggaagacggccgggaaggacgtcgaggccgacaaggccacttacccgaagctgctcggcgtcgacaaggcccgcgagtacgccgccgacctcctcgccatggccgaggcggagctcgacgggttcgacgccgagcgcgccgcgccgctgcgacacctcgcgcggttcatcgcctacaggcagcattaa

SEQ ID NO: 13706 - protein, 376 aa, Oryza sativa
MHVLAQSTAVAKVAASGCLRRSPNPSVTFQRSPSLLLSPAACRRRCRRGCSVSVDVRCSLGAMVTPELNGGDVGVGVGGGSFDFQRYLSARADAVHDALDRAMPRGFPERLCESMRYSVLAGGKRVRPVLALAACELVGGDAAAATPVACAVEMIHTMSLIHDDMPCMDDDALRRGRPSNHVAFGEFTALLAGDALHALAFEHVARGCGDHGVPADRTLRAVAELGSASGTGGVAAGQVADKESEGLPVSLAMLEYIHVHKTARLLEAAAVSGAIVGGGADAEVERVRRYARCVGLLFQVVDDVLDMTSTSEQLGKTAGKDVEADKATYPKLLGVDKAREYAADLLAMAEAELDGFDAERAAPLRHLARFIAYRQH

SEQ ID NO: 13707 - DNA, 1889 bp, Taxus canadensis
  CDS (308)..(1489)
ggaagagcggcaatcattctgtcatttaaaggttttctgcaccgaaatcctttaattttaaggttttctggaaggtgtgtgtgaaaatttgaagaaaattaacaagactgtaagtgtttttatatatttatgagctttggtttacttgggtgttactgaattggaacatacgtgcatgtcggagcaaagcagcatatttgaaatttgtgggtgttctttgaggtgtgttgcggatatagatttgattgttcagagttagtgtattttttttttttgttggttagattaattgggcaagttatagagaatggcttacacggcaatggcagcagggacccaaagcttgcaactccgcactgttgcttcctatcaagaatgcaatagtatgaggagttgttttaaattgacaccttttaaaagttttcatggagtgaatttcaatgttccctcactgggtgctgctaattgtgagattatgggtcacctgaaacttgggtcattgccatataaacaatgttcggtgtcatctaaatccacaaaaacaatggcccagttggttgatttggctgaaacagagaaggcggagggaaaggatattgaatttgatttcaacgagtatatgaagtccaaggctgtggcagtggatgcggcactggataaggcaatcccacttgaatatcctgaaaaaatacatgaatcaatgaggtattcacttctagcaggaggtaagcgcgtcaggcctgctctgtgcattgcagcatgtgagcttgtaggagggagtcaggaccttgccatgccaactgcctgtgcaatggagatgattcataccatgtctctgattcatgatgacttgccgtgcatggataatgatgatttcagaagagggaagccaacaaatcacaaggtctttggagaggacactgctgttcttgcaggggacgccctgctttcatttgcatttgagcatattgctgtggctacaagcaagactgtgcctagtgataggactttaagggtgatatctgaattgggtaagacaataggctctcaagggcttgtaggggggcaggtggttgatattacatccgagggggatgctaatgtggacctgaaaaccctggaatggattcatatacacaagactgctgtgctcttggaatgttcagttgtgagtggagggatccttggtggtgctacagaggacgagattgcgagaattcggcggtacgcccggtgtgtggggcttctgtttcaggttgtggatgacatacttgatgtcactaaatcttctgaagaattgggaaagactgcaggaaaggatttgcttactgataaggctacttatcccaagttgatgggcctggagaaagcaaaagaatttgccgctgaattggcgacgagagccaaggaagagctgtcatcctttgatcagataaaggctgcacctttgttgggtcttgcagattacattgcattcaggcaaaactgagaacaaagctgtaaagctattcttacatatcatctgtttttttttgacatctgctgaaaattagcaaataactttttcaagtttgtatctcccctgaatcataacgattcaggacatgaggtttctggtaccattgaaaagggggcgctcattgtagttgttttttagctaattccaacctgttttctatgtttccactttggatcaatttgatgtagattatgtttgtaggggtgacattgttagacttgttacatgtcatcaaattgttttttgcggccttaacatggttttaacttttcactagcaataaggtggcctaaagtgtttatgtaatttttcaatatagatagatatcttttaacaaaaaaaaaaaaaaaaaaaaaaaaaaaaaaaaaaa

SEQ ID NO: 13708 - protein, 393 aa, Taxus canadensis
MAYTAMAAGTQSLQLRTVASYQECNSMRSCFKLTPFKSFHGVNFNVPSLGAANCEIMGHLKLGSLPYKQCSVSSKSTKTMAQLVDLAETEKAEGKDIEFDFNEYMKSKAVAVDAALDKAIPLEYPEKIHESMRYSLLAGGKRVRPALCIAACELVGGSQDLAMPTACAMEMIHTMSLIHDDLPCMDNDDFRRGKPTNHKVFGEDTAVLAGDALLSFAFEHIAVATSKTVPSDRTLRVISELGKTIGSQGLVGGQVVDITSEGDANVDLKTLEWIHIHKTAVLLECSVVSGGILGGATEDEIARIRRYARCVGLLFQVVDDILDVTKSSEELGKTAGKDLLTDKATYPKLMGLEKAKEFAAELATRAKEELSSFDQIKAAPLLGLADYIAFRQN

SEQ ID NO: 13709 - DNA, 963 bp, Bacillus stearothermophilus
  CDS (1)..(963)
atgaagttaaaggcgatgtattcgtttttaagcgatgatttagcggcggtcgaagaggagcttgagcgggcggttcagtcggaatacgggccgcttggggaagcggcgctccatctgttgcaggcgggcggaaagcggatccgtcccgtttttgtcttgcttgccgcccgcttcggccaatatgaccttgagcggatgaagcatgttgccgttgcgctcgagctcattcatatggcttcgctcgtccacgacgatgtgatcgacgacgccgatttgcgccgcggccggccgacgatcaaggcgaaatggagcaaccggttcgccatgtacacaggggattatttgtttgcccgctcgctcgaacggatggcggagctcggcaacccgcgcgcccatcaagtgttggcgaaaacgatcgtggaagtgtgccgcggggaaattgagcaaattaaagacaagtaccggtttgatcagccgctgcgcacgtatttgcggcgcatccgtcggaaaacggcgctgctcatcgccgcgagctgccagcttggcgccctcgctgccggcgcgccggagccgattgtgaagcggctgtactggttcggccattatgtcggcatgtcgtttcaaattaccgacgacattctcgatttcactgggacggaggaacagctcggcaaaccggccggaagcgacttgctacaaggaaacgtcacccttcctgtgctgtatgccttgagcgatgagcgggtgaaggcggccattgcagctgtcggtccggaaacggacgttgcggaaatggcggcggtcatttccgccattaagcggacggacgccattgagcggtcgtatgcgttaagcgaccgttaccttgacaaggcgcttcaccttcttgacggactgccgatgaatgaggcgcgcggcctgttgcgcgacctcgccctttacatcgggaaaagggattattaa

SEQ ID NO: 13710 - protein, 320 aa, Bacillus stearothermophilus
MKLKAMYSFLSDDLAAVEEELERAVQSEYGPLGEAALHLLQAGGKRIRPVFVLLAARFGQYDLERMKHVAVALELIHMASLVHDDVIDDADLRRGRPTIKAKWSNRFAMYTGDYLFARSLERMAELGNPRAHQVLAKTIVEVCRGEIEQIKDKYRFDQPLRTYLRRIRRKTALLIAASCQLGALAAGAPEPIVKRLYWFGHYVGMSFQITDDILDFTGTEEQLGKPAGSDLLQGNVTLPVLYALSDERVKAAIAAVGPETDVAEMAAVISAIKRTDAIERSYALSDRYLDKALHLLDGLPMNEARGLLRDLALYIGKRDY

SEQ ID NO: 13711 - DNA, 978 bp, Methanobacterium thermoautotrophicum
  CDS (1)..(978)
atgacggaagtattagatattctcagaaagtactctgaagtggccgataagaggataatggagtgcatcagcgacataacacctgatacgctccttaaggcatcagaacacctcataacagcaggtggtaagaagataagaccttcacttgcactccttagctgtgaggctgtaggcggaaaccctgaggacgctgcaggggtggctgcggccatagaactgatacacacattctcactcattcacgatgatataatggatgatgatgagatgaggcgaggggaaccctcagtccatgtcatatggggtgaacccatggccatacttgcaggggacgtcctcttctccaaggccttcgaggccgtcatcaggaacggggactcagaaagggtgaaggatgcccttgcagtggtggttgattcatgcgttaagatatgtgagggccaggcccttgacatgggctttgaggagaggctggatgtcacagaggatgagtacatggagatgatctacaagaagaccgcagccctcattgcagcagcaacaaaggcaggtgccataatggggggcgcatcagagagagaggttgaggccctggaggactacggcaaattcatcggcctcgcattccagatacacgacgactacctggatgtggtgagtgatgaggaatctctgggcaaacctgtgggcagtgacatagcagagggcaagatgaccctcatggttgtaaaggcccttgaggaggcatcagaggaggacagggagaggctcatatcgatcctcggatcaggtgatgagggcagtgtcgctgaggccatagagatctttgaacgctacggtgcaacccagtatgcccatgaggtggcccttgactatgtgaggatggccaaggagcgccttgagatacttgaagactcagatgcaagggacgcactcatgaggatagctgactttgtacttgaaagggaacactag

SEQ ID NO: 13712 - protein, 325 aa, Methanobacterium thermoautotrophicum
MTEVLDILRKYSEVADKRIMECISDITPDTLLKASEHLITAGGKKIRPSLALLSCEAVGGNPEDAAGVAAAIELIHTFSLIHDDIMDDDEMRRGEPSVHVIWGEPMAILAGDVLFSKAFEAVIRNGDSERVKDALAVVVDSCVKICEGQALDMGFEERLDVTEDEYMEMIYKKTAALIAAATKAGAIMGGASEREVEALEDYGKFIGLAFQIHDDYLDVVSDEESLGKPVGSDIAEGKMTLMVVKALEEASEEDRERLISILGSGDEGSVAEAIEIFERYGATQYAHEVALDYVRMAKERLEILEDSDARDALMRIADFVLEREH

SEQ ID NO: 13713 - DNA, 885 bp, Buchnera aphidicola
  CDS (1)..(885)
atgaatttttctcatttatatgacatctactataatcgtataaataaaaagttgttcgaaataatacaagaattgccctttcaggattctgttctttttagagcaatgaaatacagtaccttatcaggaggaaaaagattacgtgcatgtttaatatatgctactggagaaacatttcaagtcaatattgctgcacttgatgttatatctgctgctgttgaattagttcattcgtattctttaattcatgatgatttgccatgtattgataacgattattttagaagagggaaaatttcttgtcatataaagtatggtgaaaattttgctttattggcaggtgatgcattacaaggattggcatttaatattttatcaaatagtaatatgccaggagtacacgattctattcgtttaaaaatgattgctgagttttctaatgcaattggttattctgggatgtgtattggtcaaatgctagatttagaaaaagaaagaaaaaaaataaatatatctgaattagaaaagattaatttatataaaactgcatttttaattcggtgctctatacgtttagcttattttgcttctaacaatttttctaaagaagttttatttattttagataaattttcagtttctattggtttggcttttcaaattcaagatgatatcttggatttaaaaaatgatatcaaaaagttagagagtaaaagaaataaaacaaaaaatacatatccattattaataggattaaaaaaatctaaaattaaaataaaagaattatataaagaagctttttttacattagaaattttaaaaaaaaattttaatgttaatatattaaaattactgacacagtttataatgaaacgttttaaataa

SEQ ID NO: 13714 - protein, 294 aa, Buchnera aphidicola
MNFSHLYDIYYNRINKKLFEIIQELPFQDSVLFRAMKYSTLSGGKRLRACLIYATGETFQVNIAALDVISAAVELVHSYSLIHDDLPCIDNDYFRRGKISCHIKYGENFALLAGDALQGLAFNILSNSNMPGVHDSIRLKMIAEFSNAIGYSGMCIGQMLDLEKERKKINISELEKINLYKTAFLIRCSIRLAYFASNNFSKEVLFILDKFSVSIGLAFQIQDDILDLKNDIKKLESKRNKTKNTYPLLIGLKKSKIKIKELYKEAFFTLEILKKNFNVNILKLLTQFIMKRFK

SEQ ID NO: 13715 - DNA, 1080 bp, Micrococcus luteus
  CDS (105)..(980)
agtgagtttagagaaatccattgaattgtatgagcaaggtgtcaaattatctcaagcatgtcaattaaagctatctgaagcagaagaaaagattgcaaaattaaatgctgcaggagaaactgacaatgaatcgtgactttcttaatctgattaatgaatcattgttaaataaatatcatcctgcgcaatcaagactacatgaagcaatcaactattcattaagtgcaggtggcaagcgcattagaccattacttgttctgactactttagatagtttaggtggcaatgcacatgacggtttaccatttggcattgcgcttgaaatgattcatacgtattctttaattcacgatgacttgccggcaatggataatgatgactatcgtcgcggtaaactcacgaatcataagcgttttgatgaagcaacagctatactcgctggagatgcattgctcactgatgcttttcaatgcattttaaatacgcagttaaacgcagaaattaaattatcattgattaatttattaagtactgcttctggatctaatggcatggtttacggccaaatgctcgatatgcaaggtgaacataaaacattgacattaaatgaactggaacgtattcacatacataaaaccggtgaattgattcgtgcagcaattgtaagtgcaggtatcataatgaattttaatgatgcacaaattgagcaactcaatattattggtaagaacgtaggtttaatgttccagataaaagatgatattcttgatgttgaagggtcgttcgaaaatatcggaaaaacagttggcagtgatttaaataatgataaaagtacatatgtatcactcttaggacttgaagcttcaaagcaattacttaatgataagctaactgaaacatatgatgcgcttaaaacgttacaaccgattaatgacaatctgaaaacattaattacttatatcgttgaaagaaataaataatataagcaatcaataaaagctttgatttttacttttattgattgcttttgtttattaattcttgacttgtgattattatttttcatgtgttacgaaagcg

SEQ ID NO: 13716 - protein, 291 aa, Micrococcus luteus
MLQEKLTMNRDFLNLINESLLNKYHPAQSRLHEAINYSLSAGGKRIRPLLVLTTLDSLGGNAHDGLPFGIALEMIHTYSLIHDDLPAMDNDDYRRGKLTNHKRFDEATAILAGDALLTDAFQCILNTQLNAEIKLSLINLLSTASGSNGMVYGQMLDMQGEHKTLTLNELERIHIHKTGELIRAAIVSAGIIMNFNDAQIEQLNIIGKNVGLMFQIKDDILDVEGSFENIGKTVGSDLNNDKSTYVSLLGLEASKQLLNDKLTETYDALKTLQPINDNLKTLITYIVERNK

SEQ ID NO: 13717 - DNA, 894 bp, Geobacter sulfurreducens
  CDS (1)..(894)
atggatctgaaaggttatcttaaagaacgctgtgccttggtggacgaggctctggagcgccatctgccggctgaagacgagctcccgtcttcggtgcaccgcgccatgcgttattcggtatttgccggtgggaaacgggtccgcccgatcctgatgctggcagcctgcgatgccgtgggcggcgatacggcgctggccctgccggcggcctgcgccatggagatgatccatacctactctctcatccacgatgacctgccggcaatggatgacgatgatttccgccgcgggcggccgacgaaccacaaggtattcggcgaagccattgccatccttgccggcgatgccctgcttaccgaggcgttcatcctcatcagctctccctcctatgctgccgcggttggaagcgatcgactcctgccggttattcacgagatcgccctctgtgccggttcgcggggaatggtcggcgggcaggtggtcgacatggagagcgaggggaacaaagagatcgatctggcaacagtccaatatatccacacccgcaagaccggtgcgctgatcaaggcctccatcaaggcgggagcagtactggggggagccaacgcggacgcggtcaaggccgtgacacgctacggcgaagccattggcctggcgttccagatcgccgacgatatcctcgatatcgagggaacaaccgagcagatcggcaaggacgcgggcagtgatgaagctcgggggaaagccacctatccggccgtgctgggcctggctgaatccaagcggcgcgcccaggaacttctcgatctcgccattgaggccctttcgccctttgaccaccgggctgacccccttcgggaaatcgcccggtacatcgtgtcacggaaatcatga

SEQ ID NO: 13718 - protein, 297 aa, Geobacter sulfurreducens
MDLKGYLKERCALVDEALERHLPAEDELPSSVHRAMRYSVFAGGKRVRPILMLAACDAVGGDTALALPAACAMEMIHTYSLIHDDLPAMDDDDFRRGRPTNHKVFGEAIAILAGDALLTEAFILISSPSYAAAVGSDRLLPVIHEIALCAGSRGMVGGQVVDMESEGNKEIDLATVQYIHTRKTGALIKASIKAGAVLGGANADAVKAVTRYGEAIGLAFQIADDILDIEGTTEQIGKDAGSDEARGKATYPAVLGLAESKRRAQELLDLAIEALSPFDHRADPLREIARYIVSRKS

SEQ ID NO: 13719 - DNA, 870 bp, Bradyrhizobium sp
  CDS (1)..(870)
atggacgtgatggcccggatcgaaaaatccctcgtcgctgcggtcgcgctggccggccggcccggatgtccgccacggctttcggcggccatgcaggcggctgtcttccccaagggcgcgcgggtgcggccaaggctctgtcatgcggtggcggcggcgtgtggcgacgacgagccggcggcgaccgatgccgcgggatcggccatcgagctgttgcactgcgcctcgctggtccatgacgatctgccgtgcttcgacaatgccaagctgcggcgcggccgaccgtcggtgcatgccgcgttcggtgagccgcttgcggtgctcgccggcgatgcgctgatcgtgctcgccttccagacgctcgccaagtcgcgctgctcgccgctgcggctggcgcgactgatcgagacgatcggcgacgccgtcggcgtgccgcatggcattgcggctgggcaagcctgggaatgcgagccggagatcgatctgtcgcattatcaccgctccaagaccggtgcgttgttcgcggccgccacgatctctggcgccgcggcagcggggcatgccgatccggaggcctggcgcagcctgggcgagaagatcggcgaggcctatcaggtcgccgacgatatccgcgatgcggcgagtgatgaggaggaggccggcaagccggtcgggcaggatgccgccctgggacgtccgaacgccgtgctgcgctacggcctcgcgggcgccgtgagctatctccacgatctggtcgccgacggcatccgcaccatgccgccctgcgcccatgcgcacgagctgcgcgccctgatggagcaggaagccaagcgcctggtgccgcgccgcctggcggcgtcggcggcgtga

SEQ ID NO: 13720 - protein, 289 aa, Bradyrhizobium sp
MDVMARIEKSLVAAVALAGRPGCPPRLSAAMQAAVFPKGARVRPRLCHAVAAACGDDEPAATDAAGSAIELLHCASLVHDDLPCFDNAKLRRGRPSVHAAFGEPLAVLAGDALIVLAFQTLAKSRCSPLRLARLIETIGDAVGVPHGIAAGQAWECEPEIDLSHYHRSKTGALFAAATISGAAAAGHADPEAWRSLGEKIGEAYQVADDIRDAASDEEEAGKPVGQDAALGRPNAVLRYGLAGAVSYLHDLVADGIRTMPPCAHAHELRALMEQEAKRLVPRRLAASAA

SEQ ID NO: 13721 - DNA, 867 bp, Lactobacillus johnsonii
  CDS (1)..(867)
atgaagttaaaagattttcaagaaaaatatacacctcaaattgacaatttcttaaaagaacatctggttactgaaattgataatccaacttttagtaaaattatgtcttattcagtaatggcgggaggtaagcgactacgtcctttgcttttcttagcaactcttgagacactaaatcataaaattgaagagccagaattaagaattgcatgtggaattgaattaattcatacttattctctaattcatgatgatttacccgcgatggataatgatgattatcgtcgcggaaaacttacttctcataaaaaatggggagaagcagaagctatattagctggagatgggttgcttccgttgggaattcaatggatcaccgaggggagtaattcagctgcgttagcaattgttatttctcaagctgtaggaccaaatggaatggtcggtggtcaatatcttgatattgatacaactaataacgattcagctaaagaaaatgctaagatgattgatcagatggagtggttgaaaacaggctgcctaattgaagcaagtgttaaaatggctgcaatttatgctggtgcaactgattctgagcttaatagattagacaacttcagcaagcgttttggaagatcttatcaaatctatgatgatttggtagatgtagtggagacagcaactgaagcgggaaaagctactcataaggatgcaacagaaggtaaaaataatactttaactttgcttgggattgaagatagtcgtaaacaacttgtagaaatgattgaatcaggaagaaaagctatagaagtttttgaacaacctttattaggtgaattttttaatttgtatcagaaggtattatag

SEQ ID NO: 13722 - protein, 288 aa, Lactobacillus johnsonii
MKLKDFQEKYTPQIDNFLKEHLVTEIDNPTFSKIMSYSVMAGGKRLRPLLFLATLETLNHKIEEPELRIACGIELIHTYSLIHDDLPAMDNDDYRRGKLTSHKKWGEAEAILAGDGLLPLGIQWITEGSNSAALAIVISQAVGPNGMVGGQYLDIDTTNNDSAKENAKMIDQMEWLKTGCLIEASVKMAAIYAGATDSELNRLDNFSKRFGRSYQIYDDLVDVVETATEAGKATHKDATEGKNNTLTLLGIEDSRKQLVEMIESGRKAIEVFEQPLLGEFFNLYQKVL

SEQ ID NO: 13723 - DNA, 1008 bp, Wolbachia pipientis wMel
  CDS (1)..(1008)
atgctagacgaaacaacaaaaaatttgcttattgtagaagtaaataaactcttacccgaaaatagcgagaataagcttatatcagctatgcgttatatactccttgctcctgcaaaacatatacgctcctttttagtcgtagcttcatcgcgagtgtttaacgcggaagctaaaaaagtaatatcagttgctgcagcaattgaatttgttcatgcttactctctaattcacgatgatttaccgtgcatggacaacagtgatactcgcagaagccagctaagctgccataaaaaatttgatgaagcaacagcagtgcttgccggagatgcactacttactctggcttttgaggtattatcttcgttaaatgagaaacgctgtgagatcataaaagttctttctcaggcaataggaattaggggaatggtgggaggacaggctttagatattaacagtgagcatatagattttagcccccaaccctctgtcattcaagtagcggacactgggatccagaaggctttgcctacaagcatttcgtgcaaaaagccatgcgatagtggagctgaacatgaaatggattccagtgtcagctacttgcatgacaccctttctaccttaaaactacaacattcgtacgactgtatgtatgacgctggaatgacgtcgggccaagctgataaaataaaagaaattcatttgatgaaaaccgcaaaactatttgcagcttcatgtgaaataggtgctataatagggggtgctacagacaagcaacgtaaagcgttatataactatggaataaatctagggcttatctttcaagctaaggatgatattgaagactacgaacaagataaaacaaataatcttatgtctgtgcttggtaaaagtgaagtagaggactatatagacggcctctttaaacaaggcttggataatttgagtgcgctttcaggggatactaattatttatatgatttattgaatcaagtaaagaaagatggttag

SEQ ID NO: 13724 - protein, 335 aa, Wolbachia pipientis wMel
MLDETTKNLLIVEVNKLLPENSENKLISAMRYILLAPAKHIRSFLVVASSRVFNAEAKKVISVAAAIEFVHAYSLIHDDLPCMDNSDTRRSQLSCHKKFDEATAVLAGDALLTLAFEVLSSLNEKRCEIIKVLSQAIGIRGMVGGQALDINSEHIDFSPQPSVIQVADTGIQKALPTSISCKKPCDSGAEHEMDSSVSYLHDTLSTLKLQHSYDCMYDAGMTSGQADKIKEIHLMKTAKLFAASCEIGAIIGGATDKQRKALYNYGINLGLIFQAKDDIEDYEQDKTNNLMSVLGKSEVEDYIDGLFKQGLDNLSALSGDTNYLYDLLNQVKKDG

SEQ ID NO: 13725 - DNA, 1074 bp, Oryza sativa
  CDS (1)..(1074)
atgttgtctgtgagctgcccgagagtgtacatgagcaggaaggcgctggatttcggtcagctggcctcctgccggtgccgttgggctggccggtccggcatgcgggtggcgccgaggcggcgcatgccatgtgtttgtttcgtggcctcaccgagccagccagaaaatccagttttagtttctgcggcagaacaaattttcggtgctggtggaaaaaggttaagaccagcattagtttttctggtgtccagagcaactgctgaattagctggtttgttggagcttactacagagcatcaacgcctggcagagatcatagagatgattcacacagcaagtttaatacatgatgatgtcatagatgatagtggcatgaggagagggaaagaaactattcatcagctatatggaacacgggtggccgtacttgctggtgattttatgtttgcacaatcttcttggttcctagcgaacttagaaaacatcgaagttattaagctcatcagccagatgatgtgttcacaggtgatcaaggactttgccagtggtgagataaaacaagcatctactctttttgactgcgacgtcacccttgatgattacttgctcaagagctattataaaaccgcttcgttgctcgcctcaagcacaagatctgctgcaatattcagtggtgtaagcaccactatatgcgaacaaatgtatgaatacggcaggaatctcgggctctcgttccaggtagtagatgatattcttgactttacccaatcagctgagcaacttgggaaaccagcagggagtgacttagcaaagggaaacctgacagctccagtcatattcgctttgcaagatgaacccaaactaagggagataatcgattctgagttcagtgaaagtgattcattggctactgcaatcgacttggttcacagaagtggtggaataagaagggcgcaggagcttgcaaaggagaaaggtgacttggctctccaaaatttgcagtgccttcccaagagccagttcagaagtacccttgagaacgtggtgaaatataatcttcagaggattgactga

SEQ ID NO: 13726 - protein, 357 aa, Oryza sativa
MLSVSCPRVYMSRKALDFGQLASCRCRWAGRSGMRVAPRRRMPCVCFVASPSQPENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQMMCSQVIKDFASGEIKQASTLFDCDVTLDDYLLKSYYKTASLLASSTRSAAIFSGVSTTICEQMYEYGRNLGLSFQVVDDILDFTQSAEQLGKPAGSDLAKGNLTAPVIFALQDEPKLREIIDSEFSESDSLATAIDLVHRSGGIRRAQELAKEKGDLALQNLQCLPKSQFRSTLENVVKYNLQRID

SEQ ID NO: 13727 - DNA, 999 bp, Leptospira interrogans
  CDS (1)..(999)
atggtttgtcggactttgctttacaattggaagttttctttcagttttggagttagagtgaattcatcttccttttccaaaatattccattcttacaaaagtacgtttgaaaattttttaaattctcaaactctttcgatactttctaaacaatctgctcctgaactttttgaagctatgaaatatagtctcgtggccggagggaagcgacttagacccgttttggctttggctgcttttggtggacttcaaaatgaaactcaaaacgttcttttacttggggcttctttggaatgtattcatacttattctttgattcacgacgatcttccaagtatggataacgacgattttagaagggggttgccgactcttcataaaaaattttccgaatctacggcgattttggccggagacgctttaaactctttcgcattttattttatttcttggatccgggttgaaaatggtgatcattttttacataggaatctattagaaattttgcatgcaggttgtggtgcgcctggaatggtttccggacaagtttatgatttacagatggaaagagaaaatgtgaaagaaaatgatttaacaaaccaatccgataagatagagatgcttcaattgactcaccgtttaaaaacgggagcgttgattaagtcagccttattgttagggaaccgtcttcgtaaagattggaaaaaaagagaaacgtctttatctcaatacggagaagatctaggtttactgtttcagattacagacgatattttagacgtggaaggaactcaggaatctttaggaaaaaccccaggtaaggatcaaaaatctggcaagatcacctatcctatgttattcggaatggatcgttgtaaaaagatggtagaagaacttcagaaaaatctaatttttacttcttctgattttgtttccacagaagaagaacaaacattctttcaggagcttccgatttacattggccagagaaaaaattag

SEQ ID NO: 13728 - protein, 332 aa, Leptospira interrogans
MVCRTLLYNWKFSFSFGVRVNSSSFSKIFHSYKSTFENFLNSQTLSILSKQSAPELFEAMKYSLVAGGKRLRPVLALAAFGGLQNETQNVLLLGASLECIHTYSLIHDDLPSMDNDDFRRGLPTLHKKFSESTAILAGDALNSFAFYFISWIRVENGDHFLHRNLLEILHAGCGAPGMVSGQVYDLQMERENVKENDLTNQSDKIEMLQLTHRLKTGALIKSALLLGNRLRKDWKKRETSLSQYGEDLGLLFQITDDILDVEGTQESLGKTPGKDQKSGKITYPMLFGMDRCKKMVEELQKNLIFTSSDFVSTEEEQTFFQELPIYIGQRKN

SEQ ID NO: 13729 - DNA, 939 bp, Thermus thermophilus
  CDS (1)..(939)
atgaccgacctcgaggcccccctccgccgctttgaagaggccctttccgagctcgtccagtccgacgtcctcttcatccgcctcatccaccaggacctggtgacggcgggggggaagcgcatccggcccaggctcgtcttcctggcctcgagggccttagggggggcgccctttgagctggagctcgccctggcggtggagctcctccactccgccaccctcctccacgacgacctcattgacgacgccgagaccaggcggggcaaggaggcggccttccgcaagtacgggaacgccgtttccgtgctttccggggacttcctcctctcaaggctccttcacgtcatcgccaagacggggcggatggagctcgtggagcggttcgccgaggtggccaagaccctctccgaaggcgaggtcctccagttccaggtggcggccctcgaggactactccctggagaactacgagcggatcattaccgccaagacggcggtcctcatggccctcgccacggagggccccgccctccttctcggggcggaaagcagggtgcgggaggccctttaccgctacggcctcctctacggccaggccttccagatgcgggacgattacctggacctcatggggacgccggaggtcctaggcaagcccgtgggcggggacctgcgggagggcaaggccaccctcatccccctcctcctcatggagcgctaccccgaggtgcgggaggtgctcaggcgccgggcccgggaggccggggacctggaacgggtgcgggccctggcccgggagagcggggcggccgaggaggcggtgcgccgcatccgggagcgggccgaggccgcggcccaggccctggaggccctgcctccgagccccttccgggaggccttgcgggagctcgccctgaaggaggcggagcgggtccgctag

SEQ ID NO: 13730 - protein, 312 aa, Thermus thermophilus
MTDLEAPLRRFEEALSELVQSDVLFIRLIHQDLVTAGGKRIRPRLVFLASRALGGAPFELELALAVELLHSATLLHDDLIDDAETRRGKEAAFRKYGNAVSVLSGDFLLSRLLHVIAKTGRMELVERFAEVAKTLSEGEVLQFQVAALEDYSLENYERIITAKTAVLMALATEGPALLLGAESRVREALYRYGLLYGQAFQMRDDYLDLMGTPEVLGKPVGGDLREGKATLIPLLLMERYPEVREVLRRRAREAGDLERVRALARESGAAEEAVRRIRERAEAAAQALEALPPSPFREALRELALKEAERVR

SEQ ID NO: 13731 - DNA, 1286 bp, Antirrhinum majus
  CDS (10)..(1128)
tcaacaacaatgagcctggtaaatcccattacaacctggtcaacaacaacaacctcaaaatccccaaaaaatgtccaaaccaccaccagatccagatccatcattctccctcacaaaatctcccttttcccatcaaaccccaaatcaaaatcaaaaacccacctcagattctcaatatcatcaatcctgacgaagaacccacaagaatcaagccaaaaaacctccaaagatccaacctttaccctcgatttcaaaacctacatgctagaaaaagccagctctgttaacaaagccttagaacaagctgttttactcaaagagcccttaaaaatccacgaatcgatgaggtactcgcttctagccgggggcaaaagggtcagaccaatgctctgcatcgccgcttgtgagctagttggtgggctggaatccactgcgatgccctcagcttgtgctgttgaaatgatccataccatgtctttgatccacgatgatttgccctgtatggataacgacgatttacgacgtggaaagcccacaaaccacaagatttatggcgaagacgtggcggttttagccggggatgccctgttagcgttctcgttcgagcacgtggcaaaatcgacgaaaggggtgtcgtcggataggattgttagggtgattggtgaattggctaagtgtattggctctgagggtttagttgcaggccaagtggttgatataagttctgaaggaatgactgaagttggattggagcatttggagtttatccacgtgcacaagaccgcggcgttgttggaggcttcggtggttttgggcgcgattgtgggtggtgcggatgatgaggatgttgagaagttgaggaaattcgcgaggtgtatcgggcttttgtttcaagtggttgatgatattttggatgttactaagtcttcgcaagaattggggaagacggcgggtaaagacttggttgcggataagactacgtatccgaagctgcttgggattgagaagtcgagggagtttgcggagaagttgaatagggaggcgcaggagcagctcgaggggttcgattcggttaaggctgcgccgttgatcgcgttggctaactacatcgcttatagagataattgatctgttataaaagaaaggaatgatatgatatactcatagaacctgtgttggttcttacttctcataataatagtgctattgtgaaaatgttgaagatgttgaaaagtgatattgttgtaagttgttgaatgtcatgtataacacaacttcatttgtga

SEQ ID NO: 13732 - protein, 372 aa, Antirrhinum majus
MSLVNPITTWSTTTTSKSPKNVQTTTRSRSIILPHKISLFPSNPKSKSKTHLRFSISSILTKNPQESSQKTSKDPTFTLDFKTYMLEKASSVNKALEQAVLLKEPLKIHESMRYSLLAGGKRVRPMLCIAACELVGGLESTAMPSACAVEMIHTMSLIHDDLPCMDNDDLRRGKPTNHKIYGEDVAVLAGDALLAFSFEHVAKSTKGVSSDRIVRVIGELAKCIGSEGLVAGQVVDISSEGMTEVGLEHLEFIHVHKTAALLEASVVLGAIVGGADDEDVEKLRKFARCIGLLFQVVDDILDVTKSSQELGKTAGKDLVADKTTYPKLLGIEKSREFAEKLNREAQEQLEGFDSVKAAPLIALANYIAYRDN

SEQ ID NO: 13733 - DNA, 864 bp, Desulfovibrio vulgaris
  CDS (1)..(864)
atgcaggcggcgcgcgtcgaaggctaccttgccacttgccttgcagggcggggtattccccctcgtctgcaaagtgccatggaatacagccttctagcgggtggcaaacgccttcggcctgtgctctgcctctcgacggctggcatgaccgggctcgaccccatgtcggtgatgccgttcgctgcagccatcgagctcatccacacctattcgctcatccatgacgacctgcctgccatggacgatgacgacctgcgcagaggtcgtccctccaaccatcgccagttcgatgaggcgaccgccatcctcgctggtgacggcctgctgaccgatgccttcgacctcatggcttcggtgggcgggggcatccccgcggggcacgtgctcgcagccttgcgcgaagtgtcgtctgccgcagggtcgtccggcatggttggcgggcaggctctcgacatggactataccggtcgggatgacatcgacctagccgccttgcgtaccatgcacgccatgaagaccggggctctcatccgctgttcgtgcgtcgcgggtgcgctgctcggtggcgcaccggcttccgccgtagagcaggtcgcggggtatggtgccgccatcggcgcggcgttccagatcgtcgacgacatcctcgacgagacgggcgacgaggcgcaactcggcaagcccgtgggcagcgacgtggagcagggcaaggtgacctatccttcgctgctcggcatcgaacgcagccgggccctggcgcaggaacaggcagacattgccgtgacgtgtctcgcagatttcgagggcgaggatgcagacttccttcgcgctctcgcccagtatattgttgatcgcgtctcttga

SEQ ID NO: 13734 - protein, 287 aa, Desulfovibrio vulgaris
MQAARVEGYLATCLAGRGIPPRLQSAMEYSLLAGGKRLRPVLCLSTAGMTGLDPMSVMPFAAAIELIHTYSLIHDDLPAMDDDDLRRGRPSNHRQFDEATAILAGDGLLTDAFDLMASVGGGIPAGHVLAALREVSSAAGSSGMVGGQALDMDYTGRDDIDLAALRTMHAMKTGALIRCSCVAGALLGGAPASAVEQVAGYGAAIGAAFQIVDDILDETGDEAQLGKPVGSDVEQGKVTYPSLLGIERSRALAQEQADIAVTCLADFEGEDADFLRALAQYIVDRVS

SEQ ID NO: 13735 - DNA, 966 bp, Desulfovibrio vulgaris
  CDS (1)..(966)
atgcaagagctcaaagcccgcatcatcgccgaacagccacgcttcaacgccaccctcgccaccgaggtgggcaccctgcacccgctggtgcagcccgtggcagcacatgtcctcaaggcggggggcaagcgcctgcgcccgttgctcaccctgctcgtggcgcgtgccctcggctacgccgacgacgacatctacccgctcgcctgttcggtggaactcttgcattcggccaccctcctgcatgacgacatcctcgacgacgccgacctgcgccggggcatggcagcggcgcacaccgtgttcggcagcaccgccaccgttctcgccggtgacgcgctgctggccctcgccaacctcatcgtcgcccgctacggcgacccgcgcctcaccgcgtgcatctccgaggccatcatccgcaccgccacgggcgagatcgtcgaaatcgcgcatatgcgcggcacagaccacggacgagacacctatatcgacatcatcaccggcaagacggcatggatgctgcgggcctcgtgtgaactgggcgccctgcgtgcaggggcatccgaagaggccgtccgcgccgcagccgccttcggcctcgacctcggcatcgccttccagatagtcgacgacgccctcgacttcgccgaccgcgccgataccggcaagcccgtgggcggcgacctgcgggagggcaagctcaccccgcccctcatctactatctcgaaaccctctccggtcccgagcgcgaggccttcatctcccgcttccgggacggggggttctccggcgacgacgtggcccgcatctccgcagaaatccgcgccctcggcatcatcgagcgtacgcgcgaacttgccggaaactacatcgagaaggccgccgcttcgctcgagacattgcctgactgtcccgaacgtcgtaccctgatgcagacgctcgcatacgtgcagcatcgcgacaggtga

SEQ ID NO: 13736 - protein, 321 aa, Desulfovibrio vulgaris
MQELKARIIAEQPRFNATLATEVGTLHPLVQPVAAHVLKAGGKRLRPLLTLLVARALGYADDDIYPLACSVELLHSATLLHDDILDDADLRRGMAAAHTVFGSTATVLAGDALLALANLIVARYGDPRLTACISEAIIRTATGEIVEIAHMRGTDHGRDTYIDIITGKTAWMLRASCELGALRAGASEEAVRAAAAFGLDLGIAFQIVDDALDFADRADTGKPVGGDLREGKLTPPLIYYLETLSGPEREAFISRFRDGGFSGDDVARISAEIRALGIIERTRELAGNYIEKAAASLETLPDCPERRTLMQTLAYVQHRDR

SEQ ID NO: 13737 - DNA, 882 bp, Listeria monocytogenes str
  CDS (1)..(882)
atgcaagatttaaccctttttctagaacaatataaaaaagtgattgatgagtcgctttttaaagaaataagcgagcgaaatatcgaacctagactaaaagagtccatgttatattctgttcaagcaggtggaaaacggattcgtcccatgctagtttttgctacacttcaagccttaaaagtaaatccgcttttaggtgtgaaaacagcaacggcattagaaatgattcatacgtatagcctgatccatgatgatttaccagcaatggataacgatgactatcgtcgcggcaaatatactaatcataaagtttttggggatgcaactgcgattttggcaggagacgctttactaacgcttgctttttctattttagcggaagacgaaaatttatcttttgaaacacgcatagctttgattaatcaaattagttttagtagtggtgcagaaggaatggttggcggtcaacttgcagatatggaggcagaaaacaaacaagtgacattagaagaactatcatccatccatgcacggaaaacaggcgaattattaatttttgccgtaacttctgctgcgaaaattgcagaagctgacccagaacaaacgaaaagattacggatttttgcggaaaatattgggattggattccaaatcagtgacgatattttagatgttattggtgatgaaacaaaaatgggtaaaaagacaggggtcgacgcttttctgaacaaaagtacctatcccggattactcacgcttgatggtgccaaaagggcattaaatgagcatgttgcgattgcaaagtcagcgctttcagggcatgattttgatgatgaaattctcttgaaacttgctgatttaatcgcacttagagaaaattaa

SEQ ID NO: 13738 - protein, 293 aa, Listeria monocytogenes str
MQDLTLFLEQYKKVIDESLFKEISERNIEPRLKESMLYSVQAGGKRIRPMLVFATLQALKVNPLLGVKTATALEMIHTYSLIHDDLPAMDNDDYRRGKYTNHKVFGDATAILAGDALLTLAFSILAEDENLSFETRIALINQISFSSGAEGMVGGQLADMEAENKQVTLEELSSIHARKTGELLIFAVTSAAKIAEADPEQTKRLRIFAENIGIGFQISDDILDVIGDETKMGKKTGVDAFLNKSTYPGLLTLDGAKRALNEHVAIAKSALSGHDFDDEILLKLADLIALREN

SEQ ID NO: 13739 - DNA, 1032 bp, Pyrococcus kodakaraensis
  CDS (1)..(1032)
atgggaaagtacgatgagctgtttgcaaggattaaggagaaggcgaaggacgttgatagggtcattctcgaacttgttcccgaaaaggagcctcttgagctttataaagctgctagacactaccctcttgcaggtggaaagcgcgttaggcccttcgtcgtcctccgcgcggccgaggcagttggcggcgacccggagaaggccctctatccggcggcttccgttgagttcatccacaactactccctcgttcacgacgatataatggacatggacgagctcaggcgcggcaggccgaccgtccacaagctctggggagtgaacatggcaatcctcgccggcgatctgctcttcagcaaggctttcgaggcgatagccaaagcggaagtcccagccgagaagaaggcgagaatcctggatgttctcgtcaggacttccaaccttctctgtgaaggccaggccctcgacatagagttcgagacgaaggaagaggtcaccgtagaggagtacctcaagatgataagcggcaagaccggcgcgctcttccagggctcggcagagataggtgcaatagtgggcacggaggacgaggagtacatcggggccctctcaaagtggggcatgaacgtcggaatagccttccagatatgggacgacgtcctcgatctgattgccgacgaggagaagctcggaaagcccgttggaagcgacataaggaagggtaagaagacgctcatagtgagccacttctttgagcacgcgagcgaggaggacaaggccgagttcctgaaagtcttcggcaagtatgctggcgatgctaagggcgatgcgctgatacacgacgagaacgtcaaggaggaggtcgcgaaggccatcgaactcctcaagaagtacggcagcatagactacgcggcaaactatgccaagaacctcatcagggaagcgaacgaggccctcaaggttctccctgagagcgaagccaggagagaccttgagcttctcgcggagttcctcgtcgagagggagttctga

SEQ ID NO: 13740 - protein, 343 aa, Pyrococcus kodakaraensis
MGKYDELFARIKEKAKDVDRVILELVPEKEPLELYKAARHYPLAGGKRVRPFVVLRAAEAVGGDPEKALYPAASVEFIHNYSLVHDDIMDMDELRRGRPTVHKLWGVNMAILAGDLLFSKAFEAIAKAEVPAEKKARILDVLVRTSNLLCEGQALDIEFETKEEVTVEEYLKMISGKTGALFQGSAEIGAIVGTEDEEYIGALSKWGMNVGIAFQIWDDVLDLIADEEKLGKPVGSDIRKGKKTLIVSHFFEHASEEDKAEFLKVFGKYAGDAKGDALIHDENVKEEVAKAIELLKKYGSIDYAANYAKNLIREANEALKVLPESEARRDLELLAEFLVEREF

SEQ ID NO: 13741 - DNA, 960 bp, Bacillus stearothermophilus
  CDS (1)..(960)
atggcgcagctttcagttgaacagtttctcaacgagcaaaaacaggcggtggaaacagcgctctcccgttatatagagcgcttagaagggccggcgaagctgaaaaaggcgatggcgtactcattggaggccggcggcaaacgaatccgtccgttgctgcttctgtccaccgttcgggcgctcggcaaagacccggcggtcggattgcccgtcgcctgcgcgattgaaatgatccatacgtactctttgatccatgatgatttgccgagcatggacaacgatgatttgcggcgcggcaagccgacgaaccataaagtgttcggcgaggcgatggccatcttggcgggggacgggttgttgacgtacgcgtttcaattgatcgtcgaaatcgacgatgagcgcatccctccttccgtccggcttcggctcatcgaacggctggcgaaagcggccggtccggaagggatggtcgccggtcaggcagccgatatggaaggagaggggaaaacgctgacgctttcggagctcgaatacatccatcggcataaaaccgggaaaatgctgcaatacagcgtgcacgccggcgccttgatcggcggcgctgatgcccggcaaacgcgggagcttgacgaattcgccgcccatctaggccttgcctttcaaattcgcgatgatattctcgatattgaaggggcagaagaaaaaatcggcaagccggtcggcagcgaccaaagcaacaacaaagcgacgtatccagcgttgctgtcgcttgccggcgcgaaggaaaagttggcgttccatatcgaggcggcgcagcgccatttacggcacgccgacgttgacggcgccgcgctcgcctatatttgcgaactgtcgccgcccgcgaccattaaaagcggaacggccgcccttgcttcggagcaagggcggctgtgttgcttttttgcttccgccccatga

SEQ ID NO: 13742 - protein, 319 aa, Bacillus stearothermophilus
MAQLSVEQFLNEQKQAVETALSRYIERLEGPAKLKKAMAYSLEAGGKRIRPLLLLSTVRALGKDPAVGLPVACAIEMIHTYSLIHDDLPSMDNDDLRRGKPTNHKVFGEAMAILAGDGLLTYAFQLIVEIDDERIPPSVRLRLIERLAKAAGPEGMVAGQAADMEGEGKTLTLSELEYIHRHKTGKMLQYSVHAGALIGGADARQTRELDEFAAHLGLAFQIRDDILDIEGAEEKIGKPVGSDQSNNKATYPALLSLAGAKEKLAFHIEAAQRHLRHADVDGAALAYICELSPPATIKSGTAALASEQGRLCCFFASAP

SEQ ID NO: 13743 - DNA, 894 bp, Geobacillus kaustophilus
  CDS (1)..(894)
atggcgcagctttcggttgaacagtttctcaacgaacaaaaacgggccgtcgaggcggcgctttcctcctatatggcgcggcttcgtgggccggagacgctgaaaaaggcgatggcctactcgcttgaggccggcggcaaacgaatccgcccgcttttgttgctggcgaccatccaagcgcttggcaaagacccggcgatcggtctgccagtcgcttgcgccattgaaatgatccatacgtactcgctcattcatgatgatttgccaagcatggacaacgatgatttgcggcgcggcaaaccgacgaaccataaagtgttcggcgaggcgatggccattttggccggggacgccttgcttacgtatgcgtttcaattgatcgccgaggttgatgacgaccgcgttccgccttccgtccggctgcagctcatcgagcagctcgcgaaggcggccggcccggaaggcatggtcgctggacaggcggctgatatggaggcggaaggaaaaacgctggcgcttgcggaactggaatacatccaccgccataagacggggaaaatgttgcaatacagcgtgcacgccggcgccctgcttggcggcgccgatggtcggcagacgcgcgaactcaacgagttcgccgcacatttaggcctcgcctttcaaattcgcgacgatattttggacattgaaggaatggaagaaaaaatcggcaagcgagtcggcagcgaccgcgacaacaagaaggcgacatatccggcgcttctttcgctaggcggtgccaaagagaaactggcgtttcacatcgacgccgcgaagcgccatttgcaacaagccaaaatcgatgacgcggtgctggtctacatttgcgagcttgtcgcggtccgcgaccactga

SEQ ID NO: 13744 - protein, 297 aa, Geobacillus kaustophilus
MAQLSVEQFLNEQKRAVEAALSSYMARLRGPETLKKAMAYSLEAGGKRIRPLLLLATIQALGKDPAIGLPVACAIEMIHTYSLIHDDLPSMDNDDLRRGKPTNHKVFGEAMAILAGDALLTYAFQLIAEVDDDRVPPSVRLQLIEQLAKAAGPEGMVAGQAADMEAEGKTLALAELEYIHRHKTGKMLQYSVHAGALLGGADGRQTRELNEFAAHLGLAFQIRDDILDIEGMEEKIGKRVGSDRDNKKATYPALLSLGGAKEKLAFHIDAAKRHLQQAKIDDAVLVYICELVAVRDH

SEQ ID NO: 13745 - DNA, 927 bp, Rhodopseudomonas palustris
  CDS (1)..(927)
atggccaccggcacttccacgatcgactttgccaagcggctcgacactaccgccgaggaaaccgaagcgctgctcggccggctgttgtccgacgaattgatgtccgacgagatcgcccggccgcgccggctgatggacgcgatccgctactccacgctcggcggcggcaagcggctgcggccgttcctggcggtcgagagcgccgcagtgttcggcatcgatcgtgccgccgcgctcttggtcggcgccgcgctggagtgcatccactgctactcgctgatccacgacgacctgccttcgatggacaacagcgatctgcgccgcggccgtccgacgctgcacaaggcctatgacgacgccactgcgatcctcgccggcgacgcgctgctgaccttcgcgttcgacatcgtcacccgcgacgaagtgcacaacgatccgacggtgcggctgctgctgacacgagtgctggcgcgctgcgccgggctcggcggcatggtcggcggccagatgcttgatcttgccggcgaaggccggttcggcgaccgcgagccggtcgacgtcgcgcggctgcagcagatgaagaccggcgccctgctccgctacggctgcgtcgccggcgcgatcctcggccaggcaagccccgaccagtatcgcgcgctcgacgattacggccgcgcactcggtgaagcgttccagattgccgacgacctgctcgatgtcgaaggcgacgctgccgcgctcggcaagccggccggcgccgatgccgcgctcggcaagaccaccttcgtcacccaactcggcatcgacggcgccaagcagcggctgcgcgacctggtcgcgcgtgccgaccaggcgctggcgccgttcggcgagcgcggcgaggtgctgcgcgccgccgcccgcttcgtcgccgagcggaagagctga

SEQ ID NO: 13746 - protein, 308 aa, Rhodopseudomonas palustris
MATGTSTIDFAKRLDTTAEETEALLGRLLSDELMSDEIARPRRLMDAIRYSTLGGGKRLRPFLAVESAAVFGIDRAAALLVGAALECIHCYSLIHDDLPSMDNSDLRRGRPTLHKAYDDATAILAGDALLTFAFDIVTRDEVHNDPTVRLLLTRVLARCAGLGGMVGGQMLDLAGEGRFGDREPVDVARLQQMKTGALLRYGCVAGAILGQASPDQYRALDDYGRALGEAFQIADDLLDVEGDAAALGKPAGADAALGKTTFVTQLGIDGAKQRLRDLVARADQALAPFGERGEVLRAAARFVAERKS

SEQ ID NO: 13747 - DNA, 867 bp, Rhodopseudomonas palustris
  CDS (1)..(867)
atggacgtgaccaatcggatcgagcgtgctctgacagaagcgctcaatcaggccgacatggccggatgtccgccgcggctggcggcagcaatgcgcagtgcggtgttcccgcgcggggcgcgcgttcgtccgcggctctgccacagcgtggcgcttgcttgcggcgaagacaatccgggaattaccgaagctgccggtgccgcacttgagctgatgcactgtgcctcgctgatccatgacgatcttccgtgcttcgatggtgccgacctgcgtcgcggccgcccgtcggtgcacaaggcgttcggggaaccgctcgcggtgctcgccggtgacgcgatgatcgtgctggcgttccagaccatcgcgcgggccgagggccaggcggaccgcctgctgaagctgacccagatcatcggcggcgccgtcggcgtgccgttcggcatcgtcgccggtcaggcctgggaatgtgagaccgaaatcaatctcgcccattatcaccgctctaagaccggcgcgctgttcgtggccgcaaccgcgatgggcgcggcttcggccggctccgatccggagccgtggcggatggtcggtgagaagatcggcgaagcctatcaggttgccgacgatttgcgtgacgctgccgccgatgtcgaagagatcggcaagccggttgggcaggacgtcgcccacgatcgccccagtgcggtgcgcgagatgggtatcgatggcgcgatctaccacctgaagtcgctggtgcgcggcgccgtcgaggcgatgccggaatgcaccaatggcaacgagctgcggtcgctgatcatgtcggaagcgacacgcctggtgccggcgaaactggccgcgactgcggcctga

SEQ ID NO: 13748 - protein, 288 aa, Rhodopseudomonas palustris
MDVTNRIERALTEALNQADMAGCPPRLAAAMRSAVFPRGARVRPRLCHSVALACGEDNPGITEAAGAALELMHCASLIHDDLPCFDGADLRRGRPSVHKAFGEPLAVLAGDAMIVLAFQTIARAEGQADRLLKLTQIIGGAVGVPFGIVAGQAWECETEINLAHYHRSKTGALFVAATAMGAASAGSDPEPWRMVGEKIGEAYQVADDLRDAAADVEEIGKPVGQDVAHDRPSAVREMGIDGAIYHLKSLVRGAVEAMPECTNGNELRSLIMSEATRLVPAKLAATAA

SEQ ID NO: 13749 - DNA, 1125 bp, Corynebacterium diphtheriae
  CDS (1)..(1125)
atgtctacgcaccccgccggtatctctgcatgccatcactcactgccttcgttttcggaggtcccagcagcagtagaagaagtactcgcggagtttttcgaaggccgtaaacgcaaggtagccaagattggtgttccagtgagcaatgcggttgagctgctggtcgaatatgtccttggcggtggaaaacggattcgtcctacgtatgcgtgggcgggttttgttgctagtggcggattaactaataagacggaagatcccggcgcggtactcacagcaattggctctctggaactgatccaagcgtgtgcgcttatccacgacgacattatcgacgcttccgatacgaggcgtggtaatccgactgtgcaccgtgttgcagaacgcacccatgcagaatcccatcgcttgggcgattccgcacgttttggcgagtcgatcgcaattttggttggcgatcttgcgatggtgtgggcagatgatatgttccataactctgggcttagtgatgctgcaattcgtcgtgcttcgaatgcgtggcgtggcatgcgcactgaagttattggcggacaacttcttgatatttacattgaatccactggtagcgagagcatcgaactagcggaaaccgtcaatcgttttaaaactgccgcctatacgattgagcgccctcttcacattggtgcggcgttggcgggcgctgatgaccagacagttcactgtctacgaaattatggccgtgatatcggcttggcgttccagcttcgcgacgatcttttaggtgtatttggtgacccaagtgttacgggtaagccagctggcgatgacttgcgtgaaggaaagcgcacggtattggtggccaaagcattagaaatcttggagtctgcgggctcgatccacgaggcggaaatgattcgtcgtgacttaggtgcagtgtcgggggccgaagatattgcacaattggcttcgattattcgctcctctggtgccgccgatgcggtggaagagcgcatcgcaaccttgcgaacttctggccttgcgcacattagcaatgatgttattgatgcagaggcccaagattttctaaaacacctagctatcaaggctacgtcgagaagcttctaa

SEQ ID NO: 13750 - protein, 374 aa, Corynebacterium diphtheriae
MSTHPAGISACHHSLPSFSEVPAAVEEVLAEFFEGRKRKVAKIGVPVSNAVELLVEYVLGGGKRIRPTYAWAGFVASGGLTNKTEDPGAVLTAIGSLELIQACALIHDDIIDASDTRRGNPTVHRVAERTHAESHRLGDSARFGESIAILVGDLAMVWADDMFHNSGLSDAAIRRASNAWRGMRTEVIGGQLLDIYIESTGSESIELAETVNRFKTAAYTIERPLHIGAALAGADDQTVHCLRNYGRDIGLAFQLRDDLLGVFGDPSVTGKPAGDDLREGKRTVLVAKALEILESAGSIHEAEMIRRDLGAVSGAEDIAQLASIIRSSGAADAVEERIATLRTSGLAHISNDVIDAEAQDFLKHLAIKATSRSF

SEQ ID NO: 13751 - DNA, 870 bp, Bdellovibrio bacteriovorus
  CDS (1)..(870)
atggatctcgcaattcagattgatcaggaaatcgccgcgcgcacccaggctgtgaaccagtttgtggaaaaatatctgtctgacatggagctaccagcaggcagcgccatttctgagttgcgaaagtccatgctttattccgccaccaatggcgggaaacgtttccgtccggttctgtccttgctggtcggtgagttgttcggtgctggtaaagagcgcatcttgcctttcgccgctgccgtggaaatgattcatacgtactctttgattcatgatgatctgccatgcatggataacgatgacatgcgccgcgggaagcccaccaatcacaaagtgttcggtgaagactttgcgttgctggccggggacgctcttttgactgaagctttcatgctgattgcggaaaactatggggataacagcttcctggtgggtcacctgacaaggctgttatcttcggcggcaggaattcgaggcatggtcggtggtcaggcgattgacctgcgtgctggtgacaaacaaatgtcactggaagaactgacccatctgcatcgtcttaaaaccggtgcgttgattcgtgtggcggttgagggtgcggctgtgattgccggggcaaagccgactgaaattgaaagtcttaaaaaattcggcgaaggcctgggccttgctttccaagtggccgacgatgttctggatcacggcgaaaaaggtcaggatcttcgcagcttcaccggtatcctgggtcttgagggcacaaagacctatttgaaggatgtcagtgcttcgactttggcggaactgcacaaggtgtctgccgatgctccgcttttggagtatctgatcagctttaatcaaaaccgtcaggtgtaa

SEQ ID NO: 13752 - protein, 289 aa, Bdellovibrio bacteriovorus
MDLAIQIDQEIAARTQAVNQFVEKYLSDMELPAGSAISELRKSMLYSATNGGKRFRPVLSLLVGELFGAGKERILPFAAAVEMIHTYSLIHDDLPCMDNDDMRRGKPTNHKVFGEDFALLAGDALLTEAFMLIAENYGDNSFLVGHLTRLLSSAAGIRGMVGGQAIDLRAGDKQMSLEELTHLHRLKTGALIRVAVEGAAVIAGAKPTEIESLKKFGEGLGLAFQVADDVLDHGEKGQDLRSFTGILGLEGTKTYLKDVSASTLAELHKVSADAPLLEYLISFNQNRQV

SEQ ID NO: 13753 - DNA, 885 bp, Parachlamydia sp
  CDS (1)..(885)
atgatggatgttgccaattatttacaaacacaaagtcagcttattgaaaaacgcctggatcaacttgtctccaaacgtcacggccctcaccaaaatttaattgaagctgctcgttatgctcttttaagtggaggaaaaaggctacgtccaattttagctttgacaactgttcagacacttcatggagatattcaagaagctttatctcctgcttgcacattagaacttatccatacttattctcttattcatgatgacttaccttgcatggataatgatgattatcgaagaggaaaactgactgttcatcgccaatattcagaaggccacgccgttttaacgggagacttccttttaacatacgcatttgaacttttagcgaccgataaatatttgacatctgaaaaaaaagttaaacttattactattttatccagacaaagcggatacgatggaatgattggcgggcaagccttggatttagccagcgagggacaaaaaattaatcttgaaacccttcgattacttcatcgtaataaaacagctgctttgattacagcatctgttgaattcggaggaattttagcaaatgcaacagaagaacagctcgctcatatccgggagtttggtgaaaatattgggctggcttttcaaatcactgatgatatccttgatatcacatcaagcgaagccaaacatgggcgaaaaattgggtctgacatcctaaaagataaatcgacttatgtatccttacttggaatagaacaagccaaagcatacgctttaaatttttatcaaaaggccattaatgctttaaaactccttccctatgataattcttttctaatacatttagctgactttattattcatcgtcattattga

SEQ ID NO: 13754 - protein, 294 aa, Parachlamydia sp
MMDVANYLQTQSQLIEKRLDQLVSKRHGPHQNLIEAARYALLSGGKRLRPILALTTVQTLHGDIQEALSPACTLELIHTYSLIHDDLPCMDNDDYRRGKLTVHRQYSEGHAVLTGDFLLTYAFELLATDKYLTSEKKVKLITILSRQSGYDGMIGGQALDLASEGQKINLETLRLLHRNKTAALITASVEFGGILANATEEQLAHIREFGENIGLAFQITDDILDITSSEAKHGRKIGSDILKDKSTYVSLLGIEQAKAYALNFYQKAINALKLLPYDNSFLIHLADFIIHRHY

SEQ ID NO: 13755 - DNA, 810 bp, Parachlamydia sp
  CDS (1)..(810)
atgggtgataaaacatcattaagagatgcttgtgaatatgcgttactaaatggtggaaaacgatttagacctgctctcgttttgatgattgctaaagcccttggttttcaagtcgatgtttcacaggctgctttatgtgtagaatactttcatactgcgtctttgattgcagatgatttgccttgtatggataacgatgatgaacggcgaaatgctcctaccttacataaaatttttggggaatcgacttctcttttggcgacctatactttgattgccgctggctacgcttgcttagctcggaataccgcgattttgaaagatagtgcacacccctacgttaatcaaaaagagcgtttatgtgtattggctttagaaaatgcaacgcaaaatacgggaattttaggggcaacggggggacaatatttagatttaaatcctcctaatctttctttaaagactttaaaagaagtgattgaaaagaaaacggttacgttatttgaaatttcttttgtcttagggtggatttttggaggaggggttttggaaaagttgtccctcgtgaaaaaatgtgcaggacactttggaatggctttccaaattgccgatgacttgggagacatgaagcaagactcctttcatgatcacacaatgaattttgcaaatgtttatggtaaaccagctgcgactcaattatttcatgacgaaattcatcaatttaatcaaacactaactgcgcttgattttcaatcagaagatcttcaagctttaacttgccttcttattgagcaagtacaacttctttcttga

SEQ ID NO: 13756 - protein, 269 aa, Parachlamydia sp
MGDKTSLRDACEYALLNGGKRFRPALVLMIAKALGFQVDVSQAALCVEYFHTASLIADDLPCMDNDDERRNAPTLHKIFGESTSLLATYTLIAAGYACLARNTAILKDSAHPYVNQKERLCVLALENATQNTGILGATGGQYLDLNPPNLSLKTLKEVIEKKTVTLFEISFVLGWIFGGGVLEKLSLVKKCAGHFGMAFQIADDLGDMKQDSFHDHTMNFANVYGKPAATQLFHDEIHQFNQTLTALDFQSEDLQALTCLLIEQVQLLS

SEQ ID NO: 13757 - DNA, 954 bp, Methanococcus maripaludis
  CDS (1)..(954)
atggtgtttgatagggaaatattgtcaaaaatcgattctgaactcaaaaaatacatggaaaaagatactaaactttacggtgcatcaaaacacctattacttgcaggcggtaaaagagtaagaccttatctttcaattttaacatatctcttaaagaaagatgagcttactgaaataatggcaccagcactttctgttgaattgattcataattatacattagttcatgacgatataatggataatgatgatcagagaaggggaatccctacagttcacaccgtttatggtgaaccaatcgcaattttggctggagatttattatatgcaaaggctttcgaagctctttcaaatattgaagatagtaacaaggctcacgaagttttaaaggttttatctaaagcatgtgtcgaagtctgcgaaggacagactgaagatatggaatttgaagaaagattcccgactttagacgaataccttgaaatgatttccaaaaaaacaggtgctttaattgtagctcctgtagaaattggagcagttatggcagactgtactcctgaagaaagagaagcactctgtaattatgcaaaaagaattggaatgactttccagattcaagacgatgttttagatttaattggggatcaaaaaacaatcggaaagcctgtgggtagtgacattgttgaaggtaaaaagacaatgatggtaattcacgcaatggaaaacctttctgaagataaaaaagaaagattattgcagattttaggaaatcaagatgcaaatcaacaagaagttgcagaagcaattgaacttttagcagattctattaattatgcaaaagatacaatgaaaaacgcaacagaagaagctaaagattacttaaaaatattcgatgcagaaaaaagaaaaaatctcgaaaacattgcagattttatcatcgaaagaattcactaa

SEQ ID NO: 13758 - protein, 317 aa, Methanococcus maripaludis
MVFDREILSKIDSELKKYMEKDTKLYGASKHLLLAGGKRVRPYLSILTYLLKKDELTEIMAPALSVELIHNYTLVHDDIMDNDDQRRGIPTVHTVYGEPIAILAGDLLYAKAFEALSNIEDSNKAHEVLKVLSKACVEVCEGQTEDMEFEERFPTLDEYLEMISKKTGALIVAPVEIGAVMADCTPEEREALCNYAKRIGMTFQIQDDVLDLIGDQKTIGKPVGSDIVEGKKTMMVIHAMENLSEDKKERLLQILGNQDANQQEVAEAIELLADSINYAKDTMKNATEEAKDYLKIFDAEKRKNLENIADFIIERIH

SEQ ID NO: 13759 - DNA, 972 bp, Photobacterium profundum
  CDS (1)..(972)
atggattttaaagctatccaagcgctcaccgccaacgatatggcgggagttgacgcgaagatacaagcacaactgaactcagatgtagctcttattaatcaactaggcttttacattgtaagcggtggtggcaaacgcttacgtccgatgcttgtcgttcttgccgctcgtgctttgggctaccaaggagacaaacacattacggctgctgcatttgtagaatttattcatactgcaacattgttacatgacgacgttgttgatgaatctgacatgcgccgtggtaaagacacagccaatgctgcatttggcaatgccgctagtgttcttgtcggggattacatttatacccgttcatttcagatgatgacgagcctaagatcattaaagatcctcgatatcatgagtgaagcaacaaatgtgatcgctgaaggcgaagttcagcagctaatgaactgcaatgatcctaatacgacagaagataactatatgcaggttatctactctaaaacggctcgcctttttgaagctgcaactcagatttctgcgattatcacagaatcctctactgaagttgaagttgcgctacaagactatggccgttacctcggtactgcttttcagctcattgatgatgtgttggattatgtcgcagatggcaaggaaatgggtaaaaacgtgggtgatgacctttccgaaggtaaaccgacacttccactgctacatgctatgcataatggtaatgaagcgcagtcagccatgatccgtgaagcgattgaaaaatccaacggtatggacaaactaaacgatattctggccgccatgcgcgaagctggctctttggagtacactcagcaacgcgcggaagaagaagcagaaaaagcaatcgcagcactagcccccattgctgagtctgattacaaagaagcgttgatccaacttgctcatttagcggttaaacgtacaaagtaa

SEQ ID NO: 13760 - protein, 323 aa, Photobacterium profundum
MDFKAIQALTANDMAGVDAKIQAQLNSDVALINQLGFYIVSGGGKRLRPMLVVLAARALGYQGDKHITAAAFVEFIHTATLLHDDVVDESDMRRGKDTANAAFGNAASVLVGDYIYTRSFQMMTSLRSLKILDIMSEATNVIAEGEVQQLMNCNDPNTTEDNYMQVIYSKTARLFEAATQISAIITESSTEVEVALQDYGRYLGTAFQLIDDVLDYVADGKEMGKNVGDDLSEGKPTLPLLHAMHNGNEAQSAMIREAIEKSNGMDKLNDILAAMREAGSLEYTQQRAEEEAEKAIAALAPIAESDYKEALIQLAHLAVKRTK

SEQ ID NO: 13761 - DNA, 903 bp, Photobacterium profundum
  CDS (1)..(903)
atgaataacaatttaactttatcacagtcactgaagcattatcaggatcgtagtaatcaacatttagctcaatggcttgaagcgcagccttttgccgatcaagcactagtaaaaaccatgaaatatggcacattactcggcggcaaacgcgcacgtccgtttttaacctatattacgggtcaaatgctaggggctgaatgcgccgatcttgatactcctgctgcagcggtagaatgtattcatgcttattcattaattcatgatgatctgcctgctatggatgacgatgagctacgtcgtggtcacccaacatgccacattgcatttgatgaagctttagctattcttgctggagatgctttacaaacacttgctttcgaaattcttgctgatggcaaattaaatgatgacggtaatactcaacgtatcgcgatgatcaaagagcttgcccaagcctctggtgctgcgggaatgtgtgtaggtcaagcacttgatttagaagcagaaggtaaacacgttgatttacagcagcttgaaactattcacaagcacaaaacgggggcacttatccgatgtgccgtacgtttaggtgcactcgctgcaggtcaaaaaggcgtagcggtattgccacagctaaaccaattcgccgacgcgattggtctcgcattccaagttcaagacgatattcttgatgtcacaagtgatactgaaacactggggaaaccacaaggttcagatctcgcgcttgataaaagtacctacccagctttactaggattggaaggtgcacaacaaaaaacacaacaactttatcaagaagcgctacaagcattggatgcaataccctacaatacaacccaattagaagtttttgcccgatacattatcgaacgcaataactaa

SEQ ID NO: 13762 - protein, 300 aa, Photobacterium profundum
MNNNLTLSQSLKHYQDRSNQHLAQWLEAQPFADQALVKTMKYGTLLGGKRARPFLTYITGQMLGAECADLDTPAAAVECIHAYSLIHDDLPAMDDDELRRGHPTCHIAFDEALAILAGDALQTLAFEILADGKLNDDGNTQRIAMIKELAQASGAAGMCVGQALDLEAEGKHVDLQQLETIHKHKTGALIRCAVRLGALAAGQKGVAVLPQLNQFADAIGLAFQVQDDILDVTSDTETLGKPQGSDLALDKSTYPALLGLEGAQQKTQQLYQEALQALDAIPYNTTQLEVFARYIIERNN

SEQ ID NO: 13763 - DNA, 22 bp, Primer
atggactttccgcagcaactcg

SEQ ID NO: 13764 - DNA, 27 bp, Primer
ttatttattacgctggatgatgtagtc

SEQ ID NO: 13765 - protein, 33 aa, consensus; identical to SEQ ID NO: 228
  MISC_FEATURE (1)..(33): Xaa in all positions is any amino acid.

SEQ ID NO: 13766 - protein, 76 aa, consensus
  MISC_FEATURE (1)..(76): Xaa in all positions is any amino acid.
MXNXXGXXVDLYXPRKCSAXNRXIXAKDHASXQXXXXXVDXXXXXXXXXXXXXXXXXAXXGXXRXXGXXDXXXXRL

SEQ ID NO: 13767 - protein, 53 aa, consensus; identical to SEQ ID NO: 5292
  MISC_FEATURE (1)..(53): consensus for the disclosure of xaa see table XV

SEQ ID NO: 13768 - protein, 75 aa, consensus; identical to SEQ ID NO: 5293
  MISC_FEATURE (1)..(75): consensus for the disclosure of xaa see table XV

SEQ ID NO: 13769 - protein, 100 aa, consensus; identical to SEQ ID NO: 5294
  MISC_FEATURE (1)..(100): consensus for the disclosure of xaa see table XV

SEQ ID NO: 13770 - protein, 46 aa, consensus; identical to SEQ ID NO: 5295
  MISC_FEATURE (1)..(46): consensus for the disclosure of xaa see table XV

SEQ ID NO: 13771 - protein, 688 aa, consensus; identical to SEQ ID NO: 5296
  MISC_FEATURE (1)..(688): Xaa in all positions is any amino acid

SEQ ID NO: 13772 - protein, 33 aa, consensus; identical to SEQ ID NO: 4356
  MISC_FEATURE (1)..(33): consensus for the disclosure of xaa see table XV

SEQ ID NO: 13773 - protein, 36 aa, consensus; identical to SEQ ID NO: 4357
  MISC_FEATURE (1)..(36): consensus for the disclosure of xaa see table XV

SEQ ID NO: 13774 - protein, 39 aa, consensus; identical to SEQ ID NO: 4358
  MISC_FEATURE (1)..(39): consensus for the disclosure of xaa see table XV

SEQ ID NO: 13775 - protein, 323 aa, consensus; identical to SEQ ID NO: 5813
  MISC_FEATURE (1)..(323): Xaa in all positions is any amino acid.

SEQ ID NO: 13776 - protein, 45 aa, consensus
  MISC_FEATURE (1)..(45): consensus for the disclosure of xaa see table XV
GKXXGXXXXXXXXXXXXXXXXXXXXXXXXXXXXXXXXGIXXTXXX

SEQ ID NO: 13777 - protein, 493 aa, consensus
  MISC_FEATURE (1)..(493): Xaa in all positions is any amino acid.
GXXLXXXXXXAXXXANXXXXXXXYXXXXXXXXXXXXXXXXXXXXXXXXXXXXXWXXDXLXXXFFXXXGXEXKXEXXXGXXLXXXXXXXXPXXAAXGGXXXPXXXXXXXXXXXXXXXXXXXXXXXXXXXXXXXXXXXXXXGWXXPXATDIAFAXXXXXXXGXXXPXXLXXFLXXLAXXDDXXXXXXIAXFXXXXXXXXXXXXXXXXXXXXXXXXXXXXXXXXXXXXXXXXXXXXXXYXXXGXXXWXXXXXSGXHXTXAGVXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXEXXLXPXXXXXXXPXFAXXNAGXXXXXXXXXXXXXXXXXXXXXXXXXGLXXGKXXGXXXXXXXXXXXXXXXXPXXXXXXXXXXXXXLXGIGFTXSXFIXXLAFXXXXXXXXXXXXXXXXXLXXSXXXXXXGXXXL

SEQ ID NO: 13778 - protein, 35 aa, consensus
  MISC_FEATURE (1)..(35): consensus for the disclosure of xaa see table XV
XXTHXXXFHXDEXXXXXXXXXXXXXXXXXXXXRXR

SEQ ID NO: 13779 - protein, 20 aa, consensus
  MISC_FEATURE (1)..(20): consensus for the disclosure of xaa see table XV
DVXXXXXXXDXXXDHHXXXX

SEQ ID NO: 13780 - protein, 9 aa, consensus
  MISC_FEATURE (1)..(9): consensus for the disclosure of xaa see table XV
SSXGXXXXX

SEQ ID NO: 13781 - protein, 15 aa, consensus
  MISC_FEATURE (1)..(15): consensus for the disclosure of xaa see table XV
XXXXXXXXXDXXDNG

SEQ ID NO: 13782 - protein, 42 aa, consensus
  MISC_FEATURE (1)..(42): consensus for the disclosure of xaa see table XV
XXXXXXXXXGXXXXXLXXXXXXXXXXFXHXXXFXXXXXXXXX

SEQ ID NO: 13783 - protein, 344 aa, consensus
  MISC_FEATURE (1)..(344): Xaa in all positions is any amino acid.
THXGXFHXDEXXAXXXLXXXXXXXXXXXXXRXRDXXXXXXXXXXXXXDVGGXYXXXXXXXDHHQXXXXXXXXXXXXXXXXXXXXXXXSSAGXXXXXXXXXXXXXXXXXXXXXXXXXXXXXXXXXXXXXXXXXXXDXXDNGXXXXXXXXXXXXXXXXXXXXXXXXXXXXXXXXNXXXXXXXXXXXXXXXXXXXXXXXXAXXXXXXXXXXXXXXXXXXXXXXXXXXXXXXXXXXXXXXXXXXXXXXXXXXXXXXXXXXXXXEXXXXXXXXXXXXXXXXXXXXXXXXXXXWXXXXXXXXXXXXXXXRXXXPXXWXGLXXXXLXXXXXIXGXXFXHXXXFXXXXXXXE

SEQ ID NO: 13784 - protein, 54 aa, consensus
  MISC_FEATURE (1)..(54): consensus for the disclosure of xaa see table XV
MXXXXXXXXXXXXXXXXXXXXXXXXXIXXXXXXXXXXXXNXXXNXXVXLLXHDW

SEQ ID NO: 13785 - protein, 41 aa, consensus
  MISC_FEATURE (1)..(41): consensus for the disclosure of xaa see table XV
LXXXNXXXXXXXSXXXXGXXXXXXXXSXXXXXXXXXXXXXN

SEQ ID NO: 13786 - protein, 196 aa, consensus
  MISC_FEATURE (1)..(196): Xaa in all positions is any amino acid.
MXYXYXXXXXXXXXXXXXXXXXXXXXIXXXXXXXXXKXXNXXXNXXVXLLXHDWXXXXXXXXXXXXXXXXXXXXXXXXXXXXXXXLXXXLXXXNXXXXXXXSXTXXGXAXXXXXXSXXXXXYXXXXLXXNXXXXXXXXXXXXXXXXXXXXXXXXXXXXXXXXXXXXXXXXXXXXXXXXXXXXXXXXXXXXXXXXXD

SEQ ID NO: 13787 - protein, 78 aa, consensus
  MISC_FEATURE (1)..(78): consensus for the disclosure of xaa see table XV
GXXXRXXXXXXXXXXXXXXXXXXXXXXXXXXXXXXXXXXXXXXXXXXXXXEXXXXXXLXXDDXXXXDXXXXRRXXXXX

SEQ ID NO: 13788 - protein, 62 aa, consensus
  MISC_FEATURE (1)..(62): consensus for the disclosure of xaa see table XV
XXXXXXXLXXXXXXXXXXXXXXXXXXXXXXXXXXXXXXXXXXXXXXXXXXXXXXXXXXXXXG

SEQ ID NO: 13789 - protein, 51 aa, consensus
  MISC_FEATURE (1)..(51): consensus for the disclosure of xaa see table XV
KTXXXXXXXXXXXXXXXXXXXXXXXXXXXXXXXXXXXXXGXXXQXXDDXXX

SEQ ID NO: 13790 - protein, 428 aa, consensus
  MISC_FEATURE (1)..(428): Xaa in all positions is any amino acid.
GGKRXRPXLXXXXXXXXXXXXXXXXXXXXXXXXXXXXXXXXXXXXXXAXXXEXXHXXXLXHDDXXXXDXXXXRRGXXXTXXXXXXXXXXXXXXXXXXXXXXXXXAXLXGDXLXXXAFXXXXXXXXXXXXXXXXXXXXXXXXXXXXXXXXXXXXXXXXXXXGQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTXXLXXXXXXXXGXXXXXXXXXXXXXXXXXXXXXXXXXGXXFQXXDDXLDXXXXXXXXXGKXXGXXDXXXXXKXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXR

SEQ ID NO: 13791 - DNA, 432 bp, Saccharomyces cerevisiae; identical to SEQ ID NO: 6880
  CDS (1)..(432)

SEQ ID NO: 13792 - protein, 143 aa, Saccharomyces cerevisiae; identical to SEQ ID NO: 6881

SEQ ID NO: 13793 - DNA, 309 bp, Arabidopsis thaliana (mouse-ear cress); identical to SEQ ID NO: 6882
  CDS (1)..(309)

SEQ ID NO: 13794 - protein, 102 aa, Arabidopsis thaliana (mouse-ear cress); identical to SEQ ID NO: 6883

SEQ ID NO: 13795 - DNA, 501 bp, Brucella melitensis; identical to SEQ ID NO: 6884
  CDS (28)..(306)

SEQ ID NO: 13796 - protein, 92 aa, Brucella melitensis; identical to SEQ ID NO: 6885

SEQ ID NO: 13797 - DNA, 324 bp, Nostoc sp. PCC 7120; identical to SEQ ID NO: 6886
  CDS (1)..(324)

SEQ ID NO: 13798 - protein, 107 aa, Nostoc sp. PCC 7120; identical to SEQ ID NO: 6887

SEQ ID NO: 13799 - DNA, 309 bp, Arabidopsis thaliana (mouse-ear cress); identical to SEQ ID NO: 6888
  CDS (1)..(309)

SEQ ID NO: 13800 - protein, 102 aa, Arabidopsis thaliana (mouse-ear cress); identical to SEQ ID NO: 6889

SEQ ID NO: 13801 - DNA, 540 bp, Arabidopsis thaliana (mouse-ear cress); identical to SEQ ID NO: 6890
  CDS (1)..(540)

SEQ ID NO: 13802 - protein, 179 aa, Arabidopsis thaliana (mouse-ear cress); identical to SEQ ID NO: 6891

SEQ ID NO: 13803 - DNA, 327 bp, vaccinia virus; identical to SEQ ID NO: 6892
  CDS (1)..(327)

SEQ ID NO: 13804 - protein, 108 aa, vaccinia virus; identical to SEQ ID NO: 6893

SEQ ID NO: 13805 - DNA, 312 bp, Arabidopsis thaliana (mouse-ear cress); identical to SEQ ID NO: 6894
  CDS (1)..(312)

SEQ ID NO: 13806 - protein, 103 aa, Arabidopsis thaliana (mouse-ear cress); identical to SEQ ID NO: 6895

SEQ ID NO: 13807 - DNA, 309 bp, Arabidopsis thaliana (mouse-ear cress); identical to SEQ ID NO: 6896
  CDS (1)..(309)

SEQ ID NO: 13808 - protein, 102 aa, Arabidopsis thaliana (mouse-ear cress); identical to SEQ ID NO: 6897

SEQ ID NO: 13809 - DNA, 309 bp, Arabidopsis thaliana (mouse-ear cress); identical to SEQ ID NO: 6898
  CDS (1)..(309)

SEQ ID NO: 13810 - protein, 102 aa, Arabidopsis thaliana (mouse-ear cress); identical to SEQ ID NO: 6899

SEQ ID NO: 13811 - DNA, 393 bp, Arabidopsis thaliana (mouse-ear cress); identical to SEQ ID NO: 6900
  CDS (1)..(393)

SEQ ID NO: 13812 - protein, 130 aa, Arabidopsis thaliana (mouse-ear cress); identical to SEQ ID NO: 6901

SEQ ID NO: 13813 - DNA, 589 bp, Bos primigenius taurus (cattle); identical to SEQ ID NO: 6902
  CDS (36)..(356)

SEQ ID NO: 13814 - protein, 106 aa, Bos primigenius taurus (cattle); identical to SEQ ID NO: 6903

SEQ ID NO: 13815 - DNA, 309 bp, Arabidopsis thaliana (mouse-ear cress); identical to SEQ ID NO: 6904
  CDS (1)..(309)

SEQ ID NO: 13816 - protein, 102 aa, Arabidopsis thaliana (mouse-ear cress); identical to SEQ ID NO: 6905

SEQ ID NO: 13817 - DNA, 309 bp, Arabidopsis thaliana (mouse-ear cress); identical to SEQ ID NO: 6906
  CDS (1)..(309)

SEQ ID NO: 13818 - protein, 102 aa, Arabidopsis thaliana (mouse-ear cress); identical to SEQ ID NO: 6907

SEQ ID NO: 13819 - DNA, 575 bp, Oryza sativa (rice); identical to SEQ ID NO: 6908
  CDS (45)..(383)

SEQ ID NO: 13820 - protein, 112 aa, Oryza sativa (rice); identical to SEQ ID NO: 6909

SEQ ID NO: 13821 - DNA, 333 bp, Saccharomyces cerevisiae; identical to SEQ ID NO: 6910
  CDS (1)..(333)

SEQ ID NO: 13822 - protein, 110 aa, Saccharomyces cerevisiae; identical to SEQ ID NO: 6911

SEQ ID NO: 13823 - DNA, 612 bp, Saccharomyces cerevisiae; identical to SEQ ID NO: 6912
  CDS (1)..(612)

SEQ ID NO: 13824 - protein, 203 aa, Saccharomyces cerevisiae; identical to SEQ ID NO: 6913

SEQ ID NO: 13825 - DNA, 321 bp, Homo sapiens (man); identical to SEQ ID NO: 6914
  CDS (1)..(321)

SEQ ID NO: 13826 - protein, 106 aa, Homo sapiens (man); identical to SEQ ID NO: 6915

SEQ ID NO: 13827 - DNA, 583 bp, Ricinus communis (castor bean); identical to SEQ ID NO: 6916
  CDS (44)..(352)

SEQ ID NO: 13828 - protein, 102 aa, Ricinus communis (castor bean); identical to SEQ ID NO: 6917

SEQ ID NO: 13829 - DNA, 531 bp, Arabidopsis thaliana (mouse-ear cress); identical to SEQ ID NO: 6918
  CDS (1)..(531)

SEQ ID NO: 13830 - protein, 176 aa, Arabidopsis thaliana (mouse-ear cress); identical to SEQ ID NO: 6919

SEQ ID NO: 13831 - DNA, 698 bp, Mesembryanthemum crystallinum (common ice plant); identical to SEQ ID NO: 6920
  CDS (60)..(464)

SEQ ID NO: 13832 - protein, 134 aa, Mesembryanthemum crystallinum (common ice plant); identical to SEQ ID NO: 6921

SEQ ID NO: 13833 - DNA, 441 bp, Caenorhabditis elegans; identical to SEQ ID NO: 6922
  CDS (1)..(441)

SEQ ID NO: 13834 - protein, 146 aa, Caenorhabditis elegans; identical to SEQ ID NO: 6923

SEQ ID NO: 13835 - DNA, 361 bp, Schizosaccharomyces pombe; identical to SEQ ID NO: 6924
  CDS (24)..(329)

SEQ ID NO: 13836 - protein, 101 aa, Schizosaccharomyces pombe; identical to SEQ ID NO: 6925

SEQ ID NO: 13837 - DNA, 501 bp, Schizosaccharomyces pombe; identical to SEQ ID NO: 6926
  CDS (1)..(501)

SEQ ID NO: 13838 - protein, 166 aa, Schizosaccharomyces pombe; identical to SEQ ID NO: 6927

SEQ ID NO: 13839 - DNA, 309 bp, Arabidopsis thaliana (mouse-ear cress); identical to SEQ ID NO: 6928
  CDS (1)..(309)

SEQ ID NO: 13840 - protein, 102 aa, Arabidopsis thaliana (mouse-ear cress); identical to SEQ ID NO: 6929

SEQ ID NO: 13841 - DNA, 312 bp, Arabidopsis thaliana (mouse-ear cress); identical to SEQ ID NO: 6930
  CDS (1)..(312)

SEQ ID NO: 13842 - protein, 103 aa, Arabidopsis thaliana (mouse-ear cress); identical to SEQ ID NO: 6931

SEQ ID NO: 13843 - DNA, 391 bp, Arabidopsis thaliana (mouse-ear cress); identical to SEQ ID NO: 6932
  CDS (33)..(341)

SEQ ID NO: 13844 - protein, 102 aa, Arabidopsis thaliana (mouse-ear cress); identical to SEQ ID NO: 6933

SEQ ID NO: 13845 - DNA, 330 bp, Neurospora crassa; identical to SEQ ID NO: 6934
  CDS (1)..(330)

SEQ ID NO: 13846 - protein, 109 aa, Neurospora crassa; identical to SEQ ID NO: 6935

SEQ ID NO: 13847 - DNA, 533 bp, Fritillaria agrestis; identical to SEQ ID NO: 6936
  CDS (39)..(353)

SEQ ID NO: 13848 - protein, 104 aa, Fritillaria agrestis; identical to SEQ ID NO: 6937

SEQ ID NO: 13849 - DNA, 330 bp, Plasmodium yoelii yoelii; identical to SEQ ID NO: 6938
  CDS (1)..(330): m means a or c

SEQ ID NO: 13850 - protein, 109 aa, Plasmodium yoelii yoelii; identical to SEQ ID NO: 6939
  misc_feature (54)..(54): Xaa can be Asn or His

SEQ ID NO: 13851 - DNA, 294 bp, Bordetella bronchiseptica; identical to SEQ ID NO: 6940
  CDS (1)..(294)

SEQ ID NO: 13852 - protein, 97 aa, Bordetella bronchiseptica; identical to SEQ ID NO: 6941

SEQ ID NO: 13853 - DNA, 342 bp, Triticum aestivum; identical to SEQ ID NO: 6942
  CDS (1)..(342)

SEQ ID NO: 13854 - protein, 113 aa, Triticum aestivum; identical to SEQ ID NO: 6943

SEQ ID NO: 13855 - DNA, 324 bp, Aphelenchus avenae; identical to SEQ ID NO: 6944
  CDS (1)..(324)

SEQ ID NO: 13856 - protein, 107 aa, Aphelenchus avenae; identical to SEQ ID NO: 6945

SEQ ID NO: 13857 - DNA, 327 bp, Cowpox virus; identical to SEQ ID NO: 6946
  CDS (1)..(327)

SEQ ID NO: 13858 - protein, 108 aa, Cowpox virus; identical to SEQ ID NO: 6947

SEQ ID NO: 13859 - DNA, 495 bp, Oryza sativa; identical to SEQ ID NO: 6948
  CDS (1)..(495)

SEQ ID NO: 13860 - protein, 164 aa, Oryza sativa; identical to SEQ ID NO: 6949

SEQ ID NO: 13861 - DNA, 270 bp, Vibrio vulnificus; identical to SEQ ID NO: 6950
  CDS (1)..(270)

SEQ ID NO: 13862 - protein, 89 aa, Vibrio vulnificus; identical to SEQ ID NO: 6951

SEQ ID NO: 13863 - DNA, 525 bp, Arabidopsis thaliana; identical to SEQ ID NO: 6952
  CDS (1)..(525)

SEQ ID NO: 13864 - protein, 174 aa, Arabidopsis thaliana; identical to SEQ ID NO: 6953

SEQ ID NO: 13865 - DNA, 608 bp, Arabidopsis thaliana; identical to SEQ ID NO: 6954
  CDS (68)..(445)

SEQ ID NO: 13866 - protein, 125 aa, Arabidopsis thaliana; identical to SEQ ID NO: 6955

SEQ ID NO: 13867 - DNA, 340 bp, Arabidopsis thaliana; identical to SEQ ID NO: 6956
  CDS (1)..(309)

SEQ ID NO: 13868 - protein, 102 aa, Arabidopsis thaliana; identical to SEQ ID NO: 6957

SEQ ID NO: 13869 - DNA, 618 bp, Arabidopsis thaliana; identical to SEQ ID NO: 6958
  CDS (54)..(461)

SEQ ID NO: 13870 - protein, 135 aa, Arabidopsis thaliana; identical to SEQ ID NO: 6959

SEQ ID NO: 13871 - DNA, 420 bp, Populus tremula x Populus tremuloides; identical to SEQ ID NO: 6960
  CDS (1)..(420)

SEQ ID NO: 13872 - protein, 139 aa, Populus tremula x Populus tremuloides; identical to SEQ ID NO: 6961

SEQ ID NO: 13873 - DNA, 664 bp, Mus musculus; identical to SEQ ID NO: 6962
  CDS (37)..(507)

SEQ ID NO: 13874 - protein, 156 aa, Mus musculus; identical to SEQ ID NO: 6963

SEQ ID NO: 13875 - DNA, 508 bp, Tilia platyphyllos; identical to SEQ ID NO: 6964
  CDS (28)..(375)

SEQ ID NO: 13876 - protein, 115 aa, Tilia platyphyllos; identical to SEQ ID NO: 6965

SEQ ID NO: 13877 - DNA, 604 bp, Deschampsia antarctica; identical to SEQ ID NO: 6966
  CDS (85)..(426)

SEQ ID NO: 13878 - protein, 113 aa, Deschampsia antarctica; identical to SEQ ID NO: 6967

SEQ ID NO: 13879 - DNA, 327 bp, Plasmodium berghei; identical to SEQ ID NO: 6968
  CDS (1)..(327)

SEQ ID NO: 13880 - protein, 108 aa, Plasmodium berghei; identical to SEQ ID NO: 6969

SEQ ID NO: 13881 - DNA, 498 bp, Homo sapiens; identical to SEQ ID NO: 6970
  CDS (1)..(498)

SEQ ID NO: 13882 - protein, 165 aa, Homo sapiens; identical to SEQ ID NO: 6971

SEQ ID NO: 13883 - DNA, 456 bp, Theileria parva; identical to SEQ ID NO: 6972
  CDS (1)..(456)

SEQ ID NO: 13884 - protein, 151 aa, Theileria parva; identical to SEQ ID NO: 6973

SEQ ID NO: 13885 - DNA, 336 bp, Arabidopsis thaliana; identical to SEQ ID NO: 6974
  CDS (1)..(336)

SEQ ID NO: 13886 - protein, 111 aa, Arabidopsis thaliana; identical to SEQ ID NO: 6975

SEQ ID NO: 13887 - DNA, 383 bp, Mus musculus; identical to SEQ ID NO: 6976
  CDS (15)..(383)

SEQ ID NO: 13888 - protein, 122 aa, Mus musculus; identical to SEQ ID NO: 6977

SEQ ID NO: 13889 - DNA, 318 bp, Caenorhabditis elegans; identical to SEQ ID NO: 6978
  CDS (1)..(318)

SEQ ID NO: 13890 - protein, 105 aa, Caenorhabditis elegans; identical to SEQ ID NO: 6979

SEQ ID NO: 13891 - DNA, 324 bp, Trypanosoma brucei; identical to SEQ ID NO: 6980
  CDS (1)..(324)

SEQ ID NO: 13892 - protein, 107 aa, Trypanosoma brucei; identical to SEQ ID NO: 6981

SEQ ID NO: 13893 - DNA, 336 bp, Plasmodium falciparum; identical to SEQ ID NO: 6982
  CDS (1)..(336)

SEQ ID NO: 13894 - protein, 111 aa, Plasmodium falciparum; identical to SEQ ID NO: 6983

SEQ ID NO: 13895 - DNA, 654 bp, Homo sapiens; identical to SEQ ID NO: 6984
  CDS (11)..(505)

SEQ ID NO: 13896 - protein, 164 aa, Homo sapiens; identical to SEQ ID NO: 6985

SEQ ID NO: 13897 - DNA, 478 bp, Drosophila melanogaster; identical to SEQ ID NO: 6986
  CDS (48)..(392)

SEQ ID NO: 13898 - protein, 114 aa, Drosophila melanogaster; identical to SEQ ID NO: 6987

SEQ ID NO: 13899 - DNA, 351 bp, Drosophila melanogaster; identical to SEQ ID NO: 6988
  CDS (1)..(351)

SEQ ID NO: 13900 - protein, 116 aa, Drosophila melanogaster; identical to SEQ ID NO: 6989

SEQ ID NO: 13901 - DNA, 644 bp, Homo sapiens; identical to SEQ ID NO: 6990
  CDS (26)..(481)

SEQ ID NO: 13902 - protein, 151 aa, Homo sapiens; identical to SEQ ID NO: 6991

SEQ ID NO: 13903 - DNA, 572 bp, Gallus gallus; identical to SEQ ID NO: 6992
  CDS (47)..(352)

SEQ ID NO: 13904 - protein, 101 aa, Gallus gallus; identical to SEQ ID NO: 6993

SEQ ID NO: 13905 - DNA, 321 bp, Homo sapiens; identical to SEQ ID NO: 6994
  CDS (1)..(321)

SEQ ID NO: 13906 - protein, 106 aa, Homo sapiens; identical to SEQ ID NO: 6915

SEQ ID NO: 13907 - DNA, 531 bp, Lycopersicon esculentum; identical to SEQ ID NO: 6996
  CDS (45)..(371)

SEQ ID NO: 13908 - protein, 108 aa, Lycopersicon esculentum; identical to SEQ ID NO: 6997

SEQ ID NO: 13909 - DNA, 473 bp, Mus musculus; identical to SEQ ID NO: 6998
  CDS (9)..(332)

SEQ ID NO: 13910 - protein, 107 aa, Mus musculus; identical to SEQ ID NO: 6999

SEQ ID NO: 13911 - DNA, 575 bp, Sus scrofa; identical to SEQ ID NO: 7000
  CDS (24)..(344)

SEQ ID NO: 13912 - protein, 106 aa, Sus scrofa; identical to SEQ ID NO: 7001

SEQ ID NO: 13913 - DNA, 432 bp, Saccharomyces cerevisiae; identical to SEQ ID NO: 6880
  CDS (1)..(432)

SEQ ID NO: 13914 - protein, 143 aa, Saccharomyces cerevisiae; identical to SEQ ID NO: 6881

SEQ ID NO: 13915 - DNA, 441 bp, Caenorhabditis elegans; identical to SEQ ID NO: 6922
  CDS (1)..(441)

SEQ ID NO: 13916 - protein, 146 aa, Caenorhabditis elegans; identical to SEQ ID NO: 6923

SEQ ID NO: 13917 - DNA, 324 bp, Rattus norvegicus; identical to SEQ ID NO: 7006
  CDS (1)..(324)

SEQ ID NO: 13918 - protein, 107 aa, Rattus norvegicus; identical to SEQ ID NO: 7007

SEQ ID NO: 13919 - DNA, 378 bp, Arabidopsis thaliana; identical to SEQ ID NO: 7008
  CDS (1)..(378)

SEQ ID NO: 13920 - protein, 125 aa, Arabidopsis thaliana; identical to SEQ ID NO: 7009

SEQ ID NO: 13921 - DNA, 651 bp, Ashbya gossypii; identical to SEQ ID NO: 7010
  CDS (1)..(651)

SEQ ID NO: 13922 - protein, 216 aa, Ashbya gossypii; identical to SEQ ID NO: 7011

SEQ ID NO: 13923 - DNA, 336 bp, Ashbya gossypii; identical to SEQ ID NO: 7012
  CDS (1)..(336)

SEQ ID NO: 13924 - protein, 111 aa, Ashbya gossypii; identical to SEQ ID NO: 7013

SEQ ID NO: 13925 - DNA, 25 bp, Primer
atggagaccaatttttccttcgact

SEQ ID NO: 13926 - DNA, 26 bp, Primer
ctattgaaataccggcttcaatattt

SEQ ID NO: 13927 - protein, 11 aa, consensus
  MISC_FEATURE (1)..(11): consensus for the disclosure of xaa see table XV
XXXXXXXXXXX

SEQ ID NO: 13928 - protein, 14 aa, consensus
  MISC_FEATURE (1)..(14): consensus for the disclosure of xaa see table XV
XXPXXXXXXXXXGX

SEQ ID NO: 13929 - protein, 80 aa, consensus; identical to SEQ ID NO: 7429
  MISC_FEATURE (1)..(80): Xaa in all positions is any amino acid.

SEQ ID NO: 13930 - DNA, 1728 bp, Saccharomyces cerevisiae
  CDS (660)..(1535)
gagctcacttcattgcgctgttactcccctaacaacgtggcctctctccattcggtaaggaatcaaattttgttctagaatgttcatgctgctgcggtcatttcttaccctagtagtaattcattgtgcccacgtacgaaccgtacaatgggattctgccctgcgcacgttcacagttcgccaaataacaattcttattttcatttctttttcacagtgtagatgataccgtgtctgcgacatttccattcttagtagaaatgcaaaacgcaacgtttgctattaatttttttcacctctgtttcctttttttttctcacctcaacaatcaaatgtacttatataaacttcttttgttatctccaaaatttaaacttatttacatcctttttcacttcatatatcaattcatgggaaagtaaagctatcttaattacatccttattttatatttcccaaccatcaacctttattctttacatatttctctcttttctcattttctttcttattaagcgtaaagcaccacaagcagtaccgatctaaagtctctctactttactattattttttttttttgttcacttcataaacttttagtgcaaaaataaaaataaagacaaataacacactatcaaatctcttcaagtttaacaattatgaactctattttagacagaaatgttagatctagcgaaactactttaattaaacctgaatctgaatttgataattggttgtcggatgaaaatgacggagctagtcatatcaacgtcaacaaggactcctcgtcagttctttctgcatcttcttccacatggttcgaaccattggaaaacattatctcctctgcatccagctcctcgataggctctccaatcgaagaccagtttatatcttccaacaacgaggaatctgctctttttccaacagatcagtttttcagtaatccttcctcatactcgcattctcccgaggttagcagctcgataaaaagagaagaggatgacaatgccctttcgttggcagattttgaaccggcttctttgcaattaatgcctaacatgataaatactgataataatgacgatagtaccccacttaagaatgaaatcgagctaaacgactcgtttataaaaacaaatctagatgctaaggaaacgaaaaagagggctccaagaaaaagactgacccccttccaaaagcaagctcacaacaagattgaaaaacgctacagaataaacatcaacacaaagattgcaagactgcagcagattatcccatgggtagcaagtgaacaaacagctttcgaagtaggtgattctgtaaaaaaacaggacgaagacggcgcagaaactgccgctactactcctcttccatctgccgctgctacaagcacgaagctaaataaaagcatgatcctagaaaaagctgttgactatattctatatctacaaaataacgaacgactatacgaaatggaagttcaaaggttgaaaagtgaaatcgacactttgaaacaagaccaaaaataaaagcacgcttgcttaaacaccaatattataaaattacgatagaaattcctttctcctcttttgtttatgcgacatttttttctttcttagcgaagtactttaaaaaacaagcccaaaaaataacaaggccataacatagcagacaagaatacaaaaaaaaaaaagaagttggaaaaaacatacaaaaaaaaaa

SEQ ID NO: 13931 - protein, 291 aa, Saccharomyces cerevisiae
MNSILDRNVRSSETTLIKPESEFDNWLSDENDGASHINVNKDSSSVLSASSSTWFEPLENIISSASSSSIGSPIEDQFISSNNEESALFPTDQFFSNPSSYSHSPEVSSSIKREEDDNALSLADFEPASLQLMPNMINTDNNDDSTPLKNEIELNDSFIKTNLDAKETKKRAPRKRLTPFQKQAHNKIEKRYRININTKIARLQQIIPWVASEQTAFEVGDSVKKQDEDGAETAATTPLPSAAATSTKLNKSMILEKAVDYILYLQNNERLYEMEVQRLKSEIDTLKQDQK

SEQ ID NO: 13932 - DNA, 2703 bp, Schizosaccharomyces pombe
  CDS (1)..(2703)
atgcaaagctcaattccgtcagtttccgtgtcggtcgcttctcctgcaatggaaactccaacaaaagcttcgcctgacagcaaatcacccaattcagtgggtgcgattccttcttcatcccctttggcttcatcgacaaaggcttcaacttctactccctttgtggagaattgttccaatctgttgtgtgatttggctagcattgtcgaggactcacctccaaccttgaccaacacctcgttgtctccccattcgttttccctttctgatatggagtcatcaatgagcaattggcttaacccttttgcgttcgacaatacgatgaactcggcgcctcctctgtttacttcgaccaacatgggctcccctaactcgttagaaaactctacaaatcctcttctctctaattgcggctctccaaattcatttcagaatgagacctttaccggcccatcattgaatgagttcgatgccgatgataaaattcagcgccaaatgaaaatccttcactctgttgatacaatcgatccatcgactgttcaaaattatccttcagctgatatgtcaaatccagaagtcaaattgaaaaccgaagaaattattacacccatggacaccacttgcaagcctgaaccttctgccaagaaaataaagttgtctccttcctcggaagattcttgctcaattcctgaaacattacctttttcggcccccaagtctagaggctcattatctccttctgaaaccccagattttgtagccggtcctggaggaaaaccaaagaagacagctcataacatgattgagaagagatacagaaccaacttgaacgaccgaatttgtgaattgcgtgatgcagttccttcacttcgtgctgctgctgcacttcgttgtggtaattctctggacgatgaggatttggggggtttgacacccgctcgtaagcttaacaagggtacaatattggcaaaagcaactgagtatatcagacatttggaggccaagaataaggaactacagaagactaacaagcagctttcagataggctggctttctacgaagatccttcgatggctcctccttctaacgatactcgagccgttaactctgttaatgttgtttcctcatctgactattctgttcaccaatcttctcgaccaaacctaacccaaagagcttttacttccccaaccctaaataccatgggccgcacagcactaaatggcatggttggacttggtctattcaattattttggaaacgattcttctcaatctgtttatggtttattcgctcttccaccttttcttatgtctccattcacaggtactgttctctttaacatgctgaaaattggtgttgttttactcggtttattctatcttttgcacgataactctcttttcaaaggcttcaagggtgaaaagaaatctaaagttagtaccagatcttccatgtcaccatcctcaatcttattccgaaaaaccgtattcgaaaagtattgtttattggaccattctacttcgactatttctctattttttggattactgatcttcactcttaaatctgcttatggctatttgactcatcgtttgagtgctctttatacctcctctgagaattgggtttatagtgagcaacaacttgctgaagttcgcaacatggaaaagcttttggatgcccaattaatgggtggtgatgctaaagttgaccgtttgaggctcttaatggtatttgccagttcattttctcttcctccttcaagtcatacttgtgctttacaagcaatgtattgccaactaattttttccaacacctctgtcccatccgctatcgtttcgaagtgcgttgctttcttctggaatgctgcaaagaaacaacatagcaaaagttctgtacacgcggagttacgtgagcttcctgagtgtactgctaacctaattgaaaactcccacgctgacgacgttttctctccgaatatggttgagcgattgtgggttctagcaaagtgcacccgtgactctgctcaaatgtcagatagtattattagctccttatctgatgttttggttttatctcctctagaggtgcttgcctcatggtatgccgctgatttgttggatgcccttttgatggaaagtttgagccgtaaagttgagatatccgagattgaggaaattatttccctttgtcctaagaactcctctattattcgtcatgctttactagctaaattggttttgttccccgagaatacagctgattctttgaatgaagtccttgcagcatacaagaacactttggatttatgcagccaagataaacgcaagcagtcaagcgtgttaaagatcaacttatccaagctattcacactccactcatgcctatcattagcactccaacgccttggatacggggatgtttctaaacgtatgtatcaggaaatctttgtacctgatagtgatgcagacattacacctttatcttttattatttcctggaccgctttgaacacttttgctcctatttgcacatctccaaaggaaaacgatgtcgttgaaaagatggccatgtacgtgcggacggccatcggaactttgaaaattcaagatttgaaattatctcgtaagttaatcaactcttgcatagatattggatctcgcttacaagaagatttgggttatgtttcatcagcttaa

SEQ ID NO: 13933 - protein, 900 aa, Schizosaccharomyces pombe
MQSSIPSVSVSVASPAMETPTKASPDSKSPNSVGAIPSSSPLASSTKASTSTPFVENCSNLLCDLASIVEDSPPTLTNTSLSPHSFSLSDMESSMSNWLNPFAFDNTMNSAPPLFTSTNMGSPNSLENSTNPLLSNCGSPNSFQNETFTGPSLNEFDADDKIQRQMKILHSVDTIDPSTVQNYPSADMSNPEVKLKTEEIITPMDTTCKPEPSAKKIKLSPSSEDSCSIPETLPFSAPKSRGSLSPSETPDFVAGPGGKPKKTAHNMIEKRYRTNLNDRICELRDAVPSLRAAAALRCGNSLDDEDLGGLTPARKLNKGTILAKATEYIRHLEAKNKELQKTNKQLSDRLAFYEDPSMAPPSNDTRAVNSVNVVSSSDYSVHQSSRPNLTQRAFTSPTLNTMGRTALNGMVGLGLFNYFGNDSSQSVYGLFALPPFLMSPFTGTVLFNMLKIGVVLLGLFYLLHDNSLFKGFKGEKKSKVSTRSSMSPSSILFRKTVFEKYCLLDHSTSTISLFFGLLIFTLKSAYGYLTHRLSALYTSSENWVYSEQQLAEVRNMEKLLDAQLMGGDAKVDRLRLLMVFASSFSLPPSSHTCALQAMYCQLIFSNTSVPSAIVSKCVAFFWNAAKKQHSKSSVHAELRELPECTANLIENSHADDVFSPNMVERLWVLAKCTRDSAQMSDSIISSLSDVLVLSPLEVLASWYAADLLDALLMESLSRKVEISEIEEIISLCPKNSSIIRHALLAKLVLFPENTADSLNEVLAAYKNTLDLCSQDKRKQSSVLKINLSKLFTLHSCLSLALQRLGYGDVSKRMYQEIFVPDSDADITPLSFIISWTALNTFAPICTSPKENDVVEKMAMYVRTAIGTLKIQDLKLSRKLINSCIDIGSRLQEDLGYVSSA

SEQ ID NO: 13934 - DNA, 975 bp, Candida glabrata
  CDS (1)..(975)
atggacttgcctaatcatcagaacttgaatggcgatggcatagatgaaaactataatagaaaaacctcacaattcagaccccttcaaaagtttgagtatcagaacagccaaagccttccagaattgtttggaagcggaaatcgagatatgaactccaacgccagatatatgagacagcaatatggacacaatgaaaatgtacaatacgttaatggggtcaataaagtataccccatgaaccctattattcctccaaaattaggtggaggtccttatatggttaggccatatgaacgtattgaagggacacagttggtgaagcctcatatcttccaaactggcgaaagttatcaaggaaatcaagagtatattttccagccatctacaagttcatcttacagttcagctactcttgtaaatgaagacacgaatatgccaaataaccatgtaatattagaaaatcatccaattgggctggagtataaactacccagcaactacattaatcatagtataccattaatgcatcctcaacaaagaatgcctgttacaccacatttgccgctcaagagcaccatacagccaggttcggaagatagtaaattcgatacacccaaaaatagcaaaaaaaaaatatccagaaagagattaactgatgttcagaagctagctcataataaaattgaaaagaaataccgtattaacataaattcaaagatagctcaattacagaaaatgataccgtgggtttctgatggtgaaactgcgtttgaagtcaactcttcgcttaaaacggaacagagtgatggagacagtacgtcaaacagtagtaaaactaaattcaacaaaagtataattctgcagaaggctatcgactatattgtatatctgcgaaataatgagcatctttaccaaactgaaatagatagattgcgacaagaagttgaaacgcttcgaaataatcaaaagagctga

SEQ ID NO: 13935 - protein, 324 aa, Candida glabrata
MDLPNHQNLNGDGIDENYNRKTSQFRPLQKFEYQNSQSLPELFGSGNRDMNSNARYMRQQYGHNENVQYVNGVNKVYPMNPIIPPKLGGGPYMVRPYERIEGTQLVKPHIFQTGESYQGNQEYIFQPSTSSSYSSATLVNEDTNMPNNHVILENHPIGLEYKLPSNYINHSIPLMHPQQRMPVTPHLPLKSTIQPGSEDSKFDTPKNSKKKISRKRLTDVQKLAHNKIEKKYRININSKIAQLQKMIPWVSDGETAFEVNSSLKTEQSDGDSTSNSSKTKFNKSIILQKAIDYIVYLRNNEHLYQTEIDRLRQEVETLRNNQKS

SEQ ID NO: 13936 - DNA, 1356 bp, Candida glabrata
  CDS (1)..(1356)
atggagattaacaatgaggaccacgagctgctagcggagattatgggccatggaggtgatggttctgagttgtttggcaacgatgctgatgtgtttctgcgaaatggctctgggtctggtgagacacaagcagggaatgctgatggactggcgttgtatccgcaggctacacctgcacaccgccatgagcagatggctatgatgaatcatgggaacagcgagatgcactccttcctggacgatatgtttacgaattctagtttgggccatggacagcctgttactgagtcaaatctgaccaagaacatgatgggtaaccactacgaacaaaatttggaaagcgacattgcatcatctttgtacaatagcagacaccccagtgtgagtatggagcacggcacagcgggacacccagaaatgctgttccaccaaaacgacaacagtatatcgagtttctcggagtcgttctacgggtcttctctggactctagcatttctgaagtatcctcgattaacagttttatgtctgggaactcgtttcctgctcctttgccacaccagatagatgaaaactctatacttgtgaacaataacatgtccccctcggggtttcgtgacagcataagaccggggagctttttgtcgacttcactgcgggccccaagttctatgtcccgccagatgcgcaacccgtcatataatgactcaggcatacctatgactgttggcagtgtgccgaagaatgcaacttcgcatatgactcctgatgagaaattgaaacgtaagagggagtttcataacgcagtagagcgcagaagaagagaactaataaaacaaaagataaaagaactctcaaagctagtaccaccttcgttgttgaactatgacgccgacggtaatcaaatcaagtctaataggggaacaatcctggataagagtgtagagtacctagaatacttactatacgttatagatattcagaagaggaaacgggaagcattacaggagaaaattgcccaattatcgagcttaagcagtagaacaactgacgatctgggtatgggaccacgcaaaatgactaatttaccccagaggatatcttcacaagctacacttaaggcaaacacattcaatgaagagaagataattgacactagagggatccctgatacaagagggatttcagcatcacaggctcatacagataacccattggaggatttcaaccataaccatgtcgactttaatgccacccacacagatttcaataataatattaacgatgacttacagcagttcctgtcaggggacttaatggaagcagaagacaacgcaaagctaatgttcaacccgtaa

SEQ ID NO: 13937 - protein, 451 aa, Candida glabrata
MEINNEDHELLAEIMGHGGDGSELFGNDADVFLRNGSGSGETQAGNADGLALYPQATPAHRHEQMAMMNHGNSEMHSFLDDMFTNSSLGHGQPVTESNLTKNMMGNHYEQNLESDIASSLYNSRHPSVSMEHGTAGHPEMLFHQNDNSISSFSESFYGSSLDSSISEVSSINSFMSGNSFPAPLPHQIDENSILVNNNMSPSGFRDSIRPGSFLSTSLRAPSSMSRQMRNPSYNDSGIPMTVGSVPKNATSHMTPDEKLKRKREFHNAVERRRRELIKQKIKELSKLVPPSLLNYDADGNQIKSNRGTILDKSVEYLEYLLYVIDIQKRKREALQEKIAQLSSLSSRTTDDLGMGPRKMTNLPQRISSQATLKANTFNEEKIIDTRGIPDTRGISASQAHTDNPLEDFNHNHVDFNATHTDFNNNINDDLQQFLSGDLMEAEDNAKLMFNP

SEQ ID NO: 13938 - DNA, 1017 bp, Candida glabrata
  CDS (1)..(1017)
atgaagttccataaacaaataaaatctattctttctacccaagagaattttgataatatacaactatttagtagtcaggaggctgtcaatcaaatgaacatggtcattccgttgtttccagaccaatctgatgaacttcggtctggaaatggagatagtgagcagaattggagaaatcaaggtgatgttcatatcgatcattcagtaccgtgcagtttaaatgaagattggattgattgtaaatcggatggtgaatctcagcagtctgtctcgtcatttggtaatacatgcactactggatctgagccaaagcatttcgaatccgcaacgagttcaatgcagacgtcgtcccagtttatgaatgagaaacacagtttcattgatgagcaaccatttcctagctttacagagcctgcagatattgaaagtcgtatggaaaaggcttttgattctctaatttcagaaaatgttctaactatcactgatgaaaagagaggtaaaaacacatcgacacaatgtgtttcaacaaaggaaagcgttattgataagaatcagcacataccattttgtgtttcaagaactatgggtaaaaataagaatggtttgatgggtgctaatatgcatgttctcgatgtaagaaatgacaaatactgtaaaaaaaatacaaaaactcagacgccaaaaggtagtaagagagcactccatagtattgttgaaaagaaatacagaacaaacattaatgagaggttagctgaacttaaaaatactgttccaacaatccgttatacctataaaaagctatgcaatatacctttgacagaagcagatcatcggcaattaaatggtatggaaccagctagaaaacttaataaagcatcaatcttgcacaaagctacagagtatatcaaatttcttgaaaatgaaaactctgatctgaaagctgaaaatgcaagattgcaaaacatcataaacttgtcctttaacctacaacaaagaattacgccactgaatatgtaa

SEQ ID NO: 13939 - protein, 338 aa, Candida glabrata
MKFHKQIKSILSTQENFDNIQLFSSQEAVNQMNMVIPLFPDQSDELRSGNGDSEQNWRNQGDVHIDHSVPCSLNEDWIDCKSDGESQQSVSSFGNTCTTGSEPKHFESATSSMQTSSQFMNEKHSFIDEQPFPSFTEPADIESRMEKAFDSLISENVLTITDEKRGKNTSTQCVSTKESVIDKNQHIPFCVSRTMGKNKNGLMGANMHVLDVRNDKYCKKNTKTQTPKGSKRALHSIVEKKYRTNINERLAELKNTVPTIRYTYKKLCNIPLTEADHRQLNGMEPARKLNKASILHKATEYIKFLENENSDLKAENARLQNIINLSFNLQQRITPLNM

SEQ ID NO: 13940 - DNA, 729 bp, Candida glabrata
  CDS (1)..(729)
atggctaccaagattgaacagcatgatttggacaactgggttaacaccactaatgagaaatatcctttctctacttctgaatcatccacttctttagccacttcgggatctccatggtttgaaccattggagaacattatttcttcgaactctagctctagtgtaacttcgccaagtgactccaacaatttcctgctgacggaaaacggctacgataacatctttgcgttcaacgagaatgacaaggacttccagctgaaaacagaagacgatgatgaccaattggtgtcattcgaagctgctatggaatcaatgccagccacttgcaagaaacagaaaaagaaagccccaagaaagaggttgactcaaaaccaaaaggaggctcacaacaagatcgaaaagcgttatagaattaacatcaatagcaaattagccaaattgcaacaaatcattccttgggttgcgagcgagcaatcaacttttgaagttgctgatggcaacaaaagggctacctccaagacggaagaaggtgacgatgcctttgcaaactttccatctactacgcctaaactaaacaagagcatgatcttggaaaaagctgttgattacattctatatctgcaaaataatgaaaaactattcgagatggaagtacacagactgaagtccgaacttggtgctgtaaagaaagaaaatcaagaattgaaacaactggcgacaggtaactaa

SEQ ID NO: 13941 - protein, 242 aa, Candida glabrata
MATKIEQHDLDNWVNTTNEKYPFSTSESSTSLATSGSPWFEPLENIISSNSSSSVTSPSDSNNFLLTENGYDNIFAFNENDKDFQLKTEDDDDQLVSFEAAMESMPATCKKQKKKAPRKRLTQNQKEAHNKIEKRYRININSKLAKLQQIIPWVASEQSTFEVADGNKRATSKTEEGDDAFANFPSTTPKLNKSMILEKAVDYILYLQNNEKLFEMEVHRLKSELGAVKKENQELKQLATGN

SEQ ID NO: 13942 - DNA, 1104 bp, Neurospora crassa
  CDS (1)..(1104)
atggaccaacccatagcctttacgtcgtacactaccgtgccctacagcactggccagcttcaaacctgccctgaatctttaacggacttttcgccagttgcactttatgaggacttcaacagcaccgacttcaattccgactctgcgggatcccctgtatcgcccctctcccctgtgccaagcgccacttccttcggtttattttcgccatatggtgatgatttgtttagatggggaaagttcgagcgtgagcactttgagccttccccagagtctgaagactgcttcaagtctgagccctacgacggaagcctcatctcgaccctcccacctcggcctcttaccgccagcccatccatcaaccccgttgagctctcgctagaggtgcccacgacaacacaagaccttaacttcaacttcgaaggcacaaataccaactcgccactgttccagtctcaagtcatggatgtaacacccccctcgcaacgctccaccccggctgccgttattgagccacaaccacaacagcaacaacctatcgaacttgctgaggatgtgaagcgttacccctcgcgcaacaacctcaagcgcaagtcttcctgctcttcgtcttccgatgaggaggaatgtcgcccagccaagcgcgtctccctatccccgccgcccaactcgtcccacagcccaccgatcaagcaggaaaagagcacttccctcccatccatgacggcccccaagaagacggcccacaacatgatcgagaagagatatcgcaccaacctcaacgacaagatcgcagcgcttcgcgactccgttccatctcttcgcatcgcagccatgcgcatggagagcggcaattacgatgatgagtatgagggcgaggaaggggatttgagcggtctgattccggctcccaagctcaacaaggcgaccatcctcagtaaggcgacggagtatatcagccagcttgaaaggaggaatcatggtctggagacggagaacagtgcattaagagggaggatggaaaacttggagatgtttttgatcagccgtggtggcggtccttccggtccatttgtgtggaatcagcaggagtggcccaggtga

SEQ ID NO: 13943 - protein, 367 aa, Neurospora crassa
MDQPIAFTSYTTVPYSTGQLQTCPESLTDFSPVALYEDFNSTDFNSDSAGSPVSPLSPVPSATSFGLFSPYGDDLFRWGKFEREHFEPSPESEDCFKSEPYDGSLISTLPPRPLTASPSINPVELSLEVPTTTQDLNFNFEGTNTNSPLFQSQVMDVTPPSQRSTPAAVIEPQPQQQQPIELAEDVKRYPSRNNLKRKSSCSSSSDEEECRPAKRVSLSPPPNSSHSPPIKQEKSTSLPSMTAPKKTAHNMIEKRYRTNLNDKIAALRDSVPSLRIAAMRMESGNYDDEYEGEEGDLSGLIPAPKLNKATILSKATEYISQLERRNHGLETENSALRGRMENLEMFLISRGGGPSGPFVWNQQEWPR

SEQ ID NO: 13944 - DNA, 780 bp, Ashbya gossypii
  CDS (1)..(780)
atgccagtcagcgtaatgaacaattctggggcagccgatttcgaggaatggctagcgcagggtccgatcaattctttgcctggttctgacggctcaagcggcgagacttcgtctgctgcatcgccatttgaccaatttgcgtctctttttgacgcggaagcgccgcttgcgccgctttctgatggtgaagccctgccgtccaacaagacctctgtcacgaactcgccggtgtgcataaaggaggaggacgcaggcgtgctgcagtttgctggagaccaatcgctggccgcacttgcgctgcacttcgacgggtttgatactgcgccgcaagcgacggaggcggacaacgaacgggacgatgcggacagtatcaacaacgaggaggaagagacccaggggctaacgcaaagcgagcgcgctgcatacaagcccaagcgggctcctcgcaagcgtttgaccccccaccaaaaggaggcccacaacaaaatcgagaagcgctatcgcatcaacattaacacaaagcttgcgaaactgcagcagattataccctgggttgcatcggaggccactgcatttgaggtggacgatgctctgcgccagaaatcttccccaacgatgatggacaccgccacgctcacatccgccactccaaaattgaacaaaagtatgattttggagaaggctgtcgactacattttgttcttgcagaacaatgagcgcctctatgcaatggaggtacaaaggttgaaggccgagctggatgcgcttcgcccccagtaa

SEQ ID NO: 13945 - protein, 259 aa, Ashbya gossypii
MPVSVMNNSGAADFEEWLAQGPINSLPGSDGSSGETSSAASPFDQFASLFDAEAPLAPLSDGEALPSNKTSVTNSPVCIKEEDAGVLQFAGDQSLAALALHFDGFDTAPQATEADNERDDADSINNEEEETQGLTQSERAAYKPKRAPRKRLTPHQKEAHNKIEKRYRININTKLAKLQQIIPWVASEATAFEVDDALRQKSSPTMMDTATLTSATPKLNKSMILEKAVDYILFLQNNERLYAMEVQRLKAELDALRPQ

SEQ ID NO: 13946 - DNA, 1123 bp, Kluyveromyces lactis
  CDS (219)..(1064)
gtatatgtgtgtctttgtttgaaatcatatatattagcatggttaagtctacttttttcatatatagccccacgttggatttgatagaccagtttgataattagttactacatacattgtttccattttattcttgtatatatatttacatacttctggtataccttaagtcctcatagaccaacaggactcaaatacacagataatacactattacaatggcttctattcaacaacaacagcagcaagaaggttacaagaacaccaacatgttcgctactcaaggttctaatattgaggattggtttgtcgctccacctacagcggatgtttggttggacaaggctggtaaagaggtagacacccatacctggacctctgattcttcctccgtttattcattatcaccatcggatcaatacagggctatgtttgattccgatcttttgttaaacaatcaagatactttggattcatctactgcctttaccattggcaataacgtttctgaggaaaactctcccttaatgaacgctactaatcctgacaacggatttgatttcgaaaagaatcaatttacacagctgcctttagctgctgagagtacagacctaccaaccctggattcagttgaaatagataatgatttgcaagtgaagatcgaagatggagaagaggttaagaaaccaaagaagcgtgcaactcagaaacctcaaaataagaagagaggctccagaaagagattgacggcagatcaaagagtaactcacaacatgatcgagaagagatacagaataaatattaataccaagatcggaaaattacaaaagattatcccatgggtggcttgcgaagatactgcgttcgttgtcgataataaagtcttgagtgctggagaagattctttgcctctaaagaaagtaaaactgaacaagagtatgattctcgaaaaggctgtcgattacattctatacctacaaaacaacgaaagactattcgagctagaggtccaaagattaagaaaagaaatcaatgaacttaaagccaatacctcaaaccaatgattgatttttttacacaggatggatgaaaacactgttgcagatatttctttacgtaacag

SEQ ID NO: 13947 - protein, 281 aa, Kluyveromyces lactis
MASIQQQQQQEGYKNTNMFATQGSNIEDWFVAPPTADVWLDKAGKEVDTHTWTSDSSSVYSLSPSDQYRAMFDSDLLLNNQDTLDSSTAFTIGNNVSEENSPLMNATNPDNGFDFEKNQFTQLPLAAESTDLPTLDSVEIDNDLQVKIEDGEEVKKPKKRATQKPQNKKRGSRKRLTADQRVTHNMIEKRYRININTKIGKLQKIIPWVACEDTAFVVDNKVLSAGEDSLPLKKVKLNKSMILEKAVDYILYLQNNERLFELEVQRLRKEINELKANTSNQ

SEQ ID NO: 13948 - DNA, 1648 bp, Candida albicans
  CDS (520)..(1392)
aattataacaaaaattattttccatttaataaaaaaatttttctactttgatatatctttctttttttttttatttattttatttccaacctcatatcttagttgaatagttataatcaacagaagacagcttataaacaagagactactactgtgaagttataattatatttgggttaatatcaccacagttcccctatacatattttttttctgaaaatcatcccgtcccccttttattttattacccacgaacacgtttatcaaaatagagatatctagctaaccaatctagggctattctgtttatttattttactatatttattagaacctgttctccatcaaagttttcttttttaaaaaaaaaccaagattctttcctttttagtttgtgtgcattagccaaaaaaaaaactcgttcgattttatttgtgaaaccaacaacagctttttttttacacgtaaatcaatagtgttcaatatcgtgctccgaattataattcaaccatctacaacatgttatcgcagtatgatgaacaacttgctgcgggcgacaataatgggttcaacaaacaaggtaatgcaactttatattcgtttgattttgttgatgccgacgatttcttagattcgatatctggcgcattgccgaataatggtcataacaatgtcaatcccaacaccaacgacatttcatttgaagatatgaatattatgaatccaaatatctattcccccgtatctgcagccagtggtgatgactttacacaatcttctggtcaaccgatgattagtgaaggtagtaattacacaggacaaaactttacagattacttatcggacaactcattggaagggtatgataagaatacaagtcgtccattacatgaagtcgatattggtttttctaacaaacgttccaattcaacttctacaggaagtttaagccacaatgaagagattacaccgatttcacactactccgttgactccatagtgacttctccagagcctccaataaacaaacaaggtgatttcccaccaatcaaaagaaccacaaccgtgagttctaccaatagtatcaccaacaccactaaaaaaccggccaaagtcacaaagccaaaatcaaaagataagaactctcacaacatgattgaaaagaaatacagaaccaacatcaacacaaaaatcttggctttgagagatgcagtgcctgctcttagaattgctgctggttgtgacgatgtttccatagctgatttggaagggttaacaccagcatctaaattgaacaaagctagtgttttaaccaaagctacagaatatatcaaacatttggaaagtaaaaactccattttgaaacaacaaatattgagttgcataggctaattcaacacgccaacatgaatccaaagtcattacctccacctcctcaacaaatgcaagcaccaccacaaccagggtttggcttttatccaccacaaaaccaatcattcaatgtcacccctgcttctcaatatccatctcctcaacaacaagtgtctccaacccaacaacaggcagtgcatcacccaccacaacctaatcgatatttgttgggaggtatggctgctgttatgggcacttattatttggtggatcgact

SEQ ID NO: 13949 - protein, 290 aa, Candida albicans
MLSQYDEQLAAGDNNGFNKQGNATLYSFDFVDADDFLDSISGALPNNGHNNVNPNTNDISFEDMNIMNPNIYSPVSAASGDDFTQSSGQPMISEGSNYTGQNFTDYLSDNSLEGYDKNTSRPLHEVDIGFSNKRSNSTSTGSLSHNEEITPISHYSVDSIVTSPEPPINKQGDFPPIKRTTTVSSTNSITNTTKKPAKVTKPKSKDKNSHNMIEKKYRTNINTKILALRDAVPALRIAAGCDDVSIADLEGLTPASKLNKASVLTKATEYIKHLESKNSILKQQILSCIG

SEQ ID NO: 13950 - DNA, 27 bp, Primer
atgaactctattttagacagaaatgtt

SEQ ID NO: 13951 - DNA, 27 bp, Primer
ttatttttggtcttgtttcaaagtgtc

SEQ ID NO: 13952 - DNA, 2103 bp, Saccharomyces cerevisiae
  CDS (1)..(2103)
atggttgctcaatataccgttccagttgggaaagccgccaatgagcatgaaactgctccaagaagaaattatcaatgccgcgagaagccgctcgtcagaccgcctaacacaaagtgttccactgtttatgagtttgttctagagtgctttcagaagaacaaaaattcaaatgctatgggttggagggatgttaaggaaattcatgaagaatccaaatcggttatgaaaaaagttgatggcaaggagacttcagtggaaaagaaatggatgtattatgaactatcgcattatcattataattcatttgaccaattgaccgatatcatgcatgaaattggtcgtgggttggtgaaaataggattaaagcctaatgatgatgacaaattacatctttacgcagccacttctcacaagtggatgaagatgttcttaggagcgcagtctcaaggtattcctgtcgtcactgcctacgatactttgggagagaaagggctaattcattctttggtgcaaacggggtctaaggccatttttaccgataactctttattaccatccttgatcaaaccagtgcaagccgctcaagacgtaaaatacataattcatttcgattccatcagttctgaggacaggaggcaaagtggtaagatctatcaatctgctcatgatgccatcaacagaattaaagaagttagacctgatatcaagacctttagctttgacgacatcttgaagctaggtaaagaatcctgtaacgaaatcgatgttcatccacctggcaaggatgatctttgttgcatcatgtatacgtctggttctacaggtgagccaaagggtgttgtcttgaaacattcaaatgttgtcgcaggtgttggtggtgcaagtttgaatgttttgaagtttgtgggcaataccgaccgtgttatctgttttttgccactagctcatatttttgaattggttttcgaactattgtccttttattggggggcctgcattggttatgccaccgtaaaaactttaactagcagctctgtgagaaattgtcaaggtgatttgcaagaattcaagcccacaatcatggttggtgtcgccgctgtttgggaaacagtgagaaaagggatcttaaaccaaattgataatttgcccttcctcaccaagaaaatcttctggaccgcgtataataccaagttgaacatgcaacgtctccacatccctggtggcggcgccttaggaaacttggttttcaaaaaaatcagaactgccacaggtggccaattaagatatttgttaaacggtggttctccaatcagtcgggatgctcaggaattcatcacaaatttaatctgccctatgcttattggttacggtttaaccgagacatgcgctagtaccaccatcttggatcctgctaattttgaactcggcgtcgctggtgacctaacaggttgtgttaccgtcaaactagttgatgttgaagaattaggttattttgctaaaaacaaccaaggtgaagtttggatcacaggtgccaatgtcacgcctgaatattataagaatgaggaagaaacttctcaagctttaacaagcgatggttggttcaagaccggtgacatcggtgaatgggaagcaaatggccatttgaaaataattgacaggaagaaaaacttggtcaaaacaatgaacggtgaatatatcgcactcgagaaattagagtccgtttacagatctaacgaatatgttgctaacatttgtgtttatgccgaccaatctaagactaagccagttggtattattgtaccaaatcatgctccattaacgaagcttgctaaaaagttgggaattatggaacaaaaagacagttcaattaatatcgaaaattatttggaggatgcaaaattgattaaagctgtttattctgatcttttgaagacaggtaaagaccaaggtttggttggcattgaattactagcaggcatagtgttctttgacggcgaatggactccacaaaacggttttgttacgtccgctcagaaattgaaaagaaaagacattttgaatgctgtcaaagataaagttgacgccgtttatagttcgtcttaa

SEQ ID NO: 13953 - protein, 700 aa, Saccharomyces cerevisiae
MVAQYTVPVGKAANEHETAPRRNYQCREKPLVRPPNTKCSTVYEFVLECFQKNKNSNAMGWRDVKEIHEESKSVMKKVDGKETSVEKKWMYYELSHYHYNSFDQLTDIMHEIGRGLVKIGLKPNDDDKLHLYAATSHKWMKMFLGAQSQGIPVVTAYDTLGEKGLIHSLVQTGSKAIFTDNSLLPSLIKPVQAAQDVKYIIHFDSISSEDRRQSGKIYQSAHDAINRIKEVRPDIKTFSFDDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGALGNLVFKKIRTATGGQLRYLLNGGSPISRDAQEFITNLICPMLIGYGLTETCASTTILDPANFELGVAGDLTGCVTVKLVDVEELGYFAKNNQGEVWITGANVTPEYYKNEEETSQALTSDGWFKTGDIGEWEANGHLKIIDRKKNLVKTMNGEYIALEKLESVYRSNEYVANICVYADQSKTKPVGIIVPNHAPLTKLAKKLGIMEQKDSSINIENYLEDAKLIKAVYSDLLKTGKDQGLVGIELLAGIVFFDGEWTPQNGFVTSAQKLKRKDILNAVKDKVDAVYSSS

SEQ ID NO: 13954 - DNA, 3657 bp, Rattus norvegicus (Norway rat)
  CDS (14)..(2113)
ccaacacagaactatggaagtccacgaattgttccggtattttcgaatgccagagctgattgacattcggcagtacgtgcgtacccttccaaccaacacactcatgggcttcggggcttttgcagcgctcaccaccttctggtatgccacccggccgaaggccctgaagccaccatgtgatctgtccatgcagtctgtggaagtaacgggtactactgagggtgtccgaagatcagcagtccttgaggacgacaagctcttgctgtactactacgacgatgtcagaacgatgtacgatggcttccagagggggattcaggtgtcaaatgatggcccttgtttaggttctagaaagccaaaccagccatatgagtggatttcttacaaacaggttgcagaaatggctgagtgcataggctcggcgctgatccagaagggtttcaaaccttgctcagagcagttcatcggcatcttttctcagaacagacctgagtgggtgaccatcgagcaggggtgcttcacttactccatggtggttgttccgctctatgacacgcttggaaccgacgccatcacctacatagtgaacaaagctgaactctctgtgatttttgctgacaagccagaaaaagccaaactcttattagaaggtgtagaaaataagttaacaccatgccttaaaatcatagtcatcatggactcctacgacaatgatctggtggaacgcggccagaagtgtggggtggaaatcatcggcctaaaagctctggaggatcttggaagagtgaacagaacgaaacccaagcctccagaacctgaagatcttgcgataatctgtttcacaagtggaactacaggcaaccccaaaggagcaatggtcacccaccaaaacattatgaacgattgctccggttttataaaagcgacggagagtgcattcatcgcttccccagaggatgttctgatatctttcttgcctctcgcccatatgtttgagaccgttgtagagtgtgtaatgctatgtcatggagctaagataggatttttccaaggagacatcaggctgcttatggatgacctcaaggtgcttcagcctaccatcttccctgtggttccgagactgctaaaccggatgtttgacagaatttttggacaagcaaacacgtcagtgaagcgatggctgttggattttgcctccaaaaggaaagaggcggagcttcgcagtggcatcgtcagaaacaacagcctgtgggataaactcatctttcacaagatacagtcgagcctgggcgggaaagtccggctgatgatcacaggagcagccccagtgtctgccacagtgctgacgtttctgagggcggctctcggctgtcagttctatgaaggctacggacagaccgagtgcaccgctggttgctgcctgagcttgcctggagactggacagcaggccatgttggtgcccccatgccttgcaattatatcaagcttgtagatgtggaagatatgaattaccaggctgccaagggcgagggtgaggtgtgtgtgaaaggggcaaatgtgttcaaaggctacttgaaagacccagcaagaacagctgaagccctagataaagatggttggttacacacgggggacattggaaaatggctgccaaatggcaccttgaagattatcgacaggaaaaagcacatatttaaactagcccaaggagagtacatagctccagaaaagatcgaaaatatctacctgcggagcgaagccgtggcccaggtgtttgtccatggagaaagcttgcaggcctttctcatagccattgtagtacctgatgtggagatcctaccttcctgggcacagaagagaggatttcaagggtcctttgaagaactgtgcaggaacaaggatatcaataaagctatcctggaagacatggtgaaacttgggaagaatgctggtttgaagccatttgaacaggtcaaaggcattgctgtgcacccggaattattttctattgacaatggcctcctgactccaacactgaaggcaaaaaggccagagctgcggaactatttcaggtcacagatagatgaactgtactccaccatcaagatttaacatgaggaagaatccttagaggaaatggcgcacctccacaatcctcctcgtaccaatggcctttgagttggtaactctgcctgcagcgagtgtgggaaaggaaatgccatgctggacttgtgcacagggtcttaccatagggatagcagagggcacggaacactgccttacagtcacctgtgttgtagcccatgatcctggggatacacagtttccaaaacgagccttaaacattgtaaaggggaacccataaaagtgctaagttatttaagacttcaaccaataaggtgggtgttaaaacttctgtctcctgtttttctaaccaaggggttaggacttactctttctgatacgtctgctgctggctgcacaccctgcagccgtctgctgctctgaagagtacagtacactggaagaaagctacccctttaagagcaactgtccaggctgaagaaagtcacagtggaccagagatttctcttcttaaccccttccccttgtccctttccctcaccactcacatgcagtacatttatgtgacccttctggtttgtaagggttccaaagggtccctgttgtgcctgctggtaacctcgtgtttccagtacactaaagaacagatcctcctcagaacaatgcgggtacccagtctcagaaaaggaaaaaaaaaaaaaggtggctcctgcgttgagccagcaacttgcaggctcacacagatgtcctcagactccgctccatctctgctccctgcccctcccattcttcccaggggttatgagaaaccctgccttagactctgcagtgaagatggtgttccgaagaatgacctggatgggccatgctcaactgtgattcctcccccgctgtccactcgctcgctcgtcgtggaaccagcccgtatctgcagcggcctctgtgctccaaatgtggttttctagcaaatgctaatgtggtgatcaacttgctttgttttctttccctcccagttaaactcaggcacagcatgtcttcagaagtatctaggcagttggtatacgtgggtacttattaaagtggacagtaataagtaaatgtccttattataaaactacctgatttatgtgaaatgcatttgataagccaaaaatctggggtgtagaaatctgggggaaaaaaaatcatatcctgggatcaacttcccaaggtatattttttaagttaatttgggaaatgaacagcatttcactttgccgcgagtcttggccacatttgacctatttgagctgtttatacatttgaagccactgttgttggctgtgtgacagtgtgtgtatcttgaagcacaactgggtttgcactaaagaatcatcattgtaataacactatttggtagcctaacttcattttcgtattcttaactgcacaggaagtcgataatttgtcacaacggggttttgaatgtttgctttcagtgttggctatttctatgttttataaaccaaaacagaatttccaaaaacaatgaaggaaaccaaaataaatatttctgcatttggagtgagtgg

SEQ ID NO: 13955 - protein, 699 aa, Rattus norvegicus (Norway rat)
MEVHELFRYFRMPELIDIRQYVRTLPTNTLMGFGAFAALTTFWYATRPKALKPPCDLSMQSVEVTGTTEGVRRSAVLEDDKLLLYYYDDVRTMYDGFQRGIQVSNDGPCLGSRKPNQPYEWISYKQVAEMAECIGSALIQKGFKPCSEQFIGIFSQNRPEWVTIEQGCFTYSMVVVPLYDTLGTDAITYIVNKAELSVIFADKPEKAKLLLEGVENKLTPCLKIIVIMDSYDNDLVERGQKCGVEIIGLKALEDLGRVNRTKPKPPEPEDLAIICFTSGTTGNPKGAMVTHQNIMNDCSGFIKATESAFIASPEDVLISFLPLAHMFETVVECVMLCHGAKIGFFQGDIRLLMDDLKVLQPTIFPVVPRLLNRMFDRIFGQANTSVKRWLLDFASKRKEAELRSGIVRNNSLWDKLIFHKIQSSLGGKVRLMITGAAPVSATVLTFLRAALGCQFYEGYGQTECTAGCCLSLPGDWTAGHVGAPMPCNYIKLVDVEDMNYQAAKGEGEVCVKGANVFKGYLKDPARTAEALDKDGWLHTGDIGKWLPNGTLKIIDRKKHIFKLAQGEYIAPEKIENIYLRSEAVAQVFVHGESLQAFLIAIVVPDVEILPSWAQKRGFQGSFEELCRNKDINKAILEDMVKLGKNAGLKPFEQVKGIAVHPELFSIDNGLLTPTLKAKRPELRNYFRSQIDELYSTIKI

SEQ ID NO: 13956 - DNA, 2927 bp, Saccharomyces cerevisiae
  CDS (390)..(2624)
tctagaagtcccggtgtcccctgacgttattgtagacggctttaacgacgccttacagctaagcaaataagtacgtatatatatggttagctttacgcaaactacttcttttgacaattgaggcgttatcagctaataagaaaaagtagttagtatcaaaagacacaatttatttatattaaccaaatttttcgaacatcctccggaccgtcagtctttaacgccgagccgccgatgatgggttggagtcaaaacgagggaactcaatattaattgcggagttgagcgatgatgggttggaactatataaagcatcggaaacgcatggctaagggaagtggaagaatgcaggttacaaaaaacggataagaacaaacttgtttcgaaatatggccgctccagattatgcacttaccgatttaattgaatcggatcctcgtttcgaaagtttgaagacaagattagccggttacaccaaaggctctgatgaatatattgaagagctatactctcaattaccactgaccagctatcccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaacgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagtgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatggaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttaaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcaccgatgggctacaaggattcgaaaaattgcataacatcaaagtcggacttgagcctttaactctcgaggatgatgttgtgacgccaacttttaaaataaagcgtgccaaagcatcaaaattcttcaaagatacattagaccaactatacgccgaaggttcactagtcaagacagaaaagctttaggtacttatgacgatttggaacacattcaaactagaaaaaactttgatgtaggatatccctatgcacatccatacggtatacatagtgaacgctcactgtgtataatggactaacagtagttataaacctgctttcgttactacagcacacaagactattgtactttgttaaagaactataagattaaagacatacataattccaactatttataccattaaatattcttcttaagctttttttcgcggctttctataatatatgaggatcaattagtgaaagcaatgctctctatgttggaac

SEQ ID NO: 13957 - protein, 744 aa, Saccharomyces cerevisiae
MAAPDYALTDLIESDPRFESLKTRLAGYTKGSDEYIEELYSQLPLTSYPRYKTFLKKQAVAISNPDNEAGFSSIYRSSLSSENLVSCVDKNLRTAYDHFMFSARRWPQRDCLGSRPIDKATGTWEETFRFESYSTVSKRCHNIGSGILSLVNTKRKRPLEANDFVVAILSHNNPEWILTDLACQAYSLTNTALYETLGPNTSEYILNLTEAPILIFAKSNMYHVLKMVPDMKFVNTLVCMDELTHDELRMLNESLLPVKCNSLNEKITFFSLEQVEQVGCFNKIPAIPPTPDSLYTISFTSGTTGLPKGVEMSHRNIASGIAFAFSTFRIPPDKRNQQLYDMCFLPLAHIFERMVIAYDLAIGFGIGFLHKPDPTVLVEDLKILKPYAVALVPRILTRFEAGIKNALDKSTVQRNVANTILDSKSARFTARGGPDKSIMNFLVYHRVLIDKIRDSLGLSNNSFIITGSAPISKDTLLFLRSALDIGIRQGYGLTETFAGVCLSEPFEKDVGSCGAIGISAECRLKSVPEMGYHADKDLKGELQIRGPQVFERYFKNPNETSKAVDQDGWFSTGDVAFIDGKGRISVIDRVKNFFKLAHGEYIAPEKIENIYLSSCPYITQIFVFGDPLKTFLVGIVGVDVDAAQPILAAKHPEVKTWTKEVLVENLNRNKKLRKEFLNKINKCTDGLQGFEKLHNIKVGLEPLTLEDDVVTPTFKIKRAKASKFFKDTLDQLYAEGSLVKTEKL

SEQ ID NO: 13958 - DNA, 1542 bp, Bacillus subtilis
  CDS (1)..(1542)
atgaatcttgtttcaaaattggaagaaacagcatctgagaagcccgacagcatcgcatgcaggtttaaagatcacatgatgacgtatcaagagctgaatgaatatattcagcgatttgcggacggccttcaggaagccggtatggagaaaggggaccatttagctttgctgcttggcaattcgcctgattttatcatcgcgttttttggcgctttaaaagctgggatcgtagttgttcccatcaatccgttgtacacgccgacagaaattggttatatgctgacaaatggcgatgtaaaggcaatcgtgggcgttagccagcttttgccgctttatgagagcatgcatgaatcgctgccaaaggttgagctcgtcattttatgccagacgggggaggccgagccggaagctgcggacccagaggtcaggatgaaaatgacaacgtttgcaaaaatattgcggccgacatctgccgctaaacaaaaccaagaacctgtacctgatgataccgcggttattttatatacgtcaggaacgactggaaaaccgaaaggcgcgatgctgacacatcagaatttgtacagcaatgccaacgatgtcgcaggctatttgggaatggatgagagggacaatgtggtctgcgctcttcccatgtgtcacgtgttttgtttaaccgtctgtatgaatgcaccgctgatgagcggcgcaactgtattgattgagcctcaattcagtccggcatctgtttttaagcttgttaagcagcagcaggcgaccatttttgccggtgtgcctacaatgtataactacttgtttcagcatgaaaacggaaagaaagatgatttttcttcgatccggctgtgcatttcgggaggcgcgtccatgccagtcgcgttgctgacggcgtttgaagaaaaattcggtgttaccattttggaaggctacgggctctcggaagcatcacccgtcacgtgctttaacccgtttgacaggggcagaaagccgggctccatcgggacaagtatcttacatgtcgaaaacaaggtcgtagatccgctcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccggaaaaaagacatgatcattgtaggaggatacaatgtgtatccgcgggaggtggaggaggtgctgtacagccatccggacgtcaaggaggcggttgtcatcggcgtgccggacccccaaagcggggaagcggtaaagggatatgtggtgccgaaacgctctggggtaacagaggaggacatcatgcagcactgcgaaaagcatctggcaaaatacaagcggcctgccgccattacgtttcttgacgatattccgaaaaatgcgacggggaaaatgctcagacgggcactgagagatattttgccccaataa

SEQ ID NO: 13959 - protein, 513 aa, Bacillus subtilis
MNLVSKLEETASEKPDSIACRFKDHMMTYQELNEYIQRFADGLQEAGMEKGDHLALLLGNSPDFIIAFFGALKAGIVVVPINPLYTPTEIGYMLTNGDVKAIVGVSQLLPLYESMHESLPKVELVILCQTGEAEPEAADPEVRMKMTTFAKILRPTSAAKQNQEPVPDDTAVILYTSGTTGKPKGAMLTHQNLYSNANDVAGYLGMDERDNVVCALPMCHVFCLTVCMNAPLMSGATVLIEPQFSPASVFKLVKQQQATIFAGVPTMYNYLFQHENGKKDDFSSIRLCISGGASMPVALLTAFEEKFGVTILEGYGLSEASPVTCFNPFDRGRKPGSIGTSILHVENKVVDPLGRELPAHQVGELIVKGPNVMKGYYKMPMETEHALKDGWLYTGDLARRDEDGYFYIVDRKKDMIIVGGYNVYPREVEEVLYSHPDVKEAVVIGVPDPQSGEAVKGYVVPKRSGVTEEDIMQHCEKHLAKYKRPAAITFLDDIPKNATGKMLRRALRDILPQ

SEQ ID NO: 13960 - DNA, 1893 bp, Borrelia burgdorferi (Lyme disease spirochete)
  CDS (1)..(1893)
atgtcaatagcaaaggcattttttgaagtggctgatcaacaaaaagataaaattgctcaaatgtataaagtttgcaatggatatgcccacgttacttatggcgacttaaaaaacaatgttttaaagcttgcttcctttttaaagtcaatcaatgttaagcatcaagataaaatatttatttgctctgagaatagggctgagtggactgtgatagattttgcaattttatctttgggtgccgttgatattccaaagggttctgatgttactctttttgaagcggaaattatttttaactccgttcttccaagtgtagttattttagaaaatttaaatcttcttaatatgtttattcaaattaaatttacagtaaagccaatatttattattattgaaaatttaaaccaagaggatagattaaaatatagtgattttgaaatttatacttatagcgattgtattttatttggagataccttaagaaaagattcagaaattattgagattgcaagtaaagttgattctaatgatatggcaacaataatatatacttctggaacaacaggccacccaaagggggtaatgctcagccatgccaatcttctttatcaggtttctagttttagtttaatggttgatacgcatgtgggacaaatatttatgtgcattttgccaatttggcattcctttcaaaggtctttttcttacaatattttcctcaagggtatggtttgtttattttccaccattgttccaagggcaatgcttgatgatattaaaaatgttaatcctcattatattgcagctgttcctaggctttggattgcaataagacaaaatatttacaaagaagtttctaagaaaccgtttatttctagaatgatttttcatttttttgtaaaagcggcatttcttagcgatatttgctatagggtggtaatggggctttatccggacaacgggtttagtttatttttccctataaagaaaattttaggaatatttggattaatctgtgcatttccttttaaggctttggggaatgttttaatttttaataaaataaataagatcttgggcaataattttgttgttgggattactggtggcgggagtatgccattgtctgctgttagattttttaattcaattggtattgagcttgccaatgcttatggattgactgaaacctcgcctggagtggcttctaataagcataaaaaagtgattattgggacttgtggtaaaattttgcccggaactgttgctgaaattagagatattgatgggaataagcttaaaaagcctggaaagggaattttgtttgtaaaagggcctcaagtaatgcttggatattacaaggacaaagaagcaacttgtaagattattggttctgatgggtttttaaacacgggtgatattgcaaaattatccaaggataatgttgttcaaattattggtcgagaaaaagatacaattgttttgaataatggagagaatgttgagcctgctccaattgagattaagcttgaagaatcagcattaatagaaaaagcagttgttgtagggcaagatcaaaaattcttaggcgctcttattcttccaaattttgaagaaataaataaatatctagaaagtgttggacaaaaaatttttgatgctaataataggcgtcaaattattgcgaataatattgttcttaaggccataaatgatgaaataaaaaaattaatcaataaagccaatggatttaagccttttgagcagatattaaagtttactcttttagaaaaaccatttgaagttggtaaagaaatgtctattaaaatggacattaagcgaagctatattttaaatttttataaaaatgaaattaaaaatttatttatttaa

SEQ ID NO: 13961 - protein, 630 aa, Borrelia burgdorferi (Lyme disease spirochete)
MSIAKAFFEVADQQKDKIAQMYKVCNGYAHVTYGDLKNNVLKLASFLKSINVKHQDKIFICSENRAEWTVIDFAILSLGAVDIPKGSDVTLFEAEIIFNSVLPSVVILENLNLLNMFIQIKFTVKPIFIIIENLNQEDRLKYSDFEIYTYSDCILFGDTLRKDSEIIEIASKVDSNDMATIIYTSGTTGHPKGVMLSHANLLYQVSSFSLMVDTHVGQIFMCILPIWHSFQRSFSYNIFLKGMVCLFSTIVPRAMLDDIKNVNPHYIAAVPRLWIAIRQNIYKEVSKKPFISRMIFHFFVKAAFLSDICYRVVMGLYPDNGFSLFFPIKKILGIFGLICAFPFKALGNVLIFNKINKILGNNFVVGITGGGSMPLSAVRFFNSIGIELANAYGLTETSPGVASNKHKKVIIGTCGKILPGTVAEIRDIDGNKLKKPGKGILFVKGPQVMLGYYKDKEATCKIIGSDGFLNTGDIAKLSKDNVVQIIGREKDTIVLNNGENVEPAPIEIKLEESALIEKAVVVGQDQKFLGALILPNFEEINKYLESVGQKIFDANNRRQIIANNIVLKAINDEIKKLINKANGFKPFEQILKFTLLEKPFEVGKEMSIKMDIKRSYILNFYKNEIKNLFI

SEQ ID NO: 13962 - DNA, 1803 bp, Mycobacterium leprae
  CDS (1)..(1803)
atgcgtgagttcagcgtcccaacccgattttccgtcggcgagcacgacaacatcgcggccgtggtcttcgagcacgagcgcgatgaccccaacttggtcatatatcaacgccaaatcgacggcgtctggaccgacgtcacatgcgccgaagcggccagtcaaattcgctccgcagcacttggtttgatcgcgctggggatgcaggcaggcgaccgggtatccatcttctcggccacctgcttcgagtgggcaatcctcgacctggcgatcctatccgtgggcgcggtgaccgtacctatctacgaaacctcgtcagccaagcaggtacgctggatactgcaggactcagacgcggtattggtgttcgcagagaccgatgcacacgcgacaatggtcaatcagcttgccggcgaactgcccgccctacgtcaggtgttacagatcaacagcgcaggcgctacggcgctcgaccaactcgctgaagccggcgcatcggtcgacgtggctcagctggcaaaccggctcaagacgttacgcgcccaggacccagcgacacttatctatacctcgggcaccactggtcgccccaaaggctgtcaactcacacactccaacctgctctatgaagtccggggtgccaaggaatgcctcccgacgttgctgcagcccggccagcgactgctggttttcctgccattggctcacgtactggcccgagcgcttaccctgtctgccttcacctacaagatgaccgtcgggttcaccagcgacatcaagaatctgctgccgatgttagcggtgtttaagccaaccgtggtggtgtccgtgccgcgggtattcgagaaagtgtacaataccgctgagcaaaacgcagccaacgagggcaaaagtcgaatcttcgcgatggccgcacagacggcagtcgagtggagcgaagcctcccaccgcggcggtccagggcttctgctgcgcgccaggcacgcggtgtttgaccggctagtctaccgcaagttgcgcgcagcgcttggcggtgattgccatgcgtcggtgtcgggcggcgcacccttgggcgcgagactaggccacttctatcgtggggtgggcctcaccatccacgagggctatggactgaccgagaccagtgctgccatcacacttaaccaggccggcaacgttaaggtcgggaccgttggaaatctgctgccgggcaacagtatgcgcatcgcagacgacggcgagctgttggtacgcggcaatgtggtgttcagcggctattggcacaacgaacaagggaccatcgaggcgtttaccgagggctggtttaagacaggcgatctcggtgctatcgacgaagacggcttcttgaccatcactggccgtaagaaggagatcatcgtcaccgccggcggaaagaatgttgcccccgcattattagaagatcagttgcgggctcacccgctgatcagccaggcgctggtcgtcggggacgccaagccgttcgtaggtgcgctaatcaccatcgaccccgaggccttcaatggttggaagcagcgcaacagcaaggcagccgacgcggcgataggcgaccttaccaccgaccccgacttggtggccgaggtggacgcggctgtcaaacaggccaacctgtcggtgtcacatgctgagtcgatccgcaaattccgcattttgccggttgatttcaccgagcagaccggcgaactgacgccgacgatgaaagtgaagcgcaatgtggtcgcccagaagttcgcctccgacattgaggcgatctacgaaaaggactag

SEQ ID NO: 13963 - protein, 600 aa, Mycobacterium leprae
MREFSVPTRFSVGEHDNIAAVVFEHERDDPNLVIYQRQIDGVWTDVTCAEAASQIRSAALGLIALGMQAGDRVSIFSATCFEWAILDLAILSVGAVTVPIYETSSAKQVRWILQDSDAVLVFAETDAHATMVNQLAGELPALRQVLQINSAGATALDQLAEAGASVDVAQLANRLKTLRAQDPATLIYTSGTTGRPKGCQLTHSNLLYEVRGAKECLPTLLQPGQRLLVFLPLAHVLARALTLSAFTYKMTVGFTSDIKNLLPMLAVFKPTVVVSVPRVFEKVYNTAEQNAANEGKSRIFAMAAQTAVEWSEASHRGGPGLLLRARHAVFDRLVYRKLRAALGGDCHASVSGGAPLGARLGHFYRGVGLTIHEGYGLTETSAAITLNQAGNVKVGTVGNLLPGNSMRIADDGELLVRGNVVFSGYWHNEQGTIEAFTEGWFKTGDLGAIDEDGFLTITGRKKEIIVTAGGKNVAPALLEDQLRAHPLISQALVVGDAKPFVGALITIDPEAFNGWKQRNSKAADAAIGDLTTDPDLVAEVDAAVKQANLSVSHAESIRKFRILPVDFTEQTGELTPTMKVKRNVVAQKFASDIEAIYEKD

SEQ ID NO: 13964 - DNA, 1410 bp, Listeria innocua
  CDS (1)..(1410)
atggacatgacaaactggcttcaaaaacgagtgcggctttctcctggagaaaccgcgcttgtttttgaaggaaaacaagaaacgtttgaagaaatatatgaagccgtagagaaacttgcgggtaaattattcgcgcgcggtattagaaaagacgagatggttgctttacttggaaaaaacgaccgaatgacttttttacttattcatgctttgcaacaacttggagctatcactttattccttaacaatcgtttaacgaaaaaagagattacttttcaattggcaaatgctgaggtaaaacaagtgattgtagcagatgcgtttgtggataaagtgacttctggaattagctacgaagagttacagcaaacgacatacgtggaacccgatttatgcaaaacatgggatttatcacgcacagcttcggttatgtatacttcaggaacaactggaaaaccaaaaggtgtaatgcaaacatatgaaaatcattggtggagcgctgtttcttcagttttaaatttaggtttaacggagaaagatagttggctttgcgctgtacctatttttcatatcagcggtttatcaattatgatgcgttccgttatttatggaattcccgtgtatttagaagagcatttcgatgaagaaaaaattacgcaattgcttgaaagtggtaaaatttctaccatctctgtagtgacttcgatgttagaacgattgttaaaaattcaaggcggaagctaccatccgaatgtgcgaactgttttgttaggtgggggaccagctaataaagctgttttggaaatttgtaaacaacgcgatattccattagtacagtcgtttggaatgactgaaacggcttcacaaattgtgacattgccaccaaaagatgccttaaacaaaattggctcctcaggtaaagcattatttcctgcagaagtaaaaattgctgacgatggcgaaattttactaaaaggaccttcaattacacctggatatttacacaatgaaaaagcaacggcaaaagcttttatagatggctggtttaaaacgggtgatattggttatttggatgaagaaggctttttatttgttttagagcggcgttctgatttaattatttctggtggcgaaaatatttatccgactgaaatagaacatgtgattggcgcttatgaggctgtggaagaagttgcggttgtaggtaagtcagatgctaaatggggcagtgttcctgttgcctttatcgttgtaaatgaaggatttgatgaaggggtattaaaagatatttgtcaaacgaacttggctagttttaaaatccctaagcaaataacgattgtggaacatctaccgaaaacagcttcaggcaaaattcagcgaaataaattaaaagaaagacactctaattaa

SEQ ID NO: 13965 - protein, 469 aa, Listeria innocua
MDMTNWLQKRVRLSPGETALVFEGKQETFEEIYEAVEKLAGKLFARGIRKDEMVALLGKNDRMTFLLIHALQQLGAITLFLNNRLTKKEITFQLANAEVKQVIVADAFVDKVTSGISYEELQQTTYVEPDLCKTWDLSRTASVMYTSGTTGKPKGVMQTYENHWWSAVSSVLNLGLTEKDSWLCAVPIFHISGLSIMMRSVIYGIPVYLEEHFDEEKITQLLESGKISTISVVTSMLERLLKIQGGSYHPNVRTVLLGGGPANKAVLEICKQRDIPLVQSFGMTETASQIVTLPPKDALNKIGSSGKALFPAEVKIADDGEILLKGPSITPGYLHNEKATAKAFIDGWFKTGDIGYLDEEGFLFVLERRSDLIISGGENIYPTEIEHVIGAYEAVEEVAVVGKSDAKWGSVPVAFIVVNEGFDEGVLKDICQTNLASFKIPKQITIVEHLPKTASGKIQRNKLKERHSN

SEQ ID NO: 13966 - DNA, 2052 bp, Nostoc sp. PCC 7120
  CDS (1)..(2052)
atggaaaagagatattctaacgtagtagcagaattaattaagaaaaaacaatttattccatttgaggtgtgctttatgactaacagtcaaccaggatattcattactatccgatattacaaaggaacaaagtaaagaaatacaacgcttagtagattatacaaatgtagagtctttaccagaaatttggccgatagctgggaagaaatttggtgagactttagctctttacaatccccatgctaaaccagaggtaaagattacttatcaacaactagcagacaaaatccagctatttgcttctggattacaagcattgggagttcaagcaggcgatcgcatctccctaatagctgataatagtcctcggtggttcattgccgatcaagggattatgacagccggtgcagtggatgcggtgcgtagttcccaagccgaaaaggaagaattactttatattgtcgctcatagtggcagcacagctttagttgtcgaagatttaaagacattcaataagctgcaagatagactccacgacctaccaattcaagtggtagtcatacttaccgacgaaacaccaccgacagaacaaagcctcaaagtattgaactttcttcagttaatcgaagttggtaaaaatcatacttttgtcccagtcaaacgcaaacgcaacgaactggcgacattaatttatacctctggaaccacgggaaaacccaaaggtgtaatgctcagttatagcaatctcttacatcaggtcacaaccttccgagtagtagtacaacccaaagtaggtgatacggctctcagcattttacctagttggcacagctacgaacggactgtggaatattatttattgtctcaaggttgcacacaaatttatacaaatttgcgctcagttaaagctgacctgaaacaatataaacccaactacatggttgctgtaccgcgtctgtgggaatcgatttatgaaggagtgcagaagcagttccgcgaacagccagcaaacaaacaacggctgattaagtttttattgggcatgagtgaaaaatatatcaaagcccaaagaattgctcaaggtacaagtttagatcatctccatgcttcatcgttggaacgattaatcgctaaggtactagaatttgcttttttacccttccatgttttaggacaaaagttagtgtatggcaaagtcaaggaagcaacaggaggaagatttaaacaagtaattagcggtggcggtgcattaccaaaacacatcgacacattttttgaaattattggcgtgcagattttgcaaggttatggtttaaccgaaacatccccagtcaccaacgtgcgccgtccctggcgtaattttatcgggacatccggacaaccaattcccggcacagaagttaaaatcgtagaccctgagactcgccagcctttacctgttggaaaacgaggcttggtgttattgaaagggccacaagtcatgcaaggctattaccaaaacccagaagcaactgcaaaagccattgatcctcaaggttggtttgatagcggtgacttgggttgggtaacaccagataatgaacttgtgctaactggcagagcaaaagatacgattgttttgtccaatggggaaaatatcgaaccgcagccaattgaggatgcttgtttgcgatcgccctacattgatcagattatgctagtgggacaagaccaacgtagcatcggtgctttaattgtccccaacgtggaagctttggcaaagtgggcagaaagccagaatctcgtcttgagtgtagaggatgataatttaacctcctcatccagtcaaaaaattaacctggagagtaaaatgatccagggtttatttcggcaagaattgaatcgggaagtgcagaaccgtccaggttatcgcccagatgaccgtgttgggccgtttaaactgattctggagccattttccattgaaaacggcttaatgacacaaacgctgaaactccggcgacacgttgtcacagaacgctaccgcgatattatcaacgccatgtttgcctga

SEQ ID NO: 13967 - protein, 683 aa, Nostoc sp. PCC 7120
MEKRYSNVVAELIKKKQFIPFEVCFMTNSQPGYSLLSDITKEQSKEIQRLVDYTNVESLPEIWPIAGKKFGETLALYNPHAKPEVKITYQQLADKIQLFASGLQALGVQAGDRISLIADNSPRWFIADQGIMTAGAVDAVRSSQAEKEELLYIVAHSGSTALVVEDLKTFNKLQDRLHDLPIQVVVILTDETPPTEQSLKVLNFLQLIEVGKNHTFVPVKRKRNELATLIYTSGTTGKPKGVMLSYSNLLHQVTTFRVVVQPKVGDTALSILPSWHSYERTVEYYLLSQGCTQIYTNLRSVKADLKQYKPNYMVAVPRLWESIYEGVQKQFREQPANKQRLIKFLLGMSEKYIKAQRIAQGTSLDHLHASSLERLIAKVLEFAFLPFHVLGQKLVYGKVKEATGGRFKQVISGGGALPKHIDTFFEIIGVQILQGYGLTETSPVTNVRRPWRNFIGTSGQPIPGTEVKIVDPETRQPLPVGKRGLVLLKGPQVMQGYYQNPEATAKAIDPQGWFDSGDLGWVTPDNELVLTGRAKDTIVLSNGENIEPQPIEDACLRSPYIDQIMLVGQDQRSIGALIVPNVEALAKWAESQNLVLSVEDDNLTSSSSQKINLESKMIQGLFRQELNREVQNRPGYRPDDRVGPFKLILEPFSIENGLMTQTLKLRRHVVTERYRDIINAMFA

SEQ ID NO: 13968 - DNA, 1410 bp, Listeria monocytogenes
  CDS (1)..(1410)
atggacatgacaaactggcttcaaaaacgagtgcggctttctcctaaagagaccgcactcgtttttgaaggaaaagaagaaacatttgaagaaataagtgaagcagtagagcgacttgcgggtaaattattcgcattaggcattagaaaagacgagatgattgcattgcttggaaagaatgatcggatgacgtttttgctcattcatgcgctgcaacaactcggtgcggtcactttatttctgaataatcgtttgacgaaaaaagagatagcatatcaacttgcgaacgctgaagtaaaacaagtgattgtggcggatacttttgaagataaggtaggggctggaataagttattctgaattagcggaaacagattataaagagccagaattacttgaaacttgggatttatcacgcacagcttccattatgtatacgtcagggaccacgggtaagccaaaaggtgtcatacagacttatgagaatcactggtggagcgcagttgcctctgtgctaaatttaggtttaacagagaaagatagctggctctgtgctgttccgattttccatattagcggcttatcgattatgatgcgttcggtgatttacggaattcccgtatatttggaagagcatttcgatgaagaaaaaatcacgcaattgcttgaaagtggtaaagtttccacgatatcggttgtgacttctatgttggaacgattgttgaaaatacatggtggcagttatcatccgaatgtacgaaccattttgctgggcggcggacctgctagtaaaaccgttttggaaatttgcaaacagcgtgacattcccttagtgcagtcatttggtatgacagaaacagcttcacaaatcgttactttgccaccgaaagatgccttaaataaaatcggatcttctggtaaagcgttatttccagcagaagtgaaaattgcggatgacggagaaattttgctaaaagggccctccattacacctggatatttacacaataaaaaagcgacggaagcttcatttgtggatggttggtttaaaactggtgatattggctatttggatgaagaaggctttttatttgttgtagagcgtcgttctgacttgattatttcaggaggcgagaatatatatccaactgaaattgaacatgttattggcgaatatgtagccgtgaaggaagttgctgttattggtcagcctgacgataaatggggtagtgttcccgttgcttttatcgttgcggaagaaacatttgatgaagatgaattacagcttatctgccaaacaaacttggctagttataaaatccctaaacaaataatcatcgtcgagaaactacccaaaacagcatctggcaaaattcaacgcaataaactaaaagaaaggcactctaagtaa

SEQ ID NO: 13969 - protein, 469 aa, Listeria monocytogenes
MDMTNWLQKRVRLSPKETALVFEGKEETFEEISEAVERLAGKLFALGIRKDEMIALLGKNDRMTFLLIHALQQLGAVTLFLNNRLTKKEIAYQLANAEVKQVIVADTFEDKVGAGISYSELAETDYKEPELLETWDLSRTASIMYTSGTTGKPKGVIQTYENHWWSAVASVLNLGLTEKDSWLCAVPIFHISGLSIMMRSVIYGIPVYLEEHFDEEKITQLLESGKVSTISVVTSMLERLLKIHGGSYHPNVRTILLGGGPASKTVLEICKQRDIPLVQSFGMTETASQIVTLPPKDALNKIGSSGKALFPAEVKIADDGEILLKGPSITPGYLHNKKATEASFVDGWFKTGDIGYLDEEGFLFVVERRSDLIISGGENIYPTEIEHVIGEYVAVKEVAVIGQPDDKWGSVPVAFIVAEETFDEDELQLICQTNLASYKIPKQIIIVEKLPKTASGKIQRNKLKERHSK

SEQ ID NO: 13970 - DNA, 2086 bp, Saccharomyces cerevisiae
  CDS (1)..(2085)
atgtccgaacaacactctgtcgcagtcggtaaagctgctaatgagcacgagactgcccctaggagaaatgttagagtcaagaagcggcccttaattagaccattgaactcgtcagcatctacgctgtatgaatttgccctagagtgtttcaacaagggtggaaaacgagatggtatggcttggagagatgtcatcgagattcatgagacaaagaaaaccattgtgagaaaggtagacggcaaggataaatctatagaaaagacatggctgtattatgaaatgtcaccatataaaatgatgacctaccaggaactgatctgggtgatgcacgatatgggccgtgggctggcaaaaataggcatcaagcccaatggagaacacaaattccacatcttcgcatctacttcccataaatggatgaagattttccttggttgcatatcccagggtatccccgtagtaaccgcgtatgatactttgggtgagagcggtttgattcactccatggttgaaaccgagtctgctgctattttcactgataatcaattattggctaaaatgatagtgcctttgcaatctgctaaagatatcaaatttcttatccataacgaacctatcgaccccaatgacagaagacaaaacggcaaactttacaaggctgctaaggatgccattaataagatcagagaagttaggccagacataaaaatttatagttttgaagaagttgtcaagataggtaaaaaaagtaaagatgaggtcaaacttcatccacctgagccaaaagatttggcttgtatcatgtacacctcgggctcgatcagtgcaccaaaaggtgtagtattgactcattataatattgtttcgggtatcgctggtgtaggtcacaacgtctttggatggatcggctctacagaccgtgttttgtcgttcttgccattggctcatatttttgaactggtctttgaattcgaagccttttactggaacggtattcttgggtacggtagtgttaagactttgactaatacttcgactcgtaattgtaagggtgacctggttgagtttaagcctactattatgatcggtgtggctgccgtttgggaaactgtgagaaaagctattttggaaaagatcagcgatttaactcccgtactccaaaagattttttggtctgcctatagtatgaaagaaaagagtgtaccatgcaccgggtttttaagtcgtatggtcttcaagaaagtcagacaagccaccggtggtcatcttaagtatattatgaacggtgggtctgcgatcagtattgatgctcagaaattcttttctatcgtcctgtgtcctatgattatcggttacggccttactgaaacagttgcgaatgcttgtgttttggagcctgatcatttcgaatatggtatagttggtgatcttgttggatcggtcactgccaaattggtggatgttaaggacctaggttattatgcaaaaaacaatcaaggtgaattgcttctaaagggtgcgccggtctgttctgaatattataagaatccaatagaaacggcggtctctttcacttacgatggatggtttcgtactggtgatattgttgaatggactcccaagggacaacttaaaattattgatagaagaaagaatttggttaaaaccctaaatggtgaatatattgcattagaaaagttagaatctgtttacaggtcaaactcctatgtgaaaaatatctgtgtttatgccgatgaaagtagggttaaaccggtgggtattgtggtacccaacccaggacccctatctaaatttgctgtcaaattgcgtattatgaaaaagggtgaagacatcgaaaactatatccatgacaaagcattacgaaatgctgttttcaaagagatgatcgcaacagccaaatctcaaggtttggttggtattgaactattatgtggtattgttttctttgatgaagaatggacacctgaaaatggctttgtcacatctgctcaaaaattaaagagaagagaaatcttagccgctgttaaatcagaagtcgaaagggtttacaaagaaaattcttagc

SEQ ID NO: 13971 - protein, 694 aa, Saccharomyces cerevisiae
MSEQHSVAVGKAANEHETAPRRNVRVKKRPLIRPLNSSASTLYEFALECFNKGGKRDGMAWRDVIEIHETKKTIVRKVDGKDKSIEKTWLYYEMSPYKMMTYQELIWVMHDMGRGLAKIGIKPNGEHKFHIFASTSHKWMKIFLGCISQGIPVVTAYDTLGESGLIHSMVETESAAIFTDNQLLAKMIVPLQSAKDIKFLIHNEPIDPNDRRQNGKLYKAAKDAINKIREVRPDIKIYSFEEVVKIGKKSKDEVKLHPPEPKDLACIMYTSGSISAPKGVVLTHYNIVSGIAGVGHNVFGWIGSTDRVLSFLPLAHIFELVFEFEAFYWNGILGYGSVKTLTNTSTRNCKGDLVEFKPTIMIGVAAVWETVRKAILEKISDLTPVLQKIFWSAYSMKEKSVPCTGFLSRMVFKKVRQATGGHLKYIMNGGSAISIDAQKFFSIVLCPMIIGYGLTETVANACVLEPDHFEYGIVGDLVGSVTAKLVDVKDLGYYAKNNQGELLLKGAPVCSEYYKNPIETAVSFTYDGWFRTGDIVEWTPKGQLKIIDRRKNLVKTLNGEYIALEKLESVYRSNSYVKNICVYADESRVKPVGIVVPNPGPLSKFAVKLRIMKKGEDIENYIHDKALRNAVFKEMIATAKSQGLVGIELLCGIVFFDEEWTPENGFVTSAQKLKRREILAAVKSEVERVYKENS

SEQ ID NO: 13972 - DNA, 1689 bp, Pseudomonas aeruginosa
  CDS (1)..(1689)
atgatcgaaaacttctggaaggacaagtacccagcgggtattgctgccgagatcaatcccgaccagtacccgaacatcctgtcggtactgaaggagtcctgccaacgttttgccaccaagcccgcgttcaccaacctgggcaagaccctgacctacggcgagctgtacaagctgtccggcgacttcgccgcctacctgcagcagcacaccgatctcaagcccggcgaccgcatcgccgtccagttgcccaacgtcctgcaatacccgatcgtggtcttcggcgccatgcgcgccggcctcatcgtggtcaacaccaacccgctgtacaccgcgcgcgaactggaacaccagttcaacgactccggcgccaaggcggtggtctgcctggccaacatggcccacctggtcgagggcgtactgccgaagaccggcgtcaagcaggtgatcgtcaccgaagtcggcgacatcctgccgccgctgaagcgcttcatcgtcaacttcgtggtcaagcacatcaagaagatggtgccggcctacagcctgccgcaagccaccaagctgaccgacgcgctggccaggggcgccggcaagtcgttccaggaagccgcgccgcaggccgacgacgtcgccgtgctgcaatacaccggcggcaccaccggggtcgccaagggcgccatgctgacccaccgcaacctggtggccaacatgttgcagtgcaaggcgctgatgggcgccaacctcaacgagggctgcgagatcctcatcgcgccgctgccgctgtaccacatctatgccttcaccttccattgcatggcgatgatgctcaccggcaaccacaacatcctgatcaccaacccgcgcgacctgccgtcgatgctcaaggacctcggccagtggaagttcaccggcttcgtcggcctgaacaccctgttcgtcgccctgtgcaacaacgaaaccttccgcaagctggacttctccgcgctgaagctgaccctctccggcggcatggcgctgcaactggccaccgcggagcgctggaaggaagtcaccggctgcgccatctgcgaaggctacggcatgaccgagaccgcgccggtggtatcggtcaacccgttccagaacatccaggtcggcaccatcggtatcccggtgccctcgaccctgtgcaaggtgattggcgacgacggccaggaagtgcccctgggcgagcgcggcgaactctgcgtgaagggtccgcaggtgatgaagggctactggcagcgccaggaggccaccgacgagatcctcgacgccgatggttggctgaagaccggcgatatcgccatcatccaggaagacggctacatgcgcatcgtcgaccggaagaaggacatgatcctggtctccggcttcaatgtgtatccgaacgaactggaagacgtgctggcgaccctgccgggcgtcctgcagtgcgccgcgatcggcatccccgacgagaagtccggcgagtcgatcaaggtcttcgtggtggtcaagccgggggcgaccctgaccaaggaacaggtcatgcagcacatgcatgacaacctgaccggctacaagcggccgaaggccgtggagttccgcgacagcctgccgaccaccaacgtcggcaagatcctgcgccgcgaactgcgcgacgaagagctgaagaaagcgggccagaagtaa

SEQ ID NO: 13973 - protein, 562 aa, Pseudomonas aeruginosa
MIENFWKDKYPAGIAAEINPDQYPNILSVLKESCQRFATKPAFTNLGKTLTYGELYKLSGDFAAYLQQHTDLKPGDRIAVQLPNVLQYPIVVFGAMRAGLIVVNTNPLYTARELEHQFNDSGAKAVVCLANMAHLVEGVLPKTGVKQVIVTEVGDILPPLKRFIVNFVVKHIKKMVPAYSLPQATKLTDALARGAGKSFQEAAPQADDVAVLQYTGGTTGVAKGAMLTHRNLVANMLQCKALMGANLNEGCEILIAPLPLYHIYAFTFHCMAMMLTGNHNILITNPRDLPSMLKDLGQWKFTGFVGLNTLFVALCNNETFRKLDFSALKLTLSGGMALQLATAERWKEVTGCAICEGYGMTETAPVVSVNPFQNIQVGTIGIPVPSTLCKVIGDDGQEVPLGERGELCVKGPQVMKGYWQRQEATDEILDADGWLKTGDIAIIQEDGYMRIVDRKKDMILVSGFNVYPNELEDVLATLPGVLQCAAIGIPDEKSGESIKVFVVVKPGATLTKEQVMQHMHDNLTGYKRPKAVEFRDSLPTTNVGKILRRELRDEELKKAGQK

SEQ ID NO: 13974 - DNA, 1593 bp, Caulobacter crescentus
  CDS (1)..(1593)
atgtccgacgcgatcgacttcgaccgcatgaacaccctgggcgacgtgccgcgctatcacgccgaggcgcggcccgatgcggtggccttcagcttcgaggggcgcgagacgaccttcgcgcagctcgaccggcataccaaccaggtggccaacgccctgctggcggccggcctgtcgaccggcgaccgcatcgcctatgtcggcaagaacagcgaccactatttcgagctcctgctcggcgccgccaaggcgggcgtggtaaccacgccgatcggctggcgcctggccgcgcccgagatcgcctatatcgtcggcgacagcgaggccaagctggtctttgtcggccgcgagctgatcggccatgtcgacgcggtcgccgccgaactgacccatcgtcccgtggtcatcgccatggaggccgagggcgccggcgactatcaaaccttcgaaggctggcgcgacgcggccagcgatgtcgacccgcacaagccgatccagatctcggacatcgccatccagctctacacctcgggcacgaccggacgtcccaagggcgcgatgctgacccatcacaacctgctcggcatgcgccgcgaggcggccaagaaccctttggaatggaaccagtggggccctagcgacgtcagcctggtggccatgccggtggcccatatcggcggcaccggctggggtctggtggggctgatcaacggcgccaagggcgtggtcgcccgcgagtttgatccgaccaaggtcctggacttcatcgagaaggatcgcatctccaagatgttcatggtgccggcggcgctgcagatcgtggtgcggctgcccagggcgcgcgaggtcgactattcgcgcctgacccacatcctgtatggcgccgcgcccattccgctggacttgctgcgcgagtgcatggaggtgttcggctgcggcttcgtccagcagtacggcatgaccgaaacgacggggacggtggtgtatctgccgccggaggaccacgatccggccggcaacaagcgcatgcgcgctgcgggtctgccgatgcccggcgtggagctgaagatcatcgatgaagccggcaagagcctgccgcccaatacggtgggcgaggtggccgtgcggtccagcgccaacatggccggctactggaagctggacgaggccacggccaagaccatggacgccgacggctggctgcgcaccggcgacgccggctatctggacgaggacggctatctgttcatccacgaccgggtgaaggacatgatcatctccggcggcgagaacatctatcccgccgaggtcgagagcgccgtctatggccacccgcacgtggccgaggtggcggtgatcggcgtgcctgatgacaagtggggcgaggccgtcaaggcggtggtcgcgcccaagcccggcgtcacgcccgacgccgacgacatcatcgccttcgcccgcacccgcatcgcccacttcaaggcgcccaagagcgtggacttcatcccggccctgccgcgcaacgcgtcggggaagatcctgcggcgggagctgcgggcgccgtattgggaggggcgtgagcggcaggtgaattag

SEQ ID NO: 13975 - protein, 530 aa, Caulobacter crescentus
MSDAIDFDRMNTLGDVPRYHAEARPDAVAFSFEGRETTFAQLDRHTNQVANALLAAGLSTGDRIAYVGKNSDHYFELLLGAAKAGVVTTPIGWRLAAPEIAYIVGDSEAKLVFVGRELIGHVDAVAAELTHRPVVIAMEAEGAGDYQTFEGWRDAASDVDPHKPIQISDIAIQLYTSGTTGRPKGAMLTHHNLLGMRREAAKNPLEWNQWGPSDVSLVAMPVAHIGGTGWGLVGLINGAKGVVAREFDPTKVLDFIEKDRISKMFMVPAALQIVVRLPRAREVDYSRLTHILYGAAPIPLDLLRECMEVFGCGFVQQYGMTETTGTVVYLPPEDHDPAGNKRMRAAGLPMPGVELKIIDEAGKSLPPNTVGEVAVRSSANMAGYWKLDEATAKTMDADGWLRTGDAGYLDEDGYLFIHDRVKDMIISGGENIYPAEVESAVYGHPHVAEVAVIGVPDDKWGEAVKAVVAPKPGVTPDADDIIAFARTRIAHFKAPKSVDFIPALPRNASGKILRRELRAPYWEGRERQVN

SEQ ID NO: 13976 - DNA, 1629 bp, Arabidopsis thaliana (mouse-ear cress)
  CDS (1)..(1629)
atggagagtcaaaagcaagaagataatgaatacattttccgcagtttgtatccatctgtgcccattcctgacaaacttacactgcctgaatttgtgctccaaggagttgaagaatacacagagaatgtagcgtttgtagaagcggtgaccggaaaagctgtgacgtacggtgatgtagtgagggacacaaagaggctagccaaagcgttgacatctctcggactaaggaaaggtcaagtgatggttgtggtcctaccaaacgtcgccgagtatgggattattgcccttggtattatgtctgccggtggagtcttctccggtgcaaatccgacggctcttgtttccgagatcaagaagcaagttgaagcttccggtgctagaggaatcatcactgatgctactaactatgaaaaggtgaaatcactaggtttaccggtgatagtgttaggtgaagagaagatagaaggagcagtaaactggaaagatcttctagaagcaggagacaaatgcggagataccgacaatgaagagattcttcagacagatctttgtgcacttcctttttcttcaggaacaacaggattacaaaaaggagtaatgctcacacatcgcaatctcatagccaatctttgctctactctcttcggtgtcaggtctgaaatgatcggtcagatcgtgacgcttggtttgatcccattctttcatatttacggtatcgttggcatatgttgtgctacaatgaagaataaaggcaaagttgttgctatgagtcggtacgatctaaggattttcttgaatgctttgattgctcatgaggtttcgtttgcgcctatagttccgccgattatattgaatcttgttaagaatccgatagttgatgagtttgatctttcgaagcttaaacttcagtctgtcatgactgctgctgctcctttagctcctgagcttcttactgccttcgaagccaagtttcctaatgtccaagtccaagaggcttatggattaacggagcatagttgcattacgttaactcacggagatccagagaaaggacaaggaatcgcgaaacgaaactcggttggtttcatacttccgaatctcgaggtaaagttcatagatcctgacaccggtagatcactcccgaagaacacttctggtgagctatgtgtgaggagccaatgtgtaatgcaaggttacttcatgaacaaggaagagactgacaagacaattgatgaacaaggttggcttcacacaggagacataggttacatcgatgatgatggagacatcttcatcgttgatcgtatcaaagaacttattaaatacaaaggttttcaggttgctccggccgagcttgaagctattctactcactcatccatccgttgaagacgttgccgtcgtgccgttaccggacgaggaagccggggagattccggcggcttgcgtggtgataaatccgaaagcgacagaaaaggaagaagacattctcaactttgttgcagcaaatgtggctcattacaagaaggttagagccgtccattttgtggattcaatccctaaatctctctctggtaaaatcatgaggaggcttcttagagacaagatcctcagcatcaacaagaagtag

SEQ ID NO: 13977 - protein, 542 aa, Arabidopsis thaliana (mouse-ear cress)
MESQKQEDNEYIFRSLYPSVPIPDKLTLPEFVLQGVEEYTENVAFVEAVTGKAVTYGDVVRDTKRLAKALTSLGLRKGQVMVVVLPNVAEYGIIALGIMSAGGVFSGANPTALVSEIKKQVEASGARGIITDATNYEKVKSLGLPVIVLGEEKIEGAVNWKDLLEAGDKCGDTDNEEILQTDLCALPFSSGTTGLQKGVMLTHRNLIANLCSTLFGVRSEMIGQIVTLGLIPFFHIYGIVGICCATMKNKGKVVAMSRYDLRIFLNALIAHEVSFAPIVPPIILNLVKNPIVDEFDLSKLKLQSVMTAAAPLAPELLTAFEAKFPNVQVQEAYGLTEHSCITLTHGDPEKGQGIAKRNSVGFILPNLEVKFIDPDTGRSLPKNTSGELCVRSQCVMQGYFMNKEETDKTIDEQGWLHTGDIGYIDDDGDIFIVDRIKELIKYKGFQVAPAELEAILLTHPSVEDVAVVPLPDEEAGEIPAACVVINPKATEKEEDILNFVAANVAHYKKVRAVHFVDSIPKSLSGKIMRRLLRDKILSINKK

SEQ ID NO: 13978 - DNA, 2029 bp, Arabidopsis thaliana (mouse-ear cress)
  CDS (1)..(1998)
atggcgactggtcgatacatcgttgaggttgagaagggaaagcaaggcgttgatggaggaagtccatcggtcggtccagtgtaccggagtatctatgctaaagacggttttcctgaaccgcctgatgatctcgtcagtgcatgggatattttccgtttatctgtggagaaatctccaaataatcctatgcttggtcgtagagaaatagttgatggaaaagctgggaaatatgtatggcaaacttacaaagaagtacataatgtagtgattaagcttggaaactctatcagaactattggagttggaaaaggagataaatgcggtatttatggcgccaatagtcctgaatggattataagcatggaggcttgcaatgctcatggactctactgtgtacctttatatgacactctaggtgctggagcaatagaattcatcatttgtcatgcggaggtctcacttgcttttgctgaggagaacaagatttctgagttattgaagacagctccaaaatcaactaaatatttgaagtatattgtgagctttggtgaggttacaaataatcagagagtagaagctgagaggcacagattaacaatatattcatgggaccaattcttgaagctaggcgagggtaaacattatgaattaccagagaagaggagaagcgatgtttgcaccataatgtatacaagtggcacaactggtgatcctaaaggagtattgcttacaaatgagagcattattcatctccttgaaggtgttaaaaaattgcttaaaactattgatgaagagttaaccagtaaagatgtatatctctcatatctacctctggctcatatcttcgatcgtgtgattgaggagctgtgtatttatgaagcagcctctatcggattctggcgaggggatgttaagatattgatagaagacattgctgcattgaaaccgactgttttctgcgctgttcctcgcgttctagagagaatatacaccggtcttcagcagaaactttctgatggtggttttgtaaagaagaaattattcaactttgcattcaaatacaaacataaaaacatggagaaagggcagcctcatgaacaagcatctccaatagctgacaaaattgtatttaaaaaggtaaaagaagggttgggaggaaacgtgcgtcttatcctctcaggagcagctcctcttgcagctcacatcgaatctttccttcgagttgtcgcgtgtgctcatgttttgcaaggatacggtctaacagagagttgtggtgggacttttgtgtccattccaaacgagctttcaatgcttggaacggttggtccaccggttccaaacgttgacataaggctagagtcagttccagagatgggttatgacgctcttgcaagcaatccacgtggagagatttgcatcaggggaaagactttgttctctggatactacaaacgtgaagatctcactcaagaagtcttcattgatggatggcttcacactggtgatgtcggtgagtggcaaccagatggagccatgaagatcatcgaccgtaagaagaacatctttaaactgtctcaaggagaatacgttgccgttgagaacttggagaacatatacagtcatgtcgccgccattgaatcgatatgggtatatggaaacagctatgagtcttacttagtggctgtggtatgtccaagcaagatccagatcgagcattgggccaaagaacacaaagtttcaggagactttgagtctatctgccgaaaccaaaagactaaagagtttgtccttggagagttcaacagagtagccaaagacaaaaagctgaagggatttgagctgatcaaaggtgttcatttggacacagtcccgttcgacatggaaagagatctcatcactccttcttacaagatgaaaagacctcagcttctcaagtactatcagaaagagattgatgaaatgtataagaaaaacagagaagtgcagctacgagtgtaaagaaaggaagttgttggacaaatctctcagg

SEQ ID NO: 13979 - protein, 665 aa, Arabidopsis thaliana (mouse-ear cress)
MATGRYIVEVEKGKQGVDGGSPSVGPVYRSIYAKDGFPEPPDDLVSAWDIFRLSVEKSPNNPMLGRREIVDGKAGKYVWQTYKEVHNVVIKLGNSIRTIGVGKGDKCGIYGANSPEWIISMEACNAHGLYCVPLYDTLGAGAIEFIICHAEVSLAFAEENKISELLKTAPKSTKYLKYIVSFGEVTNNQRVEAERHRLTIYSWDQFLKLGEGKHYELPEKRRSDVCTIMYTSGTTGDPKGVLLTNESIIHLLEGVKKLLKTIDEELTSKDVYLSYLPLAHIFDRVIEELCIYEAASIGFWRGDVKILIEDIAALKPTVFCAVPRVLERIYTGLQQKLSDGGFVKKKLFNFAFKYKHKNMEKGQPHEQASPIADKIVFKKVKEGLGGNVRLILSGAAPLAAHIESFLRVVACAHVLQGYGLTESCGGTFVSIPNELSMLGTVGPPVPNVDIRLESVPEMGYDALASNPRGEICIRGKTLFSGYYKREDLTQEVFIDGWLHTGDVGEWQPDGAMKIIDRKKNIFKLSQGEYVAVENLENIYSHVAAIESIWVYGNSYESYLVAVVCPSKIQIEHWAKEHKVSGDFESICRNQKTKEFVLGEFNRVAKDKKLKGFELIKGVHLDTVPFDMERDLITPSYKMKRPQLLKYYQKEIDEMYKKNREVQLRV

SEQ ID NO: 13980 - DNA, 1971 bp, Treponema pallidum subsp. pallidum (syphilis spirochete)
  CDS (1)..(1971)
atgagtgtgtgttgtacgtcctccgaagagcggattgaacggagcaagaatctcgttcaccttgtcgcgcaggttgctggtgcgtacgcgcagctgcctgctcagtatgctaaaagtagctcaggagtctttgaaattacttctttttcctcgttttacgagcatgtttgcctgtttgccgcgggtctggccagcattgggtgtggtcgtggtgattgcattggtttgatttccgacaatcgggttgagtggctccacgcgagctttggtattcaggcgcttggtgcagcagacgtcccgcgtggctctgacgctaccgagcgtgatcttgtgcagattctcggtgcggtagaggcacgcaccgtaattgtggagaatgacgcgcagttgaaaaaactcgcgcggtgttttgatgcgttgccgagcgtgtcgcagatcgtgttgttggatgcgggcggtgcgtaccaggcgatgaaggatgagtttgtccagaatgaggacggttctgcgcggaagtgctcttttttcacctaccaggacatactcgcgcatgggacacagtttcgggtgcaccatccaggcaggatagaggatgagattgggcgtaccacgcgcgcggacgttgctactattattttcacatccggtaccacgggcaccccgaagggagtggtgctttcgcacgagaattttctttgtcagttaatcgatatctcccgcaggctgaccgtgtgtccgggggatatcgcgttgtcagtgttgcctgtgtggcacgtttttgagcgaattagcgagtatgtggtactgtcccacgcagggggcgttgcttactccaagccggtagggtcggtgatgcttgcggatttggcaaagcttaatcctcactttttgccttctgtgcctcgcatctgggaggccattcacgatggcattttcaagaatgtgcgtaagaaagggggtgttgctgcagcacttttccatttctttttggcagcaggcaaagcgtacgcttacttttaccgcagcgtgtttgggctgcgtacgcataccacgcgtcgtgcgcagttttgtgcgccgctgtttgcctgtgtgccgtggctccttttagttcctctgcactttcttggaaatgtcttggtgttccgcaaggtacggaagaagtttggtacctcctttaagactgctatctcaggggggggcgcgcttcctccaaatgtggatgagtttttgtacgctattggcgtgagagtgcttgaggggtacggtctgacggaaacggcgccggtaattgccatgcgcagtgagcgcaggccagtgttcggttccgtgggtacaccctgcgcgtacaatgaagtgaagattgtggatgacactggcgcccagcttccggtggggtataaggggatagtgcttgtacgcggcaaaaatataatgcaggggtactataaaaatcctgagcttaccgcgcaggtgttagatgcagacggttggtttaatacgggggatattggctaccgctgcgtgggtggacagattgtgttacggggacgtaagaaggatacggttgtgctgcgtggtggagagaacgtggagccagttcccctcgaaatgagtatgcaggagtcccgttttattgcgcgtgcagtggtagtcgggcaagatgagcggtatttggcggcgttgatagttccggacgaggcagagctgcggctgtgggcagaggcgcaggaactccgcacagagtgcatggaagaattgctagtaaatcctgcagtggtgaagtttttcgagcaggaaatagcaaagcggatatcactcgagaacgggtttaagatattcgagcggattaaccgttttgtgcttctgccgaaggtctttgaagtgggagtggagctttccgcaaagcaggaggtaatgcgccaccgggtcgccgacctgtacgcaaaggagatcgcgcagctcttttcctag

SEQ ID NO: 13981 - protein, 656 aa, Treponema pallidum subsp. pallidum (syphilis spirochete)
MSVCCTSSEERIERSKNLVHLVAQVAGAYAQLPAQYAKSSSGVFEITSFSSFYEHVCLFAAGLASIGCGRGDCIGLISDNRVEWLHASFGIQALGAADVPRGSDATERDLVQILGAVEARTVIVENDAQLKKLARCFDALPSVSQIVLLDAGGAYQAMKDEFVQNEDGSARKCSFFTYQDILAHGTQFRVHHPGRIEDEIGRTTRADVATIIFTSGTTGTPKGVVLSHENFLCQLIDISRRLTVCPGDIALSVLPVWHVFERISEYVVLSHAGGVAYSKPVGSVMLADLAKLNPHFLPSVPRIWEAIHDGIFKNVRKKGGVAAALFHFFLAAGKAYAYFYRSVFGLRTHTTRRAQFCAPLFACVPWLLLVPLHFLGNVLVFRKVRKKFGTSFKTAISGGGALPPNVDEFLYAIGVRVLEGYGLTETAPVIAMRSERRPVFGSVGTPCAYNEVKIVDDTGAQLPVGYKGIVLVRGKNIMQGYYKNPELTAQVLDADGWFNTGDIGYRCVGGQIVLRGRKKDTVVLRGGENVEPVPLEMSMQESRFIARAVVVGQDERYLAALIVPDEAELRLWAEAQELRTECMEELLVNPAVVKFFEQEIAKRISLENGFKIFERINRFVLLPKVFEVGVELSAKQEVMRHRVADLYAKEIAQLFS

SEQ ID NO: 13982 - DNA, 1641 bp, Bacillus halodurans
  CDS (1)..(1641)
atgtcagagcgattacaagtaaccgttggagcgttgttagaaaaggtggctaaaagacaaccgacccatgaggcgcttgtttacccagaccgagggttacgctattcatatgaccagtttcttagcaaatgccaacaagcagcaaaaggattgatgaagctaggcattgaacggggagagcatgtcgccatatgggcaacgaatgtgcctgaatgggtgatcacccaatttgcgacgggaacaatgggagccgttctcgtgacagttaatacgaattatcgaacgagtgagctcgaatacttgttgaagcagtcagacgctacgactctccttttaattgacggctatcgcgatgcatcatatgtagaaatgctttatgaaattctcccagaacttaaaacgtcagagccaggggcgtgttattcgaaaaaactgcctcatctgagacgcgtcattcatttaggggaagagcgatatccaggaatgtatacgtgggaggatgtgctgaacctagggaccgaggtaaccaatgacgagttggctgagcggagcgcctccctggaccctgatgatgtgataaatatgcaatatacgtctgggacgacgggatttcctaaaggagtcatgctcacacacaacaacatcgtcaacaatgcccgaaacattgccgaatgtatgaagctgacgaacgaagatcggctctgcattccagttccgttttttcattgctttggctgtgtccttggcacgctcgcatgtgtgtcggttggcgccacgatggtaccagttcaagagtttaatcctacacgtgtgctgcaagcggttgaagcggaaaaatgcaccggattacatggggtaccgacaatgtttattgcagaattaaacgacgaagattttatgaactataatttatcccatttgcggacaggaattatggcgggttcgaattgtccaattgaagtgatgaaagccgctatcgaaaaaatggggatgtctgatattacgattgcttacgggcagacggaaacgtcaccagtaataacccagacacgggttgatgatccgatcgaactccgcgtgcaaaccgtaggccgtcccttaccgaatgtagaagtgaaaattgtggagcctggcacagaaaaggaagtggcaccaggggtccaaggggaattgtgcacccgaggctatcatgtgatgaaaggctactataaaaaccaacaagctacgcgagaagtgatcaaagaagatggctggcttcatacaggggatttagccgttatggacgaggctggctattgccgaattactggcaggttaaaagatatgattattcgcggtggggaaaacatttacccaagggaaattgaagagttcttataccagcatcctgatattctcgatgcccaagtggtcggagtccctgacgaaaaatacggggaagcagtatcggcatggattaaattgaagcctggtgtgagcgtgacgtcagaagaaattcgtgatttttgccaagggaaggtggctcattacaaaatcccacgctatatagaatttgttgatgattatccgatgacagcttctgggaaagttcaaaaatttaaattgcgacaaatggcagaacagatttttcaaaaagggtga

SEQ ID NO: 13983 - protein, 546 aa, Bacillus halodurans
MSERLQVTVGALLEKVAKRQPTHEALVYPDRGLRYSYDQFLSKCQQAAKGLMKLGIERGEHVAIWATNVPEWVITQFATGTMGAVLVTVNTNYRTSELEYLLKQSDATTLLLIDGYRDASYVEMLYEILPELKTSEPGACYSKKLPHLRRVIHLGEERYPGMYTWEDVLNLGTEVTNDELAERSASLDPDDVINMQYTSGTTGFPKGVMLTHNNIVNNARNIAECMKLTNEDRLCIPVPFFHCFGCVLGTLACVSVGATMVPVQEFNPTRVLQAVEAEKCTGLHGVPTMFIAELNDEDFMNYNLSHLRTGIMAGSNCPIEVMKAAIEKMGMSDITIAYGQTETSPVITQTRVDDPIELRVQTVGRPLPNVEVKIVEPGTEKEVAPGVQGELCTRGYHVMKGYYKNQQATREVIKEDGWLHTGDLAVMDEAGYCRITGRLKDMIIRGGENIYPREIEEFLYQHPDILDAQVVGVPDEKYGEAVSAWIKLKPGVSVTSEEIRDFCQGKVAHYKIPRYIEFVDDYPMTASGKVQKFKLRQMAEQIFQKG

SEQ ID NO: 13984 - DNA, 1713 bp, Agrobacterium tumefaciens
  CDS (1)..(1713)
atgagtgaattgtccctgggacatccggaaaatgtcagcgttgccaagcgctggctggcatcctatccgccgggcgtgccttcagagattcccgcctcggcaaatgcctccctcattgaccttctcgaaaagagctgcaagcaatttgccgaccgcaaggccttttccagcatgggaaaatccctgacctaccgggaactcgacgctgacacccgtgcggtcgccgcatggctgcaatccagaggactggaaaaaggcgaccgggttgcggtgatgatgccgaacatcctgcaaaatcccgtcgcggtttatgggattctgcgggcgggcatggtcgtggtcaatgtcaacccgctctataccccgcgcgaactggagcaccagctcaaggactccggcgcgaaagccctgttcgtgctggagaacttcgcccatgtggcgcagcaggctgtaccgaaaaccgccgtccggcatgtggtcgtcgcagcaatgggcgatcttctcggcctcaagggacatatcgtcaatctggtggtgcgcaaggtcaagaagctggtgcccgcccatgccattcccggctcgatcagcttcaaggccatgctgaaggaaggccagggggtttccctgaaaccggtcggccttacggcgcaggacatcgccttcctgcaatataccggtgggacgacgggcgtatccaagggcgccgtcctcacccatgccaatctccttgccaacaaggcgcagatcagcctgtggctcgacgctgccttcaacggccgcaaggaccgccccgaggttctcaacttcatctgcgcgctgccgctctaccatatcttcgcactgacggtgaattcactgatgggcattgcgctgggcggccataatctgctgatcgccaatccgcgcgacattcccggcttcgtaaaagagctttcgcattaccagccgcatatcttccctggcctcaccacgcttttcaacgcgttgatgaacaatgaagagttccgcaaacttgacctgtcgtcgctcatcttcgtactcggcggtggcatggcagtgcagaggccggtggccgaacgctgggtttccgtggtcggctgccctatcaccgaaggttacgggctgtcggaaacctcgcccgtcgccaccgtcaatcggctcgatgctgcggaattcagcggcaccatcggcctgcccatctcctccaccgaaatcgatattcgcgatgaggacggcaacagtctgccaacaggcgaagtcggcgagatttgcattcgcgggccgcaggtcatggccggttactggcagaggccggatgaaaccgcgaaggcgataacggcagacggcttcttccgttccggcgatatgggcttcatggacgaacgcggttacaccaagatcgttgaccgcaagaaggacatgatccttgtttccggattcaacgtctatccgaacgaggtggaagaagtggccgccagccatcctggtgtcctcgaatgcgccgcgatcggcgttccggacgaacattccggcgaaaccgtcaagcttttcgtggtcaagaaggaccagtccctgacggaagcggagctcaaggccttctgtgccaagaacctgacgaattacaaacggccgaaaatcatcgagttccgcaccgacctgccgaaatcgaatgtcggcaagattttgcggcgcgaattgcgcaatctgaactga

SEQ ID NO: 13985 - protein, 570 aa, Agrobacterium tumefaciens
MSELSLGHPENVSVAKRWLASYPPGVPSEIPASANASLIDLLEKSCKQFADRKAFSSMGKSLTYRELDADTRAVAAWLQSRGLEKGDRVAVMMPNILQNPVAVYGILRAGMVVVNVNPLYTPRELEHQLKDSGAKALFVLENFAHVAQQAVPKTAVRHVVVAAMGDLLGLKGHIVNLVVRKVKKLVPAHAIPGSISFKAMLKEGQGVSLKPVGLTAQDIAFLQYTGGTTGVSKGAVLTHANLLANKAQISLWLDAAFNGRKDRPEVLNFICALPLYHIFALTVNSLMGIALGGHNLLIANPRDIPGFVKELSHYQPHIFPGLTTLFNALMNNEEFRKLDLSSLIFVLGGGMAVQRPVAERWVSVVGCPITEGYGLSETSPVATVNRLDAAEFSGTIGLPISSTEIDIRDEDGNSLPTGEVGEICIRGPQVMAGYWQRPDETAKAITADGFFRSGDMGFMDERGYTKIVDRKKDMILVSGFNVYPNEVEEVAASHPGVLECAAIGVPDEHSGETVKLFVVKKDQSLTEAELKAFCAKNLTNYKRPKIIEFRTDLPKSNVGKILRRELRNLN

SEQ ID NO: 13986 - DNA, 3567 bp, Mycobacterium leprae
  CDS (1)..(3567)
atgtggcgccaacagtctatttctcatcgcaaggaatctgttatgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgccgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcgcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatagcggagaccccaaactgctggcgcactaccaggaactggcaaccgaccacctggaggtcatcgccggcgacaaaggcgaagtagatctggaattggaccggcaaacgtggcgacgactggccgacacggtcgatctgatcgtcgaccccgccgccctggtcaaccacgtgctgccgtacagcgagctattcggccccaatacgttaggcaccgccgagctgattcggatcgcgctgaccagtaagcaaaagccgtacatctatgtgtcgacaatcggcgtcggtaatcagattgagccagcaaaattcaccgaagactccgacatccgagtcattagcccgacgcgcaacatcaacaacaactatgccaacggctacggcaacagcaagtgggccggcgaagtgctgctgcgcgaagctcacgacctatgcggtctgccggtcacggtcttccgctgcgacatgatcttggccgacaccagctatgccggtcagctcaacgtccccgacatgtttactcgaatgatgctgagtctagccgccaccggcatcgcacccggctcgttctacgagctagacgccgagagcaatcggcaacgcgcccactacgacggtctgcccgtcgagttcatcgccgaagcgatctccaccctgggagaccaaagcctgcacgatcgagacgggttcacgacctatcatgtaatgaacccgcacgacgacggcatcggtatggacgagtttgtggactggttaattgatgccggctgccctatacaacgcatcaacgactacgacgaatggctgcgacggtttgagatttcgctgcgcgccctgcccgaaaggcagcgtcacagctcactgttgccgttgttgcacaactaccagaagccggagaagccattgcacgggtcgctggcacccacaatccggttccgtacggccgttcaaaacgcgaacattggtcaggacaaagatattccgcatatctcgccggcaatcatcgccaaatatgtcagcgatctgcagctgctcgggctggtttga

SEQ ID NO: 13987 - protein, 1188 aa, Mycobacterium leprae
MWRQQSISHRKESVMSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 13988 - DNA, 1873 bp, Arabidopsis thaliana (mouse-ear cress)
  CDS (39)..(1724)
aaaaaaaaaaaaaaaaacacttgttcatttacatcaaaatgatcactgcagctctacacgaacctcagattcacaaaccaaccgatacatccgtcgtctccgatgatgtgcttcctcattctcctcctacgcctcgcattttccggtcaaagcttccggacattgacatccctaaccacctccctctccacacttactgcttcgaaaaactctcatctgtttccgacaagccttgtctcatcgttggctccaccgggaaaagctacacctacggcgaaacacacctaatctgtcggagagtcgcttccgggttatacaagttaggtatcagaaaaggtgacgtcatcatgatccttctccaaaactcagccgagttcgttttctccttcatgggtgcttccatgatcggagccgtctcaaccaccgcaaaccctttctacacttctcaagagctttataaacagcttaaatcttccggagccaaactcataatcactcactctcaatacgtcgataaacttaaaaacctcggagaaaacctcacgctgatcactaccgatgaaccaacaccggagaattgtctaccattctcgacactcatcaccgacgacgaaacaaacccatttcaagaaaccgtcgatatcggcggtgacgatgcggcggcgttaccattctcatcgggaacaacagggttaccaaaaggagttgttttgacacacaagagcttaatcacaagcgttgcacaacaagtagatggagataacccaaatctttacctcaaatcaaacgacgtcatactctgcgttttaccacttttccatatctactctctcaatagcgtcctcctcaattcactccgatccggcgccacggttcttttaatgcataagtttgagatcggtgcgttattggatcttattcaaagacatagagtgacaatagcggcgcttgtaccgccgctagtgatcgctctagctaaaaacccgacggttaattcttatgatctctcctccgttagattcgttctttccggtgcagctcctttaggtaaagaacttcaagatagtcttcgtcgccgtctccctcaagccatccttggccagggatatggtatgacggaggcaggaccagtgttgtcaatgagccttgggttcgctaaagaaccgataccgacaaaatcaggttcatgtgggactgtggtccgaaacgcagagcttaaagtggttcaccttgagacacgtctctctcttggatacaaccaacctggtgagatttgtatccgcggtcaacagatcatgaaagagtacttgaacgatccagaagccacttcagcaacaatagacgaagaaggttggcttcacacaggagacattggatatgttgatgaagatgatgagattttcattgttgatcgacttaaagaagtcatcaagttcaaaggctttcaggtccctccagctgagctagagagtttgctaatcaatcaccattcaattgccgatgcagctgttgttccgcaaaatgatgaagtcgctggggaagttccggtggctttcgtggtgcgatcaaatggaaatgatatcactgaagaagatgttaaagaatatgttgccaaacaggtggtgttctataagagattgcacaaggtcttctttgttgcttccattcctaaatctccttcgggaaaaatactaagaaaggacctcaaagctaagctttgttgaatgtagttctttttaatatattccattgatgatttaaacgttcatttgtatccacaatgctttgtgtctcttttattttttaagatcctttgacgcaatagatgttggacactaagagtatgcttaagatactgaattattttggatca

SEQ ID NO: 13989 - protein, 561 aa, Arabidopsis thaliana (mouse-ear cress)
MITAALHEPQIHKPTDTSVVSDDVLPHSPPTPRIFRSKLPDIDIPNHLPLHTYCFEKLSSVSDKPCLIVGSTGKSYTYGETHLICRRVASGLYKLGIRKGDVIMILLQNSAEFVFSFMGASMIGAVSTTANPFYTSQELYKQLKSSGAKLIITHSQYVDKLKNLGENLTLITTDEPTPENCLPFSTLITDDETNPFQETVDIGGDDAAALPFSSGTTGLPKGVVLTHKSLITSVAQQVDGDNPNLYLKSNDVILCVLPLFHIYSLNSVLLNSLRSGATVLLMHKFEIGALLDLIQRHRVTIAALVPPLVIALAKNPTVNSYDLSSVRFVLSGAAPLGKELQDSLRRRLPQAILGQGYGMTEAGPVLSMSLGFAKEPIPTKSGSCGTVVRNAELKVVHLETRLSLGYNQPGEICIRGQQIMKEYLNDPEATSATIDEEGWLHTGDIGYVDEDDEIFIVDRLKEVIKFKGFQVPPAELESLLINHHSIADAAVVPQNDEVAGEVPVAFVVRSNGNDITEEDVKEYVAKQVVFYKRLHKVFFVASIPKSPSGKILRKDLKAKLC

SEQ ID NO: 13990 - DNA, 2076 bp, Arabidopsis thaliana (mouse-ear cress)
  CDS (1)..(2076)
atgattccttatgctgctggtgttattgtgccattggctttgacgtttctggttcagaaatctaagaaagaaaagaaaagaggtgttgttgttgatgttggtggtgaaccaggttatgctattaggaatcacaggtttactgagcctgttagttcccattgggaacatatctcaacgcttccagagctctttgagatatcgtgtaatgctcacagtgatagggttttccttggcacccgaaagctgatctctagagagattgagactagtgaggatggaaaaacgttcgagaaactgcatttaggtgactacgagtggctcacttttgggaagactctcgaagcagtgtgtgattttgcctctgggttagttcagattgggcacaagacggaagagcgtgtcgccatttttgcagatactagagaagaatggttcatctccctacagggttgcttcaggcgcaacgtcactgtggtaactatctattcatctttgggagaggaagctctttgtcactcgctgaatgagacagaggtcacaaccgtaatatgtggtagcaaagaactcaaaaagctcatggacataagccaacagcttgaaactgtgaaacgtgtgatatgcatggatgatgaattcccatctgatgtgaacagtaattggatggcgacttcatttactgatgttcagaaacttggccgcgaaaatcctgtggatcctaatttccctctctcagcagatgttgctgttataatgtacaccagtggaagcactggacttcccaagggtgttatgatgacgcatggtaatgtcctagctacagtttcggcagtgatgacaattgttcctgaccttggaaagagggatatatacatggcatatttacctttggctcacatccttgagttagcagctgagagcgtaatggctactattgggagtgctattggatatgggtctcccttgacgctaacggatacttcaaacaagataaaaaagggtacaaaaggagatgtcacagcactaaagcccactataatgacagctgttccagccattcttgatcgtgtcagggatggtgtccgcaaaaaggttgatgcaaagggcggattgtcaaagaaattgtttgactttgcatatgctcggcgattatctgcaatcaatggaagttggtttggagcctggggattggaaaagcttttgtgggatgtgcttgtgttcaggaaaatccgtgcagttttgggaggtcaaatccgctatttgctctctggtggtgcccctctttctggtgacactcagagattcattaacatctgcgttggggctccaatcggtcagggatatgggctcacagagacttgtgctggtggaaccttctcggagtttgaggacacatccgttggccgtgttggtgctccacttccttgctcctttgtaaagctagtagactgggcggaaggtgggtatctaactagtgataagccgatgccccgtggtgaaattgtaattggtggctcaaatatcacgcttgggtatttcaaaaatgaggagaaaactaaagaagtgtacaaggttgatgaaaagggaatgaggtggttctacacaggagacataggacgatttcaccctgatggctgcctcgagataatagaccgaaaaaaggatatcgttaaacttcagcatggagaatatgtctccttgggcaaagttgaagctgctctaagtataagtccctatgttgaaaacataatggttcatgctgattcgttctacagttactgtgtggctcttgtggtcgcgtcccaacatacagttgaaggttgggcttcaaagcaaggaatagactttgccaacttcgaagaactgtgcacgaaagagcaagccgtgaaagaagtgtatgcgtcccttgtgaaggcggctaaacaatcacgattggagaagtttgagataccagcaaagatcaaattattggcatctccatggacgccagagtcaggattagtcacagcagctctaaagctgaaaagagatgtaattaggagggaattctctgaagatctcaccaagttatatgcctaa

SEQ ID NO: 13991 - protein, 691 aa, Arabidopsis thaliana (mouse-ear cress)
MIPYAAGVIVPLALTFLVQKSKKEKKRGVVVDVGGEPGYAIRNHRFTEPVSSHWEHISTLPELFEISCNAHSDRVFLGTRKLISREIETSEDGKTFEKLHLGDYEWLTFGKTLEAVCDFASGLVQIGHKTEERVAIFADTREEWFISLQGCFRRNVTVVTIYSSLGEEALCHSLNETEVTTVICGSKELKKLMDISQQLETVKRVICMDDEFPSDVNSNWMATSFTDVQKLGRENPVDPNFPLSADVAVIMYTSGSTGLPKGVMMTHGNVLATVSAVMTIVPDLGKRDIYMAYLPLAHILELAAESVMATIGSAIGYGSPLTLTDTSNKIKKGTKGDVTALKPTIMTAVPAILDRVRDGVRKKVDAKGGLSKKLFDFAYARRLSAINGSWFGAWGLEKLLWDVLVFRKIRAVLGGQIRYLLSGGAPLSGDTQRFINICVGAPIGQGYGLTETCAGGTFSEFEDTSVGRVGAPLPCSFVKLVDWAEGGYLTSDKPMPRGEIVIGGSNITLGYFKNEEKTKEVYKVDEKGMRWFYTGDIGRFHPDGCLEIIDRKKDIVKLQHGEYVSLGKVEAALSISPYVENIMVHADSFYSYCVALVVASQHTVEGWASKQGIDFANFEELCTKEQAVKEVYASLVKAAKQSRLEKFEIPAKIKLLASPWTPESGLVTAALKLKRDVIRREFSEDLTKLYA

SEQ ID NO: 13992 - DNA, 1659 bp, Archaeoglobus fulgidus
  CDS (1)..(1659)
atgaaaccttggttcaggcactggccccctcttttgacaaaaacacttgactacccaagggttcccctctttgagtttgtcgagacgtctgcgaggagatttggcgataaggctgcaataatctactatggcagggagataacgtacaatgagcttcttgacgctgttgagagatttgccacttttttaagcaatgccggggttgagaaaggggacagagtggcaatctacgcccagaactccccgcagttcgtaatcgcatttttcggaataatgagagccaatgctgctgtcgtgccagttaatccgatgcttgttgagagggagcttgagtacgttctgagcgactctggcagcaagcttgttgtagcaacttcagagcttgcaggcagggttctgcctgtggcaaagaagcttggaattcaggtggtttgcggaaacctctctgacttcatacccgagcagcccacactgccagttccagactttgccaagctaaaaattgacgttgaggggacaacaagctggagtgaggcaatgaaggagagaaatccgcctgaagttatggtaggaagcgatgaccttgccctgattccctacacagcgggcacaactgggttaccgaagggctgcatgcacacgcattttacagcaatagcaaacgttctgagctcagttcactggtttaacctcaccccctcagccatatcactggcaaccctgccgtttttccatgtcacaggaatggtgcattcaatgctcgctccggtctacataggtgccacaatggtcttgcttacgagatgggacagggagacagctttgcaggcgattgagaggtatcgctgcacccactgggtgaacataacgacgatggtaattgacctgctcagcgacccgaaaattgctgagagggatttgagctctctgcttgtagttggtggtgggggagcgccgatgcccaaagccgtggctgagaagctgtatcagcttacggggataaggtacatggagggttacggcttaaccgagaccatctcccagacgcacatgaaccctccccaaaatccaaagcttcagtgccttggcattcctgattttggtgttgatgccctcgtgattgacatcgagacgggaaagccgctcccaccaaacgaggaaggagagatagttgtttcagggcctgagattttcaagggatactggaacaagcctgaggagacggaaaaggcatttattgagatagatgggaagagatacttcagaacgggagacctcggctacatggatgaagacggctacttcttcattgttgacaggattaagaggatgattaaccgttctggcttcaaagtctggcctgcagaggttgaagcggttctctacaagcatcccgcagttaaggaggtctgtgttataggagttccggatgagagggttgttgaggaggttaaggccttcatcgtcgtcaatcctgagtacaggggcaaaatcacagaggaagagataatccagtgggcgaagcagcagatggccgcatacaagtatccgaggattgtagagtttgatgatgagcttccgaagagcggggctggtaagattttgtggaggttgctgcaggaaagggagaaggagaaattggagaagggaggtggttga

SEQ ID NO: 13993 - protein, 552 aa, Archaeoglobus fulgidus
MKPWFRHWPPLLTKTLDYPRVPLFEFVETSARRFGDKAAIIYYGREITYNELLDAVERFATFLSNAGVEKGDRVAIYAQNSPQFVIAFFGIMRANAAVVPVNPMLVERELEYVLSDSGSKLVVATSELAGRVLPVAKKLGIQVVCGNLSDFIPEQPTLPVPDFAKLKIDVEGTTSWSEAMKERNPPEVMVGSDDLALIPYTAGTTGLPKGCMHTHFTAIANVLSSVHWFNLTPSAISLATLPFFHVTGMVHSMLAPVYIGATMVLLTRWDRETALQAIERYRCTHWVNITTMVIDLLSDPKIAERDLSSLLVVGGGGAPMPKAVAEKLYQLTGIRYMEGYGLTETISQTHMNPPQNPKLQCLGIPDFGVDALVIDIETGKPLPPNEEGEIVVSGPEIFKGYWNKPEETEKAFIEIDGKRYFRTGDLGYMDEDGYFFIVDRIKRMINRSGFKVWPAEVEAVLYKHPAVKEVCVIGVPDERVVEEVKAFIVVNPEYRGKITEEEIIQWAKQQMAAYKYPRIVEFDDELPKSGAGKILWRLLQEREKEKLEKGGG

SEQ ID NO: 13994 - DNA, 2667 bp, Plasmodium falciparum
  CDS (1)..(2667)
atgcacattatatttagtgtgtgtttgtttatcatttacataattcatgtatatccttgtaagtctggttgtttaggtaaagataaaggttattcagaaatttgtgagaaggcgatatatgagaatgaatcaaatacattttgtatgaaagatcatttaattcgagagtccttatttatttataagcctattatgaaattattattaaaaaaatatagattacgtaataataaaatagcaatagtcgaacatgcttatggtgaaccacaaaattttataacatatgggaaatttttcagaaaagtattatcctttagtcattcattaaataattttgaaggacaaggtatacaaggtaaaagttataaagaacatcaaaatcatggatggtttagattattaggtatatatggtagcaattctataaattggttaattgttgatatggcagctatgatgagtggtgtaacaaccttgattttacattctaactttagtatagatgtaattgtaaacatattaaatgaaacgaaattagaatggttatgtttagatttagatttagttgatggcttattacttcatagacatgaattaccatatttgaaaaaattaataattttagataacttagtgaaacctatacgaatagatattcttcgttatgtttttaataatgaaaataacgtttcagaatatgatgatgctagtgatgatgatgaaaatagtgaatcgtctgatgaatcgtttgaaattaatatgggtcttgcagaatatgatgtagaaaaattagaaaaaataaaagatttaaaagaaagatcaaaaaatgttggaattagatttttagaatttgatgacgtatcaagtgtcccaactaaaatttataatattcaaaatgatgaaccagattttattacttctattgtatatacatctggaacatctggaaaacctaaaggtgttatgttaagtaatttaaacatgtataatgctattgtaccattatgtaaacacagtatgctaaattatcatccaaaagcacatttatcctatttacctgtatcacatatatatgaaagagttaatgtatatgttgctttcttatcaggtataaaaatagatatttggagcaaaaatatcaatttcttttctagagatatatttaattcaaaaggtgaattattagtaggggtacccaaagtttttaatagaatctattcaaatattatggcagaaataaataatttgtcagctactaaaagaagaaatataaaaaatgttttctcattacgtagatctgttaattgtgcttgctttacaaatttattagaaggattaactggatattcatctaaaattagaaattgtgtaaacccaaatttagaagtcatattaaatggtggtggaaagttatctccaagaattgctgaagaattacgtgttctattaaatgttaacttttatcaaggctatggtttaacagaaaccacaggtcctatttttgtacaacaaaaaagagattataatacagaaagtataggaggtcccatagcccctaatacaaaatataaagtaagaacatgggaaacttataaagcatcagattctacacctaaaggagaattattaattaaaagtgattccatatttaaaggatactttctagaaagagaactaacagaaaattcttttacatatgatcatttttttgtaacaggtgatatcgttcaaataaatgataatggttctttaactttcttagatagatctaaaggtttagtgaaattatcacaaggggaatatatagaaacagatttgttaaataatatttattcagaaattccttttattaataattgtgttgtttatggtgatgattctttagatgaagccttagctattatttctgttgataaatatttattatttagatgtttaagagatgataatatgttaaatgaaactggaattaatgaaaaaaattatatggataaattatctgatcaaaacataaatacaaaacattttattgattacgttaaaaataaaatgttagaagtatataataatacaaatttaaataggtataatattattaatcatatttatttaacgtccaaaacttgggatacaaccaattatcttacaccaacaatgaaggtgaagagattttctgtcatacaagattatgctttcttcattgatcaagttaaaaatatatttaaaaaaaaattaaaaggtcaaaaggaacgcactaagcgtttacaaaagaaaacctcagatgaacaggaaataaaaaatgatgaaaacgatcaagaaaaatctaaaaaaagttatttttcaagattatcacaaaagagaaaatcacgttctcaagaaaaaaataaatcaacatctcaagaaaaaaataaatcaacatctcaagaaaaaaataaatcaaaatctaaagaaaaaaatacatcaacacttccacaggataatatatccataccagtgcaaaataaaattgaaaaaccgcaacaaaataatatgtcaaatattacattaaaaaataccctcaaatctactgatgcatctttaaaaatacctgaaaaaaataaagtacaaacaaataaatcgagatttcaagttcaaaatgtacgagaagaacttgaaatgaattcataa

SEQ ID NO: 13995 - protein, 888 aa, Plasmodium falciparum
MHIIFSVCLFIIYIIHVYPCKSGCLGKDKGYSEICEKAIYENESNTFCMKDHLIRESLFIYKPIMKLLLKKYRLRNNKIAIVEHAYGEPQNFITYGKFFRKVLSFSHSLNNFEGQGIQGKSYKEHQNHGWFRLLGIYGSNSINWLIVDMAAMMSGVTTLILHSNFSIDVIVNILNETKLEWLCLDLDLVDGLLLHRHELPYLKKLIILDNLVKPIRIDILRYVFNNENNVSEYDDASDDDENSESSDESFEINMGLAEYDVEKLEKIKDLKERSKNVGIRFLEFDDVSSVPTKIYNIQNDEPDFITSIVYTSGTSGKPKGVMLSNLNMYNAIVPLCKHSMLNYHPKAHLSYLPVSHIYERVNVYVAFLSGIKIDIWSKNINFFSRDIFNSKGELLVGVPKVFNRIYSNIMAEINNLSATKRRNIKNVFSLRRSVNCACFTNLLEGLTGYSSKIRNCVNPNLEVILNGGGKLSPRIAEELRVLLNVNFYQGYGLTETTGPIFVQQKRDYNTESIGGPIAPNTKYKVRTWETYKASDSTPKGELLIKSDSIFKGYFLERELTENSFTYDHFFVTGDIVQINDNGSLTFLDRSKGLVKLSQGEYIETDLLNNIYSEIPFINNCVVYGDDSLDEALAIISVDKYLLFRCLRDDNMLNETGINEKNYMDKLSDQNINTKHFIDYVKNKMLEVYNNTNLNRYNIINHIYLTSKTWDTTNYLTPTMKVKRFSVIQDYAFFIDQVKNIFKKKLKGQKERTKRLQKKTSDEQEIKNDENDQEKSKKSYFSRLSQKRKSRSQEKNKSTSQEKNKSTSQEKNKSKSKEKNTSTLPQDNISIPVQNKIEKPQQNNMSNITLKNTLKSTDASLKIPEKNKVQTNKSRFQVQNVREELEMNS

SEQ ID NO: 13996 - DNA, 1671 bp, Neisseria meningitidis
  CDS (1)..(1671)
atggaaaaaatctggttagacagctacgagaagggcgtcagtgccgaaatcgacatcacgcaatacaattccgtcagcgacgtattccgccaaagcgtggaaaaatttgccgaccaacctgcttttcaaaacatgggtaagacgctgacttatgccgaaaccggcaaactggcaacagattttgcttcttatctgcaaaacgtccttaaattgcctcgaggagagcgcgtggcaataatgttgcccaatgtactgcaatatccggttgcccttttcggcattttgcaggcaggtttggtagcggtgaacaccaatccgctctataccccgcgcgagctggagcatcagttgaaagacagcggcgcgaccgccatcatcgttttggaaaatttcgccaacacgctggagctggtgctgccgcgcacgcagatcaaacacgtcatcgtcgcctctgtcggcgaaatgttcgggctgcttaaaggttcgctgatcaatttcgtcatccggaaaatcaagaaaatggtgcccgaataccgtattcgggaaaccgtttcctttcagacggcattgaaagaaggggcgaagcacgttttccaacctgtcgcattaaaccgcgaagataccgcgctgttgcaatacacgggcggcacgacaggtgttgccaaaggggcggtgctgagtcacggcaacatctgcgccaatatgcttcaggcaaaagaatggattaaaaaccagttgcgcgagggcaaagaaaccgttatcgccgccctgccgctgtatcatatttttgccttaaccgtgaatctgatgatttttgccaatgccggctcgaaaatcatcctgattaccaacccgcgcgatatgaaaggctttatcggagaactgaaaaaacagcgggttaatgtatttatcggcgtgaacacgctgtttaacgcgatggttaaccgtcctgattttgccgaagtcgatttttcagaattgcggctgactttgggcggcggtatggcgacccaaaaagccgttgccgaaaaatggaaaaaaatcaccggcacgcccatcgtcgaagcctacggtctgaccgaagccagccccggcgtgtgctgcaaccccttaaacatcgaatcatacagcggcagcatcggtttgcccgtctcgtccaccgaagtcgaactgcgcgacgcaaacggcaaagaagtccccgtcggacagccgggcgaactttgggtgcgcggcccgcaagtcatgaaaggctattggaaccgtcccgaagaaaccgctaaagccatagacgcgcgcggtttcttggaaaccggcgatattgccgtcatggacgaaaaaggctggttgaagctggtcgatcgtaagaaagacctcgtcgtcgtttccggattcaatgtttatccgaacgaaatcgaggaagtcatcgcgcatcacggcaaagtgatggaagtcgcctgtatcggcgttcccgacgaaaaaaccggagaagccctaaaagtatttgtcgtcaaaaaagacccgtcattgaccaaagaagaacttatcgccttttgccgcaccgaattaaccgcatataaagtaccgaaaaatatcgaattccgcgacgagttgcccaagtccaacgtcggcaaaatcctgcgccgcgagttgcggcaaagtaccgggaaataa

SEQ ID NO: 13997 - protein, 556 aa, Neisseria meningitidis
MEKIWLDSYEKGVSAEIDITQYNSVSDVFRQSVEKFADQPAFQNMGKTLTYAETGKLATDFASYLQNVLKLPRGERVAIMLPNVLQYPVALFGILQAGLVAVNTNPLYTPRELEHQLKDSGATAIIVLENFANTLELVLPRTQIKHVIVASVGEMFGLLKGSLINFVIRKIKKMVPEYRIRETVSFQTALKEGAKHVFQPVALNREDTALLQYTGGTTGVAKGAVLSHGNICANMLQAKEWIKNQLREGKETVIAALPLYHIFALTVNLMIFANAGSKIILITNPRDMKGFIGELKKQRVNVFIGVNTLFNAMVNRPDFAEVDFSELRLTLGGGMATQKAVAEKWKKITGTPIVEAYGLTEASPGVCCNPLNIESYSGSIGLPVSSTEVELRDANGKEVPVGQPGELWVRGPQVMKGYWNRPEETAKAIDARGFLETGDIAVMDEKGWLKLVDRKKDLVVVSGFNVYPNEIEEVIAHHGKVMEVACIGVPDEKTGEALKVFVVKKDPSLTKEELIAFCRTELTAYKVPKNIEFRDELPKSNVGKILRRELRQSTGK

SEQ ID NO: 13998 - DNA, 2354 bp, Arabidopsis thaliana (mouse-ear cress)
  CDS (202)..(2184)
atcaaattatcttctttctctttctctctgatcatttccaaattatttctaagctaagaaaatctttaaaaataacaaagcttctaaaataataatccgacctaccggattcaaaccattgatctgaagatcatctataaaccagtccttgatctataaactaaaataagggaagaaaaaaacaagagagagaaatagagaatgaagtcttttgcggctaaggtagaagagggagttaaaggaatagacggaaagccgtcggtaggtccggtgtaccggaatcttctgtcggaaaaaggttttcctccgattgattctgagatcaccactgcttgggacattttcagtaaatcagtggagaaattccctgacaataatatgcttggatggcgtcgaattgttgatgagaaggttggaccatatatgtggaaaacgtacaaggaagtatacgaagaagttttgcagattggctctgcactacgagccgccggagctgaacctgggagtcgagtggggatctacggtgttaattgtcctcagtggatcatagcaatggaggcttgtgcagctcacactctaatctgtgtacctctatatgatacattggggtcaggagcagtcgattacattgtagagcatgcggaaatcgactttgtgtttgtccaagacaccaaaattaaaggacttcttgagccagattgcaaatgtgctaaacggctaaaagctatagtttccttcactaacgtgagcgacgagcttagccacaaggcttcagaaattggagtcaaaacatactcctggatcgattttctccatatgggacgtgagaaaccggaagacacgaacccgcctaaggcgtttaacatatgcaccataatgtacaccagcggcacaagcggtgatcctaaaggtgtggttttgactcaccaagcggtcgcgacttttgttgttgggatggatctctatatggaccagtttgaagataagatgacacatgatgatgtgtatctctccttcttgcccttggctcatattcttgaccgtatgaacgaggaatacttctttcgcaaaggcgcttccgtcggctattaccatggaaatttgaacgtgttacgtgacgatattcaagaactgaaaccgacttatctagctggagtaccaagagtgtttgagagaatccatgaggggattcaaaaggctcttcaagaacttaacccaagaaggagattcatcttcaatgctctctacaaacacaagcttgcgtggttgaatcgtgggtactctcatagtaaagcttcacccatggctgatttcattgctttcagaaagattagagacaaattgggaggtcgcatccggttgctagtatctggaggagcacctttgagccctgagattgaagagtttttgagagttacttgttgttgctttgtcgttcaaggctacggtctaacggagacacttggaggaacggctttgggtttcccggacgagatgtgtatgctagggacagtcggtattccagcggtttacaacgagatacggcttgaagaggtgtctgaaatgggctatgacccgctcggagaaaatccggcaggagagatctgtataagaggacaatgtatgttttcagggtattacaagaaccctgaactcactgaagaagtcatgaaagatggatggttccacacaggagatataggtgagattcttccaaacggagtactcaagatcatcgatcgtaaaaagaatctgatcaaactttctcaaggagaatatgttgctctcgagcatttggaaaacatcttcgggcaaaactctgttgtccaagatatatgggtttatggagacagcttcaaatctatgcttgtcgcggtggttgttcccaacccagaaaccgtcaacaggtgggctaaagatctcggttttactaaaccattcgaagaactctgttctttcccggaactaaaagaacacatcatttcagaactgaagtccacggcagaaaagaacaagctaagaaagtttgagtacatcaaagcggtgacagtggagacaaaacctttcgacgtagagagagacttagtgactgcgacgctcaagaatcggaggaacaatcttctcaaatattatcaggtgcaaatcgacgaaatgtaccgcaaattggcctcaaagaaaatctgaaagtgttgcgatgatgtgtgtgctgttattgatagttatatatgtacgttatatgtatcaataattcatagatatgagctttatgctttatgtaatattttatttttatgttgtatgacatcataattatggaatttttttttgttgattaaaaaaaaaaaaaaaaaaag

SEQ ID NO: 13999 - protein, 660 aa, Arabidopsis thaliana (mouse-ear cress)
MKSFAAKVEEGVKGIDGKPSVGPVYRNLLSEKGFPPIDSEITTAWDIFSKSVEKFPDNNMLGWRRIVDEKVGPYMWKTYKEVYEEVLQIGSALRAAGAEPGSRVGIYGVNCPQWIIAMEACAAHTLICVPLYDTLGSGAVDYIVEHAEIDFVFVQDTKIKGLLEPDCKCAKRLKAIVSFTNVSDELSHKASEIGVKTYSWIDFLHMGREKPEDTNPPKAFNICTIMYTSGTSGDPKGVVLTHQAVATFVVGMDLYMDQFEDKMTHDDVYLSFLPLAHILDRMNEEYFFRKGASVGYYHGNLNVLRDDIQELKPTYLAGVPRVFERIHEGIQKALQELNPRRRFIFNALYKHKLAWLNRGYSHSKASPMADFIAFRKIRDKLGGRIRLLVSGGAPLSPEIEEFLRVTCCCFVVQGYGLTETLGGTALGFPDEMCMLGTVGIPAVYNEIRLEEVSEMGYDPLGENPAGEICIRGQCMFSGYYKNPELTEEVMKDGWFHTGDIGEILPNGVLKIIDRKKNLIKLSQGEYVALEHLENIFGQNSVVQDIWVYGDSFKSMLVAVVVPNPETVNRWAKDLGFTKPFEELCSFPELKEHIISELKSTAEKNKLRKFEYIKAVTVETKPFDVERDLVTATLKNRRNNLLKYYQVQIDEMYRKLASKKI

SEQ ID NO: 14000 - DNA, 2233 bp, Arabidopsis thaliana (mouse-ear cress)
  CDS (82)..(2079)
acactccttatcttcttcattcctccatcctatttttcttcttcgccaaagtgttattcctcaactttatatattacacaaatgtctttagccgcggataatgtgttgttggtggaagaaggaaggccagccacagcggaacatccatcggccggaccggtttatcgatgtaaatacgctaaagatggcctcctcgatctccctaccgatattgattctccttggcagttctttagtgaggctgtgaagaaatatccgaatgagcaaatgttgggccaacgcgtaacgactgattctaaggtcggtccatacacgtggatcacatataaggaagcgcacgacgctgcaattcggattggatcagcaatcagaagccgaggcgttgatccgggacactgttgtggtatttacggagctaattgtccagaatggattattgcaatggaggcctgcatgagccaagggatcacctacgtgcctctatacgattctttaggcgtaaacgcagttgaattcatcatcaaccacgccgaggtttcgctagtatttgttcaagagaagacagtttcatcgatcttatcgtgccaaaagggatgttcttcgaatttgaagactattgtgagcttcggggaagtctcgagtacacaaaaggaagaagctaagaaccaatgtgtttctttattttcatggaatgagttctcactaatgggaaacttagatgaggcaaatctacctcgtaagcgaaagacagacatctgcacaataatgtacacaagcgggacgactggagaacccaaaggtgtaatcttaaacaacgcagcaatttcggtccaggttttatccatagacaaaatgcttgaagtcactgatcgatcgtgtgacacgagcgatgtgttcttctcgtacttgccattagcacattgctatgatcaagtcatggagatttactttttatctagaggctcctctgttggatactggcgtggcgacattcggtacctgatggatgatgttcaagctcttaaacctactgtgttttgcggtgttccacgagtttacgacaaactatatgccggtataatgcaaaaaatatcagctagtggcttgatacgcaagaaactgtttgattttgcttataactacaaattgggaaatatgagaaaaggattctctcaagaagaagcttctcctcgtctagacagacttatgttcgataagataaaagaagcattaggaggaagagctcatatgttgttatcaggagcagcgcctctacctcgtcatgtagaggagttcttgagaatcattcctgcctctaatctctctcaaggttatggattgactgagagttgtgggggaagcttcacgaccttagccggagtattttctatggtggggacagtgggtgtgccaatgcccacggtggaggcaaggctagtgtccgtaccagagatgggttacgacgccttttccgctgacgtgccgagaggagagatttgtcttagaggaaattcaatgttttctggttaccataaaagacaagatctaactgatcaagtcctaatcgatggatggttccacacaggagatattggagaatggcaagaagatggatcaatgaagatcatcgataggaagaagaacatcttcaagttgtctcaaggtgaatatgttgctgttgaaaacctcgaaaacacttactcaagatgtcccctcattgctcagatatgggtctatggcaacagcttcgagtcatttttggtaggtgtggttgtacctgatagaaaagctattgaagattgggctaaactcaattaccaatctcccaatgatttcgaatctctatgtcaaaatctcaaagctcaaaaatacttcttggatgagcttaactctaccgcaaagcaatatcaacttaaaggatttgaaatgttaaaagctattcatttagaaccaaacccttttgatattgaaagagatcttattactccaactttcaagctgaaaaggccacagctcctccaacattacaagggcatagttgatcaactttattcagaagcaaagaggtccatggcatagataattagataccgatcggctattcattttctgatgctatttgggtttgtatgatatgttacaaaattgtgttcggatcctctcatcatgtgattcttgttacactaaatttatagtttggaaactatatatatactattaagcaacgtttacg

SEQ ID NO: 14001 - protein, 665 aa, Arabidopsis thaliana (mouse-ear cress)
MSLAADNVLLVEEGRPATAEHPSAGPVYRCKYAKDGLLDLPTDIDSPWQFFSEAVKKYPNEQMLGQRVTTDSKVGPYTWITYKEAHDAAIRIGSAIRSRGVDPGHCCGIYGANCPEWIIAMEACMSQGITYVPLYDSLGVNAVEFIINHAEVSLVFVQEKTVSSILSCQKGCSSNLKTIVSFGEVSSTQKEEAKNQCVSLFSWNEFSLMGNLDEANLPRKRKTDICTIMYTSGTTGEPKGVILNNAAISVQVLSIDKMLEVTDRSCDTSDVFFSYLPLAHCYDQVMEIYFLSRGSSVGYWRGDIRYLMDDVQALKPTVFCGVPRVYDKLYAGIMQKISASGLIRKKLFDFAYNYKLGNMRKGFSQEEASPRLDRLMFDKIKEALGGRAHMLLSGAAPLPRHVEEFLRIIPASNLSQGYGLTESCGGSFTTLAGVFSMVGTVGVPMPTVEARLVSVPEMGYDAFSADVPRGEICLRGNSMFSGYHKRQDLTDQVLIDGWFHTGDIGEWQEDGSMKIIDRKKNIFKLSQGEYVAVENLENTYSRCPLIAQIWVYGNSFESFLVGVVVPDRKAIEDWAKLNYQSPNDFESLCQNLKAQKYFLDELNSTAKQYQLKGFEMLKAIHLEPNPFDIERDLITPTFKLKRPQLLQHYKGIVDQLYSEAKRSMA

SEQ ID NO: 14002 - DNA, 1806 bp, Archaeoglobus fulgidus
  CDS (1)..(1806)
atgaaggttgtcaaagacccagagctgaaaattgagcgaaaggaatcgctcaacaagatgctctggaacaccgttcagagtcatccaagagtgtcggccattggctactgggacgatggaaagctgaaatatctcacctacgaggagttctgggagagggtgaggaagctatcaaagtttttaatttcttccggcctgcggaagggagacagggttgcgatttacgccgacacacgctatgaatgggagattgccgactttgcagttctaactgctgggggagtggttgttacagtccacagcgttcttaacagagagcaggttgaatacatcctgagagactcggagagcagagttgttttcacggaaaagaagtatgctgaaaacgttcctgaggactttgaggtttactttctggaggagctggaaaagcttgtcggtgaggtttctgatgatgaattcgaaagcagatggaagagcgttgagcctgacgaccttgcaagcattgtttacacctctggcaccacaggagagccaaagggggcgatgctcacgcactggaactggaggttcaactgccactctgtgatgtccatcacgcccttctatcccggagagccccacatctgctatctgccattgagccacgtttaccagaggcttgttttctttgctggaatttcgagggcagcaacagcagttttctgcagtccccagcagttcctcgaaacgtcaacagcagtgaagcctgttggactaatagttgtgccgagaattcttgagagggtgaatgcgggaattgtcgagaaagttgagaagtcaccagctttggcaaagaagattttctactggtcgagaggagttgccattgagtgtggaaagagaatgagcagaggggagaaatacggcttctggctgaatataaagagaataatcgcagacaggcttgttttcagcaaaattcgggagaacctcggcctcacaagaatcaggtttgtctgctcctctgccgcagaactacagaaggagctggcctacatgttcaatggcatgggaattcccgtaattgagggctacggaatgacagagactgcagcaccatccaacctcaatcctgtcggaaggttcaaacccggcacagttggcccgccaattcccggcatcgaggaggcgatagctgaggatggagagattctcgtcaggggagacaacgtgatgaagggctactggagaaaggaagctgagacgagaaaaaccttcaccgaggatggatggctgaagacaggtgaccttggagagttcgacgaggatggctacctcgtctttctcgggaggaagaagcacataattgtccttgacacgggtaaaaacgtttctcctgtccctatagaggaggaattgctcaaaaatccgcttgtgagtgatgcggttatcattggtgacggaaagccctacgtaactaccctcatagtcccgaatttcagcatgctccttgagtttgccgataaaaacggaattgagtatgacaggagtagaacgattgttcagaggagcatttctggagaggaggagattgtggctgttgatgaaaaccttgtggagaataatgcagttaaggagctttacgcaaaaattgttgatgatgtcaacagcaggctggcaaagcacgagacaatcaagaagttcaaaattttgcctgaggctttcagccttgagaagggggagataactccaactttgaagaagaggaggcacgtcattctgaagaggtatgagaaatttattgaggagatgtataagaggtga

SEQ ID NO: 14003 - protein, 601 aa, Archaeoglobus fulgidus
MKVVKDPELKIERKESLNKMLWNTVQSHPRVSAIGYWDDGKLKYLTYEEFWERVRKLSKFLISSGLRKGDRVAIYADTRYEWEIADFAVLTAGGVVVTVHSVLNREQVEYILRDSESRVVFTEKKYAENVPEDFEVYFLEELEKLVGEVSDDEFESRWKSVEPDDLASIVYTSGTTGEPKGAMLTHWNWRFNCHSVMSITPFYPGEPHICYLPLSHVYQRLVFFAGISRAATAVFCSPQQFLETSTAVKPVGLIVVPRILERVNAGIVEKVEKSPALAKKIFYWSRGVAIECGKRMSRGEKYGFWLNIKRIIADRLVFSKIRENLGLTRIRFVCSSAAELQKELAYMFNGMGIPVIEGYGMTETAAPSNLNPVGRFKPGTVGPPIPGIEEAIAEDGEILVRGDNVMKGYWRKEAETRKTFTEDGWLKTGDLGEFDEDGYLVFLGRKKHIIVLDTGKNVSPVPIEEELLKNPLVSDAVIIGDGKPYVTTLIVPNFSMLLEFADKNGIEYDRSRTIVQRSISGEEEIVAVDENLVENNAVKELYAKIVDDVNSRLAKHETIKKFKILPEAFSLEKGEITPTLKKRRHVILKRYEKFIEEMYKR

SEQ ID NO: 14004 - DNA, 1938 bp, Borrelia burgdorferi (Lyme disease spirochete)
  CDS (1)..(1938)
atgagtgatactgtgcctaagcgttttaaagatgtggtagctctttatagtgagcttgatatttttatgtataaggagggggaatcaaaaagttttaagaagcaaatatacgctgatttttggaatgagacaaaaagagtggcttctgggcttttgcattgtggcattaaaaggggagaaaaggttgtaattatttctgattctagaagagaatggataataatcgacgttgctactttggggttaggctgcgttgatgttcccaggggaaatgattcttctgaggatgaattagcttatattattaaccattctgaatctacttttatttttgttgaaaacaataagcaacttcacaaggttttatccaaaaagcatgatcttagattggtaagatgtattgttgttattgatgatgataaatcttatgaagaaaaaataggaaatattactgtattttcttataaaaaattactagaacttggaactgagtatttaagagctaatccaaaatcatttgatatggagattgaaaaaggttcttcaaaagacattgcaactataatatatacttctggtacaacaggtatgccaaagggagtaatgttgaggcatgaatcttttatttttcaattagatagactttatgattatcttccaacacttaaacccggcaagataatgatttctattcttcctctttggcattcttttgagcgggcttgtgaatatatagttgctttaaaaggcatagcaattgcatattcaaagcccataggtcctgttttgttaaaagactttttacttttaaatcctcaaatgattgtttctgtacccagaatttgggaaggtataagaataggtattattaaaaaggtatcagaatcttttattaagaagtttgtgtttggagggtttttaaaagttgggattatttatgcaaagcttaaggagagatttttagggctttctcctatttataaaaaaactaattttcttatttcgcttttttcaaaattatttttatttattgggattgttttaatttttcctattaaattattgggcgatattttagtatttaaaaaaataaaaaatgctcttgggcaaaattttgaatttggagtttctggtggtggggcattggttgattatgttgattatttttttaaggccgtaggaattaaagtgcttgaaggttacggtcttactgaaacgggccctattttgagcgttaggcgtcttaaaggccctgtagcaaaaactgtcggccctattttgccagatgttgaatacaaagtagttggaattgatgggagagttttgccttatggagaaaaaggcgagctttgggtcaggtcgccacaaataatgagtggctactttaaggataaggctaagacaagtgaagttttaacagaagatggttggtttaacactggggacttggttagattaacaattaataatgaaatttcaattgttggtagaagcaaggatacaattgttctgaggggcggggaaaatattgagcctgagccccttgagagagttttgggtaaatctttgtttattgaaaatattatgatcgttggtcaggatcaaaaatttttgggggctgttattgtgcctaattttgataatcttgaaaaatgggcaaattctagtggagtttctttttcttccagaagtgatttgttagccaatgaggacgtcaataaactttattctaagcatatttcagacactattaatactaaattaggttttaaaaattttgaaaaaatagtaggctttgttttgcttcaggatccttttacaattggagaagagcttaccaatactcttaagttaaaaagatattatatatccaaaaagtatgaagataaaataaaattaatttttagcaaaagtgacttagatttaaacggatattag

SEQ ID NO: 14005 - protein, 645 aa, Borrelia burgdorferi (Lyme disease spirochete)
MSDTVPKRFKDVVALYSELDIFMYKEGESKSFKKQIYADFWNETKRVASGLLHCGIKRGEKVVIISDSRREWIIIDVATLGLGCVDVPRGNDSSEDELAYIINHSESTFIFVENNKQLHKVLSKKHDLRLVRCIVVIDDDKSYEEKIGNITVFSYKKLLELGTEYLRANPKSFDMEIEKGSSKDIATIIYTSGTTGMPKGVMLRHESFIFQLDRLYDYLPTLKPGKIMISILPLWHSFERACEYIVALKGIAIAYSKPIGPVLLKDFLLLNPQMIVSVPRIWEGIRIGIIKKVSESFIKKFVFGGFLKVGIIYAKLKERFLGLSPIYKKTNFLISLFSKLFLFIGIVLIFPIKLLGDILVFKKIKNALGQNFEFGVSGGGALVDYVDYFFKAVGIKVLEGYGLTETGPILSVRRLKGPVAKTVGPILPDVEYKVVGIDGRVLPYGEKGELWVRSPQIMSGYFKDKAKTSEVLTEDGWFNTGDLVRLTINNEISIVGRSKDTIVLRGGENIEPEPLERVLGKSLFIENIMIVGQDQKFLGAVIVPNFDNLEKWANSSGVSFSSRSDLLANEDVNKLYSKHISDTINTKLGFKNFEKIVGFVLLQDPFTIGEELTNTLKLKRYYISKKYEDKIKLIFSKSDLDLNGY

SEQ ID NO: 14006 - DNA, 2097 bp, Arabidopsis thaliana (mouse-ear cress)
  CDS (1)..(2097)
atggcttcgacttcttctttgggaccttctacactactctcttacggttctccttctcgtcagtttcctgattttgggttcagattgatttcgggtcacgaaagtgttcgaattccatcattccggcgatttcgggaaaaagaagtgaagccgtcttctccatttcttgaaagctcctcgttttcgggagatgctgctttgcgctctagtgaatggaaggctgttcctgatatttggagatcatctgcagaaaagtatggtgatagagttgcattggtggatccttatcatgatcctcctttgaaactgacgtacaagcagttggaacaagaaattttggactttgctgagggcttacgagttcttggagtgaaagcagatgagaagattgcactttttgctgataactcctgccgatggcttgtttcagatcaaggggcagtcaatgttgtcagaggatctaggtcctctgttgaagagttactgcagatataccgtcattctgaaagcgtagccattgttgtggataatcctgagtttttcaaccgcattgctgagtcatttacgtcaaaggcatctctgagatttttgatacttctctggggtgagaaatcatcactggtcacacaggggatgcagattccagtttacagttatgcagaaattataaaccaaggacaggagagtcgtgcaaaattatcagcatctaatgataccaggagctatagaaatcaattcatcgattcagatgatacagctgcaattatgtataccagtggtaccacgggaaatccaaaaggcgttatgcttacacatcggaatctcttacaccagataaaacatttatccaaatatgtacctgctcaagctggggataaatttctaagcatgctaccatcatggcatgcctatgaacgtgctagtgaatacttcatattcacttgtggagttgagcaaatgtatacatctataagatacttaaaggatgatctaaagcggtaccaaccgaactatattgtgtccgttcctctagtatatgagacactttacagtgggattcaaaagcaaatttctgcaagttctgctggccgtaaatttctagcacttacattgatcaaagtcagtatggcatatatggagatgaaaaggatatatgagggtatgtgtctgacaaaagagcaaaagcctccaatgtatattgttgcttttgtggattggttgtgggcgagagtaattgctgccttgttgtggccattacatatgttggccaaaaagcttatctacaagaaaattcattcgtctattgggatatcgaaggctggtattagcggaggtggtagtttacccattcatgttgacaagttttttgaggccatcggtgtgattctacaaaatggttatggtttgacagagacctcacctgttgtctgtgcacggacacttagctgcaatgttcttggctcagctgggcatccaatgcatggtacagaattcaaaattgtagatcctgagactaataatgtactccctcctggttcaaagggcattatcaaagtcagaggtccacaggttatgaagggttattataagaatccatcgactacaaagcaagttctaaatgagagtggatggttcaatacaggagacaccggttggattgctcctcatcactcaaaagggcggagtcgccactgtggaggtgtcattgttcttgaaggccgtgcaaaagacacaattgtactttccacaggtgaaaatgtggaaccgttggagattgaagaagccgccatgagaagcagggtgattgaacaaattgttgttattggacaggaccgacgtcgccttggagctatcattatcccaaacaaagaggaagcacaaagagtagatcctgaaacatccaaagaaacactaaagagcttggtctaccaagaactgagaaaatggacatcagaatgttcgtttcaagtcggaccagtcttgatcgtcgacgaccctttcacgatagacaacgggttaatgacaccaactatgaagattagacgggacatggtcgtggctaaatacaaagaggagattgatcaactctacagttaa

SEQ ID NO: 14007 - protein, 698 aa, Arabidopsis thaliana (mouse-ear cress)
MASTSSLGPSTLLSYGSPSRQFPDFGFRLISGHESVRIPSFRRFREKEVKPSSPFLESSSFSGDAALRSSEWKAVPDIWRSSAEKYGDRVALVDPYHDPPLKLTYKQLEQEILDFAEGLRVLGVKADEKIALFADNSCRWLVSDQGAVNVVRGSRSSVEELLQIYRHSESVAIVVDNPEFFNRIAESFTSKASLRFLILLWGEKSSLVTQGMQIPVYSYAEIINQGQESRAKLSASNDTRSYRNQFIDSDDTAAIMYTSGTTGNPKGVMLTHRNLLHQIKHLSKYVPAQAGDKFLSMLPSWHAYERASEYFIFTCGVEQMYTSIRYLKDDLKRYQPNYIVSVPLVYETLYSGIQKQISASSAGRKFLALTLIKVSMAYMEMKRIYEGMCLTKEQKPPMYIVAFVDWLWARVIAALLWPLHMLAKKLIYKKIHSSIGISKAGISGGGSLPIHVDKFFEAIGVILQNGYGLTETSPVVCARTLSCNVLGSAGHPMHGTEFKIVDPETNNVLPPGSKGIIKVRGPQVMKGYYKNPSTTKQVLNESGWFNTGDTGWIAPHHSKGRSRHCGGVIVLEGRAKDTIVLSTGENVEPLEIEEAAMRSRVIEQIVVIGQDRRRLGAIIIPNKEEAQRVDPETSKETLKSLVYQELRKWTSECSFQVGPVLIVDDPFTIDNGLMTPTMKIRRDMVVAKYKEEIDQLYS

SEQ ID NO: 14008 - DNA, 1701 bp, Bacillus halodurans
  CDS (1)..(1701)
atgacaattgatcgagtttggttgaagagttatccgaaggaaattccccattctattgactatgaggaaaggacgttgcaatcgtatttaaagcaagcagcagaggagttcccgtcacatattgccgttcagtttctcggaaaggaaatgacctatcgtgagctgtatgaacaagcgaagcaatttggcaatcagctaaaaacgctaggtatctcaaaaggggatcgagtggcgatcatgctagccaacagtccccaatcgattattagttactacggagcgttaatgatcggggccgtcgttgtgcaaacaaaccccttgtatgttgagcgagaactggaacatcaattagttgattcaggagcaaaagtcattgtctgtttggatctcgtgttcccaagagtgtcaaaagtaagaaaagcaacccaattagagtatgtcattgtcacaagtattaaagattatttaccatttccgaaaaacgtcctttatccatttgtccaaaaaaagcaaacaggaatgaaaattgacattacgtataatgaaaataccctttcgtttaaaaagttcctccaaggaggagtgacgacggagccatctgaggatgtctcaccaacagatgatttggccctgctccaatatacgggaggaaccacaggaccagcgaaaggggttatgctaacccatgccaatttagtcgccaacacgattcaagggctccattggatgtataaatcgaagcgtgcagaagaagtcatactctgcgtcctgccgtttttccatgtttatgggatgtccgctggtatgaacttagcgatcatgaatgcgtataaaatggtgattttaccgaaatttaacccgaaggacgttctcaaagcaattgaaaagcataaagtcactttatttccaggggcaccgacgatgtatgtaggattaattaacgatccatccatacaggactataatttaacatctgttgaagcttgtattagtggcgctgccccgcttccacttgaagtgcagcaaaaatttgaacagttgactggagggaagctagtagaagggtatgggctgacggaaacgtcccctgtagcgattgcgacaccgatttgggggaaacgaaagcaacgaagcatcggcatcccgtggccagatacagatgttatgatcatttctgcggaaacgggtgagcctgcagatgtcaacgaagtaggcgagcttgccgttcgtggtccgcaagtaatgaaaggctattggaacagaccagaagagacggcccaagtgtttaaagatgactggtttttaacaggcgatatggggtatatggacgaagatggttacttttacattgtcgatcggaaaaaagatatgatcattgctggcggcttcaacatttaccctagggaaattgaagaaattttatatgagcatgatgccattaaagaagcggttgtgatcggtgcaccagatgcttatcgcggagagacggtgaaagcatttatcgtcttaaaagaagggagatcggtctcagaagaagaattagatgcattttgtcggaaacatttagcggcatacaaagtgccacgactttatgagtttcgtgaagagctaccaaaaaccctcgtcgggaaaatattacgtcgcgtcttagtcgaagaggaaaagaaaaaggcagagcaacaaaaggtgagcaacgaataa

SEQ ID NO: 14009 - protein, 566 aa, Bacillus halodurans
MTIDRVWLKSYPKEIPHSIDYEERTLQSYLKQAAEEFPSHIAVQFLGKEMTYRELYEQAKQFGNQLKTLGISKGDRVAIMLANSPQSIISYYGALMIGAVVVQTNPLYVERELEHQLVDSGAKVIVCLDLVFPRVSKVRKATQLEYVIVTSIKDYLPFPKNVLYPFVQKKQTGMKIDITYNENTLSFKKFLQGGVTTEPSEDVSPTDDLALLQYTGGTTGPAKGVMLTHANLVANTIQGLHWMYKSKRAEEVILCVLPFFHVYGMSAGMNLAIMNAYKMVILPKFNPKDVLKAIEKHKVTLFPGAPTMYVGLINDPSIQDYNLTSVEACISGAAPLPLEVQQKFEQLTGGKLVEGYGLTETSPVAIATPIWGKRKQRSIGIPWPDTDVMIISAETGEPADVNEVGELAVRGPQVMKGYWNRPEETAQVFKDDWFLTGDMGYMDEDGYFYIVDRKKDMIIAGGFNIYPREIEEILYEHDAIKEAVVIGAPDAYRGETVKAFIVLKEGRSVSEEELDAFCRKHLAAYKVPRLYEFREELPKTLVGKILRRVLVEEEKKKAEQQKVSNE

SEQ ID NO: 14010 - DNA, 1953 bp, Halobacterium sp. NRC-1
  CDS (1)..(1953)
atggacccccgcgacgccgaacgcgagtacgacgaccacgtcatcgcacgccagacactttcacgcacgttcgaggacgccgccgaacgccacgccgacagccccgcccaggcgtacaagggcggcgtctacgaccgcagcctggcccccgaggtggtcgaccccgcgcccgacggcggcgtcgaaacgctcagctacgacgccctccgcgacatcgttcgcacgctcgccgccggcttccgggacctcggcgtcacggccggcgaccgcgtcggcgtcttcgcgcacacccgcatggagtgggcgcaatgcgacctcgccgtgctcgccgccggcggcgcggtcaccactgtctacgccagctccagcccggcgcagatcgcccacctcctcggcgacagcggcgccgtcggcgtcgtcgtcgagaacgacgccctccgccagcgcgtccgcgaggtcgaatccgacctcgacgacctcgagttcgtcgccacgatggacacccccagcgacgacacgcgcccgctgtcagcggtctacgaccgcggccgcgacgccttcgacccggacgcctaccagggctggatcgacgaccgcgatcccgacgacctggcgagcctcatctacacctccggcaccacgggaacgcccaagggcgtcgccctcacacaccggaacttccacgcgaacctcaaccagtcccggcggcgattcgggccccggcccgaccgcggcgacgcccccgcggtcaccagcgacagccgccacctctcgtttctcccgctcgcacacgtgcttgagcggctctcggggcatttcctgccgctggcgtcgggcgcgcaggtctgctacgccgaatctccggacacgctccgggaggatttcggcctcttcgaacccaccagcgccaccagcgtcccccgcgtctacgagaagctctacgacaccatccgcgagcaggccgccgactccccggtctccgagcgcgtcttcgagtgggcgacccgcgtcggccgcgccgcccacaccaccgacgaccccgggatcgggctgcgcgccgcacacgccctcgcggacacgctcgtgttctcggacatccgggacgcccttgggggggagatcgagtttttcatctccggcggcggctcgctgtccccggagctgtgtgcgctgttccacggcatggggctgcccatcctcgaaggctacggcctcaccgagaccagcccggtgctcgcggtcaacccctacgaggaccccatcgtcggcaccatcggcccgccggtcacggacaccgagctgaccgtcgacgagaccatcgccagccccgagcaacgccagcgctgtgacggcgccgccggcgagctgctcgcgcgcggcccacaagtgttcgacggctactgggggctgcccgatgccaccgacgccgcgttcgtcacccgcgagggcaaagagtggttccgcaccggcgacgtggtcgaactccgccccgacggctacgtgcggttcctcgaacgcgccaagcaactgctgaccctctcgacgggcaagaacgtcgcccccggccccatcgaggacgcgttcgccgccagcccgctggtcgcacaggccatggtcgtcggggacggccagaagttcgtctccgcgatcctggttccgaacttcgacgcggtctccgagtgggccgccagccaggagatcgcgctccccgacgaccgcgacgcgatctgccgcgacgagcgcgtccgcgcccgcatccagtcggcggtcgacgacgtcaacaccggcttcgagccctacgagcggatcaagcagttccgcctcgtcgcgaccgagttcacggaagcgaacgacctcctcacacccaccatgaagaagaaacgccaccacatccgtgaccggttcgcggacgcggtcggcgacgtctacgacgactccgaattcagcacctaa

SEQ ID NO: 14011 - protein, 650 aa, Halobacterium sp. NRC-1
MDPRDAEREYDDHVIARQTLSRTFEDAAERHADSPAQAYKGGVYDRSLAPEVVDPAPDGGVETLSYDALRDIVRTLAAGFRDLGVTAGDRVGVFAHTRMEWAQCDLAVLAAGGAVTTVYASSSPAQIAHLLGDSGAVGVVVENDALRQRVREVESDLDDLEFVATMDTPSDDTRPLSAVYDRGRDAFDPDAYQGWIDDRDPDDLASLIYTSGTTGTPKGVALTHRNFHANLNQSRRRFGPRPDRGDAPAVTSDSRHLSFLPLAHVLERLSGHFLPLASGAQVCYAESPDTLREDFGLFEPTSATSVPRVYEKLYDTIREQAADSPVSERVFEWATRVGRAAHTTDDPGIGLRAAHALADTLVFSDIRDALGGEIEFFISGGGSLSPELCALFHGMGLPILEGYGLTETSPVLAVNPYEDPIVGTIGPPVTDTELTVDETIASPEQRQRCDGAAGELLARGPQVFDGYWGLPDATDAAFVTREGKEWFRTGDVVELRPDGYVRFLERAKQLLTLSTGKNVAPGPIEDAFAASPLVAQAMVVGDGQKFVSAILVPNFDAVSEWAASQEIALPDDRDAICRDERVRARIQSAVDDVNTGFEPYERIKQFRLVATEFTEANDLLTPTMKKKRHHIRDRFADAVGDVYDDSEFST

SEQ ID NO: 14012 - DNA, 1635 bp, Arabidopsis thaliana (mouse-ear cress)
  CDS (1)..(1635)
atggagaaatccggctacggcagagacggaatttaccgatcacttcgtccaacactcgttcttcccaaagatccaaacacatcgttagtctctttcctcttccgtaactcctcatcttacccatcaaaactcgctatcgccgattccgataccggcgattccttaaccttctctcagctcaaatccgccgtcgctagactcgctcacggattccaccgtttaggtattcgcaaaaacgacgtcgtgttgattttcgctcctaactcttaccagttccctctctgtttcctcgccgtaaccgcgatcggcggcgttttcaccaccgcgaatcctctttacactgtgaatgaggtttcgaaacagatcaaagattcgaatccgaagattatcatatccgttaatcaactgtttgataagatcaaaggctttgatcttcccgttgttctacttggatctaaagacaccgtagagattcctccgggatcgaattcgaagattcttagtttcgataacgtgatggaactctcagagccagtttctgagtacccgttcgttgagattaagcaatcagatacagctgcattgttgtattcatcaggaactacaggaacaagcaaaggtgttgaattgactcatgggaatttcattgcagcttcgttaatggttactatggatcaagatcttatgggagagtatcatggcgtcttcttgtgttttcttcctatgtttcatgtttttggtttggcagtgattacttattctcagcttcagagaggaaatgctttggtttctatggcgagatttgagcttgagttggtgcttaagaatattgagaagtttagagttactcatctttgggttgttcctcctgtgttccttgctctttccaagcagagtattgtgaaaaagtttgatctttcttcacttaagtatattggttcaggagctgctcctcttggtaaagatttgatggaggaatgtggaagaaacattcctaatgttttgcttatgcagggatatggaatgactgaaacgtgtggaattgtgtctgtggaagacccgagactcgggaaacggaactctggttcagctggaatgcttgctccaggtgttgaagctcagatagtgagtgtagaaactggaaaatctcagcctccaaatcaacaaggagaaatctgggttcgaggaccaaacatgatgaaagggtacctcaataaccctcaggctactaaagaaacaatagacaaaaaaagttgggtgcataccggagatcttggatatttcaacgaagatggtaacctttatgttgttgatcgaatcaaagaacttatcaaatacaaaggcttccaggttgctccagctgaactagaaggtcttcttgtatcacatcctgatatactagatgctgtcgttatcccgttccctgatgaagaagcaggtgaagttccaattgcgtttgttgttcgatcaccaaatagctcaataacagagcaagatattcaaaagttcatagccaaacaggtcgctccttacaaaagattacgacgagtgagcttcatcagccttgttccaaaatccgctgctggtaaaatcttgagaagagaacttgttcagcaagtaagatccaagatgtga

SEQ ID NO: 14013 - protein, 544 aa, Arabidopsis thaliana (mouse-ear cress)
MEKSGYGRDGIYRSLRPTLVLPKDPNTSLVSFLFRNSSSYPSKLAIADSDTGDSLTFSQLKSAVARLAHGFHRLGIRKNDVVLIFAPNSYQFPLCFLAVTAIGGVFTTANPLYTVNEVSKQIKDSNPKIIISVNQLFDKIKGFDLPVVLLGSKDTVEIPPGSNSKILSFDNVMELSEPVSEYPFVEIKQSDTAALLYSSGTTGTSKGVELTHGNFIAASLMVTMDQDLMGEYHGVFLCFLPMFHVFGLAVITYSQLQRGNALVSMARFELELVLKNIEKFRVTHLWVVPPVFLALSKQSIVKKFDLSSLKYIGSGAAPLGKDLMEECGRNIPNVLLMQGYGMTETCGIVSVEDPRLGKRNSGSAGMLAPGVEAQIVSVETGKSQPPNQQGEIWVRGPNMMKGYLNNPQATKETIDKKSWVHTGDLGYFNEDGNLYVVDRIKELIKYKGFQVAPAELEGLLVSHPDILDAVVIPFPDEEAGEVPIAFVVRSPNSSITEQDIQKFIAKQVAPYKRLRRVSFISLVPKSAAGKILRRELVQQVRSKM

SEQ ID NO: 14014 - DNA, 1985 bp, Luciola cruciata (Genji firefly)
  CDS (50)..(1696)
gttaacttacaagtacggtttcaaagtgattataaacatttactctaaaatggaaaacatggaaaacgatgaaaatattgtagttggacctaaaccgttttaccctatcgaagagggatctgctggaacacaattacgcaaatacatggagcgatatgcaaaacttggcgcaattgcttttacaaatgcagttactggtgttgattattcttacgccgaatacttggagaaatcatgttgtctaggaaaagctttgcaaaattatggtttggttgttgatggcagaattgcgttatgcagtgaaaactgtgaagaattttttattcctgtaatagccggactgtttataggtgtaggtgttgcacccactaatgagatttacactttacgtgaactggttcacagtttaggtatctctaaaccaacaattgtatttagttctaaaaaaggcttagataaagttataacagtacagaaaacagtaactactattaaaaccattgttatactagatagcaaagttgattatcgaggatatcaatgtctggacacctttataaaaagaaacactccaccaggttttcaagcatccagtttcaaaactgtggaagttgaccgtaaagaacaagttgctcttataatgaactcttcgggttctaccggtttgccaaaaggcgtacaacttactcacgaaaatacagtcactagattttctcatgctagagatccgatttatggtaaccaagtttcaccaggcaccgctgttttaactgtcgttccattccatcatggttttggtatgttcactactctagggtatttaatttgtggttttcgtgttgtaatgttaacaaaattcgatgaagaaacatttttaaaaactctacaagattataaatgtacaagtgttattcttgtaccgaccttgtttgcaattctcaacaaaagtgaattactcaataaatacgatttgtcaaatttagttgagattgcatctggcggagcacctttatcaaaagaagttggtgaagctgttgctagacgctttaatcttcccggtgttcgtcaaggttatggtttaacagaaacaacatctgccattattattacaccagaaggagacgataaaccaggagcttctggaaaagtcgtgccgttgtttaaagcaaaagttattgatcttgataccaaaaaatctttaggtcctaacagacgtggagaagtttgtgttaaaggacctatgcttatgaaaggttatgtaaataatccagaagcaacaaaagaacttattgacgaagaaggttggctgcacaccggagatattggatattatgatgaagaaaaacatttctttattgtcgatcgtttgaagtctttaatcaaatacaaaggataccaagtaccacctgccgaattagaatccgttcttttgcaacatccatctatctttgatgctggtgttgccggcgttcctgatcctgtagctggcgagcttccaggagccgttgttgtactggaaagcggaaaaaatatgaccgaaaaagaagtaatggattatgttgcaagtcaagtttcaaatgcaaaacgtttacgtggtggtgttcgttttgtggatgaagtacctaaaggtcttactggaaaaattgacggcagagcaattagagaaatccttaagaaaccagttgctaagatgtgaattagtcagttcaatcaaaatattaaaagaaaactggttacattaaacatttgagtcattttcttatcttaagtgggattaaaatcgtttatactaatactgtattaagtagatatttagataagtttattactataaagccttatacatgttacattaaaaagtaaagtttctgtaattcgctagagtaagcgtaattatatttactcttattgtaatgggtatgtttataaaacttctgtacgttacgcaaaaattatctgtataatatacttttggtttcatcatt

SEQ ID NO: 14015 - protein, 548 aa, Luciola cruciata (Genji firefly) [sequence omitted]

SEQ ID NO: 14016 - DNA, 3634 bp, Homo sapiens (man)
  CDS (14)..(2110)
tcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacaccgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgcttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttc

SEQ ID NO: 14017 - protein, 698 aa, Homo sapiens (man)
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 14018 - DNA, 1927 bp, Petroselinum crispum (parsley)
  CDS (64)..(1698)
gaattcccatcatcgtttcaacaccaaaaacacacacacaactcatattttcatattttcataatgggagactgtgtagcacccaaagaagaccttattttccgatcgaaactccctgatatttacatcccgaaacaccttccgttacatacttattgtttcgaaaacatctcgaaagttggcgacaagtcctgtttaataaatggcgctacaggcgaaacgttcacttattctcaagttgagctcctttccaggaaagttgcatcagggttaaacaaactcggcattcaacagggcgataccatcatgcttttgctccccaactcccctgagtattttttcgctttcttaggcgcatcgtatcgtggtgcaatttctactatggccaatccgtttttcacttctgctgaggtgatcaaacagctcaaagcatccctagctaagctcataattacgcaagcttgttacgtagacaaagtgaaagactacgcagcagagaaaaatatacagatcatttgcatcgatgatgctcctcaggattgtttacatttctccaaacttatggaagctgatgaatcagaaatgcccgaggtagtgatcgattcagacgatgtcgtcgcgttaccttactcatcgggtactacaggactaccgaaaggtgttatgttgacccacaaaggacttgttactagcgtggcacaacaagttgatggagacaatccgaatttatatatgcatagcgaggatgtgatgatctgcatattgcctttgtttcatatttattcgcttaacgcggtgttgtgctgtggactcagagcaggggtgacgatcttgattatgcagaaatttgatattgtgccatttttggaactgatacagaaatataaagttacaattggaccgtttgtgccaccaattgtgttggcaattgcgaaaagtccagtggtggataaatatgacttgtcgtcggtgaggacggttatgtctggagctgctccgttagggaaggagcttgaagatgctgttagagctaagtttcctaatgccaaacttggtcagggatatggaatgacagaggcagggccagttttagcaatgtgcctggcgtttgcaaaggaaccatacgagatcaaatcgggtgcctgtggaactgttgtgaggaatgctgaaatgaaaattgtggatcctgagaccaacgcctctcttccacgaaaccaacgcggagagatttgcattcgaggtgaccaaattatgaaaggctacctcaatgatcctgaatcaacaaggacaacaatagacgaagaaggctggttgcacacaggagatataggcttcattgacgacgatgatgagctatttattgttgatagacttaaggaaataatcaaatacaaaggcttccaggttgcccctgctgaacttgaagctctgctacttactcatcctaccatttccgatgctgcagttgttcccatgatagatgagaaagcaggagaggtgcctgtggcttttgttgtgagaacaaacggtttcaccaccactgaggaagaaatcaagcaattcgtctcgaaacaggtggtgttctacaagagaatatttcgtgtattttttgttgatgcaattccgaaatcaccatctggaaagattcttcgaaaggacttgagagcaaaaatagcatccggtgatcttcccaaataagtaatctctacaaacagaaatggcataaagctgaagctgtatgtgtatctttacaaagtaaattctacctaaaagagctccgagttgtaacttgtttgtatattttattttttgaatgaaggaagatttataagatcatgtaatcactcatcaaagtttaaatatcatcatttgtatcactacattcggtttttccgatcataaacattgattttttcatgttaaaagt

SEQ ID NO: 14019 - protein, 544 aa, Petroselinum crispum (parsley)
MGDCVAPKEDLIFRSKLPDIYIPKHLPLHTYCFENISKVGDKSCLINGATGETFTYSQVELLSRKVASGLNKLGIQQGDTIMLLLPNSPEYFFAFLGASYRGAISTMANPFFTSAEVIKQLKASLAKLIITQACYVDKVKDYAAEKNIQIICIDDAPQDCLHFSKLMEADESEMPEVVIDSDDVVALPYSSGTTGLPKGVMLTHKGLVTSVAQQVDGDNPNLYMHSEDVMICILPLFHIYSLNAVLCCGLRAGVTILIMQKFDIVPFLELIQKYKVTIGPFVPPIVLAIAKSPVVDKYDLSSVRTVMSGAAPLGKELEDAVRAKFPNAKLGQGYGMTEAGPVLAMCLAFAKEPYEIKSGACGTVVRNAEMKIVDPETNASLPRNQRGEICIRGDQIMKGYLNDPESTRTTIDEEGWLHTGDIGFIDDDDELFIVDRLKEIIKYKGFQVAPAELEALLLTHPTISDAAVVPMIDEKAGEVPVAFVVRTNGFTTTEEEIKQFVSKQVVFYKRIFRVFFVDAIPKSPSGKILRKDLRAKIASGDLPK

SEQ ID NO: 14020 - DNA, 1781 bp, Luciola lateralis (Japanese firefly)
  CDS (59)..(1705)
gtggagtgtttagttacaagtgcgacttgaaaacgattaataaacctttttttaaaaaatggaaaacatggagaacgatgaaaatattgtgtatggtcctgaaccattttaccctattgaagagggatctgctggagcacaattgcgcaagtatatggatcgatatgcaaaacttggagcaattgcttttactaacgcacttaccggtgtcgattatacgtacgccgaatacttagaaaaatcatgctgtctaggagaggctttaaagaattatggtttggttgttgatggaagaattgcgttatgcagtgaaaactgtgaagaattctttattcctgtattagccggtttatttataggtgtcggtgtggctccaactaatgagatttacactctacgtgaattggttcacagtttaggcatctctaagccaacaattgtatttagttctaaaaaaggattagataaagttataactgtacaaaaaacggtaactgctattaaaaccattgttatattggacagcaaagtggattatagaggttatcaatccatggacaactttattaaaaaaaacactccacaaggtttcaaaggatcaagttttaaaactgtagaagttaaccgcaaagaacaagttgctcttataatgaactcttcgggttcaaccggtttgccaaaaggtgtgcaacttactcatgaaaatgcagtcactagattttctcacgctagagatccaatttatggaaaccaagtttcaccaggcacggctattttaactgtagtaccattccatcatggttttggtatgtttactactttaggctatctaacttgtggttttcgtattgtcatgttaacgaaatttgacgaagagacttttttaaaaacactgcaagattacaaatgttcaagcgttattcttgtaccgactttgtttgcaattcttaatagaagtgaattactcgataaatatgatttatcaaatttagttgaaattgcatctggcggagcacctttatctaaagaaattggtgaagctgttgctagacgttttaatttaccgggtgttcgtcaaggctatggtttaacagaaacaacctctgcaattattatcacaccggaaggcgatgataaaccaggtgcttctggcaaagttgtgccattatttaaagcaaaagttatcgatcttgatactaaaaaaactttgggcccgaacagacgtggagaagtttgtgtaaagggtcctatgcttatgaaaggttatgtagataatccagaagcaacaagagaaatcatagatgaagaaggttggttgcacacaggagatattgggtattacgatgaagaaaaacatttctttatcgtggatcgtttgaagtctttaatcaaatacaaaggatatcaagtaccacctgctgaattagaatctgttcttttgcaacatccaaatatttttgatgccggcgttgctggcgttccagatcctatagctggtgagcttccgggagctgttgttgtacttgaaaaaggaaaatctatgactgaaaaagaagtaatggattacgttgctagtcaagtttcaaatgcaaaacgtttgcgtggtggtgtccgttttgtggacgaagtacctaaaggtctcactggtaaaattgacggtaaagcaattagagaaatactgaagaaaccagttgctaagatgtaaatgtcaatcaatcgtttaatcaaattattaaagaaatgactacatttaatgttttactcatttttttatgttaagt

SEQ ID NO: 14021 - protein, 548 aa, Luciola lateralis (Japanese firefly)
MENMENDENIVYGPEPFYPIEEGSAGAQLRKYMDRYAKLGAIAFTNALTGVDYTYAEYLEKSCCLGEALKNYGLVVDGRIALCSENCEEFFIPVLAGLFIGVGVAPTNEIYTLRELVHSLGISKPTIVFSSKKGLDKVITVQKTVTAIKTIVILDSKVDYRGYQSMDNFIKKNTPQGFKGSSFKTVEVNRKEQVALIMNSSGSTGLPKGVQLTHENAVTRFSHARDPIYGNQVSPGTAILTVVPFHHGFGMFTTLGYLTCGFRIVMLTKFDEETFLKTLQDYKCSSVILVPTLFAILNRSELLDKYDLSNLVEIASGGAPLSKEIGEAVARRFNLPGVRQGYGLTETTSAIIITPEGDDKPGASGKVVPLFKAKVIDLDTKKTLGPNRRGEVCVKGPMLMKGYVDNPEATREIIDEEGWLHTGDIGYYDEEKHFFIVDRLKSLIKYKGYQVPPAELESVLLQHPNIFDAGVAGVPDPIAGELPGAVVVLEKGKSMTEKEVMDYVASQVSNAKRLRGGVRFVDEVPKGLTGKIDGKAIREILKKPVAKM

SEQ ID NO: 14022 - DNA, 2009 bp, Luciola mingrelica (southern Russian firefly)
  CDS (69)..(1715)
ggaattcggcacgaggttacaattacaacttcgaagtccctaaacggtagaggaaaagtttttgaaaaatggaaatggaaaaggaggagaatgttgtatatggccctctgccattctaccccattgaagaaggatcagctggaattcagttgcataagtacatgcatcaatatgccaaacttggagcaattgcttttagtaacgcccttactggagttgacatttcttaccaagaatactttgatattacatgtcgtttagctgaggccatgaaaaactttggtatgaaaccggaagaacatattgctttgtgcagtgaaaattgtgaagaatttttcatccctgtacttgctggtctttacattggggtagctgttgcacctactaatgaaatttacacattgcgtgaacttaatcatagtttgggcatcgcacaaccaactattgtattcagctccagaaaaggcttacctaaagttttagaagtgcaaaaaacagttacatgcatcaaaaaaattgttattttagatagtaaagtaaactttgggggccacgattgtatggaaacttttattaagaaacatgtagaattaggttttcaaccaagtagctttgtacccattgatgtaaagaaccgtaaacaacacgttgctttgcttatgaattcttctggctctactggtttacctaaaggtgtacgaattacccacgaaggtgcagttacaagattctcacacgctaaggatccaatttacggaaaccaagtttcacctggtactgctattttaactgtcgttccgttccatcatggatttggaatgtttaccactttaggatactttgcttgtggataccgtgttgtaatgttaacaaaatttgatgaagaactatttttgagaactttgcaagattataagtgtaccagtgttattctggtaccaacgttatttgctattctcaacaagagtgaattgatcgataagttcgatttatctaatctaactgaaattgcttctggtggagctcctttggcaaaagaagttggcgaagcagtcgctagaagatttaatctacccggtgtccgtcagggttacggattaacagaaacgacatctgcatttattattaccccagaaggtgatgataaacctggagcatctggaaaagtagtacccttattcaaagtaaaagttattgatcttgacactaaaaaaactttgggtgtcaaccgacgaggagagatctgtgtaaaaggacccagtcttatgttaggctactcgaacaatccggaagcaacaagagaaactattgatgaagagggttggttgcacacaggagatattggatattacgacgaagacgaacatttcttcattgtcgatcgtttgaaatcattaatcaaatacaaggggtaccaggtaccacctgctgaattggaatccgttcttttgcaacatccaaatatatttgatgctggtgtggctggtgtccccgatcccgatgctggcgaacttccaggggctgtagttgtaatggaaaaaggaaaaactatgactgaaaaggaaattgtggattatgttaatagtcaagtagtgaaccacaaacgtctgcgtggtggcgttcgttttgtggatgaagtacctaaaggtctaactggtaaaattgatgctaaagtaattagagaaattcttaagaaaccacaagccaagatgtaaatcagtcaaaatgctattcatgtaactaaactactcataagaagacaatttaaaattaagtcattacacacttagtgttatatctcaaaagtagtgggagtttgacatttatctcaataatttatcgaatggatgcttgtattagtttcttattgttaattatagctttaaagaacgactcctttaatatatatttacttgcattccaatggttatattgtaacgggcacgtttccctgatatgtgtgaaatatacgtcaattgcattattaaaaaaaaaaaaaaaaaaaaaaa

SEQ ID NO: 14023 - protein, 548 aa, Luciola mingrelica (southern Russian firefly)
MEMEKEENVVYGPLPFYPIEEGSAGIQLHKYMHQYAKLGAIAFSNALTGVDISYQEYFDITCRLAEAMKNFGMKPEEHIALCSENCEEFFIPVLAGLYIGVAVAPTNEIYTLRELNHSLGIAQPTIVFSSRKGLPKVLEVQKTVTCIKKIVILDSKVNFGGHDCMETFIKKHVELGFQPSSFVPIDVKNRKQHVALLMNSSGSTGLPKGVRITHEGAVTRFSHAKDPIYGNQVSPGTAILTVVPFHHGFGMFTTLGYFACGYRVVMLTKFDEELFLRTLQDYKCTSVILVPTLFAILNKSELIDKFDLSNLTEIASGGAPLAKEVGEAVARRFNLPGVRQGYGLTETTSAFIITPEGDDKPGASGKVVPLFKVKVIDLDTKKTLGVNRRGEICVKGPSLMLGYSNNPEATRETIDEEGWLHTGDIGYYDEDEHFFIVDRLKSLIKYKGYQVPPAELESVLLQHPNIFDAGVAGVPDPDAGELPGAVVVMEKGKTMTEKEIVDYVNSQVVNHKRLRGGVRFVDEVPKGLTGKIDAKVIREILKKPQAKM

SEQ ID NO: 14024 - DNA, 2085 bp, Saccharomyces cerevisiae
  CDS (1)..(2085)
atgaccgaacaatattccgttgcagttggcgaagccgccaatgagcatgaaaccgctccaagaagaaatatcagggttaaagaccagcctttgattagacccataaactcctcagcatctacactgtacgaattcgccctggaatgttttaccaagggtggtaagagagacggtatggcatggagagatattatagatatacatgagacgaaaaaaaccatagtcaagagggtggatggtaaggataagcccatcgaaaaaacatggttgtactacgaactgactccctacataaccatgacatacgaggagatgatctgcgtaatgcacgacattggacgtgggctgataaagattggtgttaaacctaacggtgagaacaagttccacatctttgcctctacttctcacaagtggatgaaaacttttcttggttgcatgtcacaaggtattcctgtggtcaccgcgtacgacactttgggtgagagcggtttgattcactccatggtggaaacagattccgtcgccattttcacggacaaccagctgttgtccaaattagcagttcctttgaaaaccgccaagaacgtaaaattcgtcattcacaacgaacccatcgatccaagtgacaaaagacaaaatggtaagctttacaaggctgccaaggatgctgttgacaaaatcaaggaagttagaccggacataaaaatctacagtttcgatgaaattattgagataggtaaaaaggccaaggacgaggttgaattgcatttccccaagcctgaagatccagcttgtatcatgtacacttctggttccactggtacaccaaagggtgtggtattgacacattacaacattgtagctggtattggtggtgtgggccataacgttatcggatggattggcccaacagaccgtattatcgcattcttgccattggctcatatttttgaattaacctttgaattcgaagcgttctactggaatggtatcctagggtacgccaatgtcaagactttaaccccaacttctacacgtaattgccaaggtgacctgatggagtttaaacctaccgtaatggtgggtgtcgccgcagtttgggaaacagtgagaaaaggtatcctggccaagatcaacgaattgcccggttggtctcaaacgcttttctggactgtctatgctttgaaagagagaaatataccatgtagcggcttgctgagtgggttgatcttcaagagaatcagagaagcaaccggtggaaacttaaggtttattctgaacggtgggtctgcaatcagcatagacgcccaaaaattcctctccaaccttctatgtcctatgctcattggatatgggctaactgagggtgtggctaatgcctgtgtcctggagcctgaacattttgattacggtattgctggtgaccttgtcggaactattacagctaaattggtggatgtcgaagatttgggctattttgccaagaataatcaaggtgaattgctgtttaagggtgcacccatctgttctgaatactataagaatcctgaagaaactgctgcggcctttaccgatgatggctggttccgtaccggtgatatcgctgaatggacccccaagggacaagttaagatcattgatagaaagaaaaatttggttaagaccttaaatggtgagtacattgcattggaaaaattagaatccatttacagatcaaatccttacgtccaaaacatctgtgtctacgctgatgaaaacaaagttaagcctgtcggtattgtggtccctaacttaggacacttgtctaagctggctatcgaattaggtataatggtaccaggtgaagatgtcgaaagctatatccatgaaaagaagctacaggatgccgtttgcaaagatatgctgtcaactgccaaatctcaaggcttgaatggtattgaattattatgtggcattgttttctttgaagaagaatggactccagaaaatggccttgttacatccgcccaaaaattaaagagaagagatattctagcggctgtcaagccagatgtggaaagagtttataaagaaaacacttaa

SEQ ID NO: 14025 - protein, 694 aa, Saccharomyces cerevisiae
MTEQYSVAVGEAANEHETAPRRNIRVKDQPLIRPINSSASTLYEFALECFTKGGKRDGMAWRDIIDIHETKKTIVKRVDGKDKPIEKTWLYYELTPYITMTYEEMICVMHDIGRGLIKIGVKPNGENKFHIFASTSHKWMKTFLGCMSQGIPVVTAYDTLGESGLIHSMVETDSVAIFTDNQLLSKLAVPLKTAKNVKFVIHNEPIDPSDKRQNGKLYKAAKDAVDKIKEVRPDIKIYSFDEIIEIGKKAKDEVELHFPKPEDPACIMYTSGSTGTPKGVVLTHYNIVAGIGGVGHNVIGWIGPTDRIIAFLPLAHIFELTFEFEAFYWNGILGYANVKTLTPTSTRNCQGDLMEFKPTVMVGVAAVWETVRKGILAKINELPGWSQTLFWTVYALKERNIPCSGLLSGLIFKRIREATGGNLRFILNGGSAISIDAQKFLSNLLCPMLIGYGLTEGVANACVLEPEHFDYGIAGDLVGTITAKLVDVEDLGYFAKNNQGELLFKGAPICSEYYKNPEETAAAFTDDGWFRTGDIAEWTPKGQVKIIDRKKNLVKTLNGEYIALEKLESIYRSNPYVQNICVYADENKVKPVGIVVPNLGHLSKLAIELGIMVPGEDVESYIHEKKLQDAVCKDMLSTAKSQGLNGIELLCGIVFFEEEWTPENGLVTSAQKLKRRDILAAVKPDVERVYKENT

SEQ ID NO: 14026 - DNA, 2029 bp, Arabidopsis thaliana (mouse-ear cress)
  CDS (89)..(1774)
aggccaaagcctaaaattcacacaaccaaaaaaaccaaccttttttttccacctaaatctttgaatatcacaatatttactatttacaatggcgccacaagaacaagcagtttctcaggtgatggagaaacagagcaacaacaacaacagtgacgtcattttccgatcaaagttaccggatatttacatcccgaaccacctatctctccacgactacatcttccaaaacatctccgaattcgccactaagccttgcctaatcaacggaccaaccggccacgtgtacacttactccgacgtccacgtcatctcccgccaaatcgccgccaattttcacaaactcggcgttaaccaaaacgacgtcgtcatgctcctcctcccaaactgtcccgaattcgtcctctctttcctcgccgcctccttccgcggcgcaaccgccaccgccgcaaaccctttcttcactccggcggagatagctaaacaagccaaagcctccaacaccaaactcataatcaccgaagctcgttacgtcgacaaaatcaaaccacttcaaaacgacgacggagtagtcatcgtctgcatcgacgacaacgaatccgtgccaatccctgaaggctgcctccgcttcaccgagttgactcagtcgacaaccgaggcatcagaagtcatcgactcggtggagatttcaccggacgacgtggtggcactaccttactcctctggcacgacgggattaccaaaaggagtgatgctgactcacaagggactagtcacgagcgttgctcagcaagtcgacggcgagaacccgaatctttatttccacagcgatgacgtcatactctgtgttttgcccatgtttcatatctacgctttgaactcgatcatgttgtgtggtcttagagttggtgcggcgattctgataatgccgaagtttgagatcaatctgctattggagctgatccagaggtgtaaagtgacggtggctccgatggttccgccgattgtgttggccattgcgaagtcttcggagacggagaagtatgatttgagctcgataagagtggtgaaatctggtgctgctcctcttggtaaagaacttgaagatgccgttaatgccaagtttcctaatgccaaactcggtcagggatacggaatgacggaagcaggtccagtgctagcaatgtcgttaggttttgcaaaggaaccttttccggttaagtcaggagcttgtggtactgttgtaagaaatgctgagatgaaaatagttgatccagacaccggagattctctttcgaggaatcaacccggtgagatttgtattcgtggtcaccagatcatgaaaggttacctcaacaatccggcagctacagcagagaccattgataaagacggttggcttcatactggagatattggattgatcgatgacgatgacgagcttttcatcgttgatcgattgaaagaacttatcaagtataaaggttttcaggtagctccggctgagctagaggctttgctcatcggtcatcctgacattactgatgttgctgttgtcgcaatgaaagaagaagcagctggtgaagttcctgttgcatttgtggtgaaatcgaaggattcggagttatcagaagatgatgtgaagcaattcgtgtcgaaacaggttgtgttttacaagagaatcaacaaagtgttcttcactgaatccattcctaaagctccatcagggaagatattgaggaaagatctgagggcaaaactagcaaatggattgtgatggatgatttcaaccaaaaagcaaaagatgatttcaatgtgtatatacatacaactgtttgacccaaccaaggaaacaaactcatacgaaccattgtcttttgttgttgttgttgttgttgttgttgctgttcttgcttgattcatgtaatgagcctttgtgatgaaggtggtttcttttttggtttcctatcatgtaacttgtgctggagaaaacagcacacctttttcatataataataaatttactcggatt

SEQ ID NO: 14027 - protein, 561 aa, Arabidopsis thaliana (mouse-ear cress)
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVAMKEEAAGEVPVAFVVKSKDSELSEDDVKQFVSKQVVFYKRINKVFFTESIPKAPSGKILRKDLRAKLANGL

SEQ ID NO: 14028 - DNA, 2484 bp, Mycobacterium leprae
  CDS (1)..(2484)
atgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgtcgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcagcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatag

SEQ ID NO: 14029 - protein, 827 aa, Mycobacterium leprae
MSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTVASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAATRHRGAHRPVDRRYRLPGALLGPEMARTDGPGRREGNRSGKSQVQRGRSGPARQDLR

SEQ ID NO: 14030 - DNA, 2091 bp, Synechocystis sp
  CDS (1)..(2091)
atggacagtggccatggcgctcaatccaggataaagcttggtcagactgggtataaactgtcaacatatttctgcaagagtgggcccaattgggaaaatcaacctcaaatccattggaatagccttttttcaaccgtaaaaatccaactttctctcttcccttcttccttccatctgattatggttacgccaattaactaccattccatccattgcctggcggatatctgggctatcaccggagaaaattttgccgatattgtggccctcaacgatcgccatagtcatccccccgtaactttaacctatgcccaattgcgggaagaaattacagcttttgccgctggcctacagagtttaggagttaccccccatcaacacctggccattttcgccgacaacagcccccggtggtttatcgccgatcaaggcagtatgttggctggagccgtcaacgccgtccgttctgcccaagcagagcgccaggaattactctacatcctagaagacagcaacagccgtactttaatcgcagaaaatcggcaaaccctaagcaaattggccctagatggcgaaaccattgacctgaaactaatcatcctcctcaccgatgaagaagtggcagaggacagcgccattccccaatataactttgcccaggtcatggccctaggggccggcaaaatccccactcccgttccccgccaggaagaagatttagccaccctgatctacacctccggcaccacaggacaacccaaaggggtgatgctcagccacggtaatttattgcaccaagtacgggaattggattcggtgattattccccgccccggcgatcaggtgttgagcattttgccctgttggcactccctagaaagaagcgccgaatattttcttctttcccggggctgcacgatgaactacaccagcattcgccatttcaagggggatgtgaaggacattaaaccccatcacattgtcggtgtgccccggctgtgggaatccctctacgaaggggtacaaaaaacgttccgggaaaagtcccctgggcaacaaaagctaattaatttctttttcggcatttcccaaaaatatattttggccaaacgcattgccaataacctgagcttgaaccatctccacgcttcggcgatcgccaggttggtggcccggtgccaagccttggtgcttagtcctctccattacctcggggacaaaattgtctaccataaggtacgccaggccgctgggggcagactggaaactctcatttccggaggaggggcgttagctagacatttagatgatttttacgaaatcaccagcattcccgtcctggtgggctatggcttaacggaaacggccccagtaactaatgccagggtgcataaacataatttgcgctattcctctggccgccccattcctttcacagaaattcgtattgttgacatggaaaccaaggaggatttgccccccgaaacccaaggtcttgtgctaatccgtggtccccaggtgatgcagggctattacaacaagccggaagccaccgccaaagttttagaccaggaaggctggttcgacagcggtgacttaggctgggtaacgccccaaaatgatttgattctcaccggtcgggccaaggacaccattgtgctcagtaacggggaaaatgtggaaccccaacccattgaagatgcctgtttacgcagtgcctacattgaccagattatgctggtgggccaggatcaaaaatccttgggggctttgattgtgcccaacttcgatgcattgcaaaaatgggcagagacgaaaaatttacaaatcaccgtgccggaaccgtcggctagcagtgaagggatgcaggctagtggtttgtatgacccccaagtggtggggttaatgcggtcggagttgcatcgggaagtgcgcgatcgccctggctaccgagccgatgaccagattaaggatttccgttttatcccagcaccattttccctggaaaacggcatgatgacccaaaccttgaagctcaaacgaccagtggtaacccaaacttatcaacatttaattgacgaaatgttttaa

SEQ ID NO: 14031 - protein, 696 aa, Synechocystis sp
MDSGHGAQSRIKLGQTGYKLSTYFCKSGPNWENQPQIHWNSLFSTVKIQLSLFPSSFHLIMVTPINYHSIHCLADIWAITGENFADIVALNDRHSHPPVTLTYAQLREEITAFAAGLQSLGVTPHQHLAIFADNSPRWFIADQGSMLAGAVNAVRSAQAERQELLYILEDSNSRTLIAENRQTLSKLALDGETIDLKLIILLTDEEVAEDSAIPQYNFAQVMALGAGKIPTPVPRQEEDLATLIYTSGTTGQPKGVMLSHGNLLHQVRELDSVIIPRPGDQVLSILPCWHSLERSAEYFLLSRGCTMNYTSIRHFKGDVKDIKPHHIVGVPRLWESLYEGVQKTFREKSPGQQKLINFFFGISQKYILAKRIANNLSLNHLHASAIARLVARCQALVLSPLHYLGDKIVYHKVRQAAGGRLETLISGGGALARHLDDFYEITSIPVLVGYGLTETAPVTNARVHKHNLRYSSGRPIPFTEIRIVDMETKEDLPPETQGLVLIRGPQVMQGYYNKPEATAKVLDQEGWFDSGDLGWVTPQNDLILTGRAKDTIVLSNGENVEPQPIEDACLRSAYIDQIMLVGQDQKSLGALIVPNFDALQKWAETKNLQITVPEPSASSEGMQASGLYDPQVVGLMRSELHREVRDRPGYRADDQIKDFRFIPAPFSLENGMMTQTLKLKRPVVTQTYQHLIDEMF

SEQ ID NO: 14032 - DNA, 2097 bp, Leishmania major
  CDS (1)..(2097)
atgggcggctgtgtcgtgtcattgatggagtgcaaggcccgcagcaatgaggtgccgtgggagctctccgaggacgtgaagagctacggccccttgagtgtggccgtcgccggcacacaaacccccaacagctccgccgtgtacgtgaacggcaagcagtccacgctggcggcacagcaggagtgtgggaaacaattctactacggccctaaccagccacagcgttttgcgaagctatgccaggagaacctcgacagtgttgccctggcgtaccgccgcatcgagaagatggaaaaggagcaggtggcgggtgcatcgcggccgatggacgttgcgtacttctccgagcaatgtaacctcacgtaccgggagctgtggcatgccgtgaccggcttcagccgcggcctcgccgagctcgggctcgagaagcgcgtcaacgtgaccatctacgaggagacgcgctgggagtggctggcgtctatctacggcatctggatgcaggacatggtcgccgccaccgtctacgccaacctcggcgagggcgctctcttccacgcactgcgcgagacggagtgcaaggcgattctgtgcaacggcaagagcgtgccgaacctgctgcgcggcgtcggcagtggtgccttccctgcgtgcacgctcatctacttggacaatctgccggttgccgggtgcgcggagctgcacgggtgccgcgtagtgtcgtggaaggacgtggtcgcgctgggccacggcgcgggtgcgcaccacggtgccgcgccaccggaggacaacgaatcggtggcactgatcatgtacacgagcggcacgaccggtgacccgaagggcgtcatgcacacgcacggcagcatcgtcgccggcatcctcaccatggacgactggctctacagcgttatcaagcacagaccggatgatgtctacctctcctacctgcccatggcgcacatcatggagttcggtgtggtgaacatcctcctcgcccgccgcgcccacgtcgcgttcggcaccccgcgcacgctgacggacgccacggcacggccgcacggcgactttacccacttccgcccaacgctgctcatcggcgtaccgcgcatcttcgacacgctcaagaaggccgtcgaggcgaagctgccgccggtgggcacgctcaagcgacaggtgttcgaccacgcctaccagagccggctggcggcgctgaaggagggcaaggacacgccgttctggaacgagaaggtgttcagtcagccacgcgcggctctgggaggtcgcgtgcgggcctttctcagcggcggcggcccgctgtccgagaccacgcaggagttcgtgaacgtggtctttgggtgcatcgtcaacggctggggcctcacggagacggtgtgcatcggtgccattcaacggctgggtgacctgacgccgtctgccgtaggccaggtgctctgttcggaacagctgaagctgcgcgacattgacgagtacaagcacacggacacgccgtatccgcgcggcgagatctgcctgcgcggcccgttcctgttcaagggctactacaagcagccggagctgacgcgcgaggtgctggacgaggatggctggttccacaccggcgacgttggcagcatcgactgcgaaggtcgcgtctccatagtggggcgcatcaaggcgctggcgaagaactgcctgggcgagtacatcgcgctggaggtgctcgaggcggtctacagcagccacccgctggtcctgcataactgtgtgtgtgtgttggtggacccgtgcaagaactacatctgcgctctcgtgctcacagacgagagccacgtgatgcgcttcgcgaaggcgaacgggatcgagggcgagtacccatccctgctagagaagaaggagctgctggagaaagctgccgcgtcgatggcggagacagcccgcgcggcgcggcgccgcgacttcgaggttgtgcgccgtgtttcccttatcgatgacgagtggtcgccggagaagggccagctaacggcggcgctgaagctgaggcgaggcgctatcgctaaacagtatgaaaagcaaatcacatgcttgttcgcggagtga

SEQ ID NO: 14033 - protein, 698 aa, Leishmania major
MGGCVVSLMECKARSNEVPWELSEDVKSYGPLSVAVAGTQTPNSSAVYVNGKQSTLAAQQECGKQFYYGPNQPQRFAKLCQENLDSVALAYRRIEKMEKEQVAGASRPMDVAYFSEQCNLTYRELWHAVTGFSRGLAELGLEKRVNVTIYEETRWEWLASIYGIWMQDMVAATVYANLGEGALFHALRETECKAILCNGKSVPNLLRGVGSGAFPACTLIYLDNLPVAGCAELHGCRVVSWKDVVALGHGAGAHHGAAPPEDNESVALIMYTSGTTGDPKGVMHTHGSIVAGILTMDDWLYSVIKHRPDDVYLSYLPMAHIMEFGVVNILLARRAHVAFGTPRTLTDATARPHGDFTHFRPTLLIGVPRIFDTLKKAVEAKLPPVGTLKRQVFDHAYQSRLAALKEGKDTPFWNEKVFSQPRAALGGRVRAFLSGGGPLSETTQEFVNVVFGCIVNGWGLTETVCIGAIQRLGDLTPSAVGQVLCSEQLKLRDIDEYKHTDTPYPRGEICLRGPFLFKGYYKQPELTREVLDEDGWFHTGDVGSIDCEGRVSIVGRIKALAKNCLGEYIALEVLEAVYSSHPLVLHNCVCVLVDPCKNYICALVLTDESHVMRFAKANGIEGEYPSLLEKKELLEKAAASMAETARAARRRDFEVVRRVSLIDDEWSPEKGQLTAALKLRRGAIAKQYEKQITCLFAE

SEQ ID NO: 14034 - DNA, 2124 bp, Leishmania major
  CDS (1)..(2124)
atggacatcccctctcactgcagcagcctggaggcaacggtgctccagctgatggacgacgccaacgcgcgccgcgtcgtgccggaccctcgcgcaatgcgctaccagcagctaggcgacgagaacgtcgccctcgaaggcaccgagagcgagaacagcacgccgatctaccgccaggcgaaggtgacggacgcgatgcagcgccgcctggaaaacgagtggtacaacgggcccaacttcgtgcaatgcttcgagtccatgtgcaagtcgcgtggcagcaagcgtgcgctggcctaccgcccgataagtcgcgtgtcgcatcagctggtgagggagccggagagcgggctggagcggttgtttgaggtgacatgttacgatgcgacgcagtacttgacgtatgatgatgtgtggacggtcgtgcagaactttggccgtggcctgcgcgagctcgcactcactcctggctgcaaggtcggcatgtacctcgagacgcgctgggagtggctggcgtcggcgtacggcgtgtggtcgcagagcatggtgctcgccacggtgtacgcgaacctcggcaaggaggcgctcagcgaggccttcgcggagacgagctgcgccgccatcgtggcagtgggcgagcgtgtgccgtcgctgatcgccatgatgcggagcggtgcgatgccgcactgcatcctgatctacctcgacacgctgccggagggcatcgatgcgacgggcgtgacgctgaaggcgtgggaagacgtcgtgagggacggcgctctctccagctaccccctcaacctgccgacaaacaacgatgacgtgtccctgatcatgtacacgagcggcacgacgggcgggccgaagggcgtcatgcacacgtacggctcgatgaccgcgggcatcaacggcatgggtggccgcctgaacgagctgtgcggcggcgttgagcccgatgaacgctactgctcctccctgccgctggctcacatcttcgagttcacggtcacgaacgtcttccttgcgcgcggctgctggatcggatttggccacacccgcacactgttgagcacgtacgcacgtccacacggcgacctcgtcgagttcaagccaatcttcttgattggtgtgccacgcatcttcgactcctacaagaagatgatggagacgagcctggcacagcgcggcgtgctggagcgcaaggtctttgagcacgccttcgcctcccgcctcaagtaccttcacgccggcatggagacgccgttctggaacgaggtggtcttcgccccgctgcgcgagatggtgggcggtcgcgtgcgcagcatgttcggaggcggtggcccgatcagtgcaccaacgcagaacttcatgaacgtcgtccttggcgggttcatccagggctacggactcaccgaaaccgtcggcaacgggccgaagcagctcgtcggcgacctcgagcccgcgtgtgtcggtcggctggagatggcctgcgagatgaagctggtggacacgccagactacaagcacacggacacgccggagccgcgcggtgaggtgtgcctgcgcggtcccatgctcttcaagggctattacaagaaggaaagcatcaccaaggccgccatcgacgctgacggctggttccacaccggcgatgttggcgccatcgccgaccgcggtcgactgcgcatcgttagccgcatcaagtcactggccaagaacgccctaggtgagtacatcccgatggagagcctggagtccctgtacgcacaggtgagcctgtgcgtgccgaacggcgtgtgcgtcgttgtccactctgccaagtactacgtctgtgccatcgcgtgcacgacggagagcaaggcgatggtgttcgcgcggcagcacgacatccagtgtgagtggccggcgattctgaagaaccccgactttcagaaggcagcgacggaggcgttccgcgagctcgccataaacgcgggccgtggcaagcaggagattgtacgctacgtccacgtcgtgggggatcagtggacgccggagaacgatatgctcacggcggctggcaagctgaagcgccacgcagtcgcggagcgctacaaggacctgatctgctccctgtacgttgactag

SEQ ID NO: 14035 - protein, 707 aa, Leishmania major
MDIPSHCSSLEATVLQLMDDANARRVVPDPRAMRYQQLGDENVALEGTESENSTPIYRQAKVTDAMQRRLENEWYNGPNFVQCFESMCKSRGSKRALAYRPISRVSHQLVREPESGLERLFEVTCYDATQYLTYDDVWTVVQNFGRGLRELALTPGCKVGMYLETRWEWLASAYGVWSQSMVLATVYANLGKEALSEAFAETSCAAIVAVGERVPSLIAMMRSGAMPHCILIYLDTLPEGIDATGVTLKAWEDVVRDGALSSYPLNLPTNNDDVSLIMYTSGTTGGPKGVMHTYGSMTAGINGMGGRLNELCGGVEPDERYCSSLPLAHIFEFTVTNVFLARGCWIGFGHTRTLLSTYARPHGDLVEFKPIFLIGVPRIFDSYKKMMETSLAQRGVLERKVFEHAFASRLKYLHAGMETPFWNEVVFAPLREMVGGRVRSMFGGGGPISAPTQNFMNVVLGGFIQGYGLTETVGNGPKQLVGDLEPACVGRLEMACEMKLVDTPDYKHTDTPEPRGEVCLRGPMLFKGYYKKESITKAAIDADGWFHTGDVGAIADRGRLRIVSRIKSLAKNALGEYIPMESLESLYAQVSLCVPNGVCVVVHSAKYYVCAIACTTESKAMVFARQHDIQCEWPAILKNPDFQKAATEAFRELAINAGRGKQEIVRYVHVVGDQWTPENDMLTAAGKLKRHAVAERYKDLICSLYVD

SEQ ID NO: 14036 - DNA, 2148 bp, Leishmania major
  CDS (1)..(2148)
atgggcgggtgcgtggtctctgtgatggcgaagcgcaacgcggcgcaagtgatgcccgacccgcgcgccgaggcgctcgagcgccggcgtgcccagtgcggtggcaattttgtgcaacgcgtgcccggcacggagagcgagcacgcctcagccatctaccgcatcgctggagtgacagcggagcaacacgaagccatcctcgcggcggccgcggcgaggcccaccttttacaccacgctgatgcgtcactgcgcggagcgcacggaccagcgcgtgcttggctaccgccccgtgaagtgcgtcacaaaggagccggcgccgtcgaagtcaagcggcagcacgagcgagccagcgaagaaggagcggctcatgagcatcacacacttcgacgaggtggtgcacgtcacctactcagaaatggaggagcgcatcttccacttcggcgccggcctggccgccctcggcgtcaccgccaacggaaacgtttcaatctacctcgacacgtgcgtcgagtggctgatcggcatctacggcatctggtcctgcagcgccgtcgccgccaccgtctacgccaacctcggcgaggcggccctggcgcacgcgctgcacgagacggagagccaggcgattctgtgcgggtcggtgaatgtggcgaatgtgctgaagctgatgaagaacggggtcatgccgcaggtgccgatcatccacgtcggcgccctgcccgcgtcgctcgacacgcacggcgtgcaggtggtgagcttcaagcaggtggagatgatcggcgcggcacacctcgagggtggtgcggcgaagggcacggggccgttgaacgacgacgacctggcattgatcatgtacacgagcggcacgaccggtgacccgaagggcgtcatgcacacgcaccgcacgttggctgctggcctgcacaccctcgagccgcgcgtgatcgacctgctcggccagccgcgccccgacgacgtgtacctctcctacctgcccatggcgcacatcatggagttcaccatcacaaacctgttcatcttccgcggtgcctttatcggcttcggcacgccgcgcacgctgacggacaccacggcacggccgcacggcgacctgcttacgttcaacccgtccatgctcgccggcgtaccgcgcatcttcgacacgctcaagaaggccgtcgaggcgaagctgccgccggtgggcacgctcaagcgacaggtgttcgaccacgcctaccagagccggctggcggcgatgaaggagggcaaggacacgccgttctggaacgagaaggtgttcgcggcgccgcgtgccgtgctcggcagccgcctacggatcatgctcagcggcggcggcccgctgtccgccgcgacgcatgaatttgtgaacgtggtctttggccgcgtggtgattggctacgggctcacggagacgatctgcgtcggggcgattcagatccccggtgacacggagacgaacgtgacgggcttgatggagcctggccaggagatcaagctgctcgacattgacgagtacaagcacacggacacgcccgagccgcgcggcgagatgctgtcacgcgggccgtacctgttcaagggctactacaagcagccggagctgacgcgcgaggtgctggacgaggatggctggttccacaccggcgacgttggcagctttaccgcggacggcaagatgcgtattgtcggccgcgtcaaggcgctggcgaagaactgcctgggcgagtacatcgcgctggaggcgctcgaggcggtctactctagcaacgaactgctgcagccaaacggcgtgtgcgtcctcgtgcacccggacaagccgtacatcacggctctggcgctgacggacgaggcgcgtgcaacgagcttcgcggcgaagcacggtatcgagggtacgtaccctgccctgctgaaggaccagcgcttccagcaggcggccgcgatttcgatggccgacacggcacgcgcctcgaaccgcgcgtccttcgagtgcgtgaagcgcgtgcgcgtgatcgacgacgagtggaccccggagaacgagatcttgacagctgcccagaagctgaagcgccgcgtcatcgatgcgcagtacgcacagacgatcgcagagctcttcgcggatgattag

SEQ ID NO: 14037 - protein, 715 aa, Leishmania major
MGGCVVSVMAKRNAAQVMPDPRAEALERRRAQCGGNFVQRVPGTESEHASAIYRIAGVTAEQHEAILAAAAARPTFYTTLMRHCAERTDQRVLGYRPVKCVTKEPAPSKSSGSTSEPAKKERLMSITHFDEVVHVTYSEMEERIFHFGAGLAALGVTANGNVSIYLDTCVEWLIGIYGIWSCSAVAATVYANLGEAALAHALHETESQAILCGSVNVANVLKLMKNGVMPQVPIIHVGALPASLDTHGVQVVSFKQVEMIGAAHLEGGAAKGTGPLNDDDLALIMYTSGTTGDPKGVMHTHRTLAAGLHTLEPRVIDLLGQPRPDDVYLSYLPMAHIMEFTITNLFIFRGAFIGFGTPRTLTDTTARPHGDLLTFNPSMLAGVPRIFDTLKKAVEAKLPPVGTLKRQVFDHAYQSRLAAMKEGKDTPFWNEKVFAAPRAVLGSRLRIMLSGGGPLSAATHEFVNVVFGRVVIGYGLTETICVGAIQIPGDTETNVTGLMEPGQEIKLLDIDEYKHTDTPEPRGEMLSRGPYLFKGYYKQPELTREVLDEDGWFHTGDVGSFTADGKMRIVGRVKALAKNCLGEYIALEALEAVYSSNELLQPNGVCVLVHPDKPYITALALTDEARATSFAAKHGIEGTYPALLKDQRFQQAAAISMADTARASNRASFECVKRVRVIDDEWTPENEILTAAQKLKRRVIDAQYAQTIAELFADD

SEQ ID NO: 14038 - DNA, 8172 bp, Streptomyces hygroscopicus
  CDS (1)..(8172)
atgctccgtcgcgagctgatccggccgttgcccgagctgctgaaagcgcacgcggcccgcaggggaagccagaccgcgttcgccgactcgaggcgtggcgtcagctacgcccagttggaagcccgcacccgtcgactggccggacacctcgcccaactgcggctgctgcccggcgaccgggccgccatctacctgggcaactgcgtcgagaccattgagagctatctggccatcgcgcgcgccagcgcgatcggtgtgcccatcaacccgcactcctccaccgccgagctcgcctatctgctcgacgacagcgcggcccgggtcatcgtcaccgaccacacccggctgccccaggtgcgccggctccaggcggaacggccgcatctgaccgtggtggtgaccggcgacgaggaaagcggcgcggtgccgttcgacgcgctcgccgagaccgaaccgcagcagcccgcccgcgacgacctcgggctggacgacatcgcctggatgctctacacctccggcaccaccggccggcccaagggcgtactgtccacccagcgcagctgcctgtggtcggtggccgcctcgtccgccggtgtgctggggctctccgagaccgaccgagtgctgtggccggtgccgctgttccacagcctggcacacatctactgcgtgctcagcgtgaccgcggtcggcgcgaccgcgcggatcaccgaggcgttcgacgccgaggaactgctgcacacgctgcgcgccgaggagttcaccttcctggccggtgtgccgaccatgtaccactatctgctggacgccgcccgggacggcgacctgtcgctgccgaacctgcgggtgtgcctgtcggccggcgcgatcagcaccgcgacgctgcgcgccgagttccaggagactttcggcgtcccgctgctcgactgctacggcagcaccgagacctgcggcctgatcaccgccaactggccgaacgggacccaggccgagggctcctgcggactgccggtgcccggcctgaccgtacggatcgtcgacccggagacccacgagagtgtcgagaccggcgaggagggcgagatatgggtcggcgggcccagcctgatggtcggctaccacaaccagccggaggccaccgaggcggcgctgccccgcggctggtaccgcaccggtgacctcggccgccgcgacgacctcggctaccacaccatcaccgggcggctcagcgagctgatcatccgcagcggggagaacatccacccgaccgaggttgagcaggtgctgctgcgagtgccgggcgtgaccgacgcggccgtcgtcggctcggcccaccccaccctcggcgaggtgccggtcgcgttcctcgtgccggccgcggacggcttcgacccggacgaggtgttcgccgcctgccgcgagcacctggcgtacttcaaggtgccggaggagctgtacgaaatcggttccataccgcgcaccgggtccgggaagatcaagcggcacgcgctggcgcagagcccggcccggctgcgggcggtgagctccgggtcgttcgagtcgctgttccgcctggagtggacggcgcccgtgccggaggctgggcctgttgacggcgaccaggcgacgtccgcgcatcgggccggtggcagcgtgacggcgggcctcgaagcgcccgggtcggcggtcgtggactgcccgcgcggctccctcgacgaggtgctgcgcgcggtgcggaccgggctgaccgaccggtccggccgggtggccgtgctgacccacggtgcggaccacgacccggcgcaggccgcggtctgggggctggtggagtcgatgcgggcggacgcgccgcacgacgcgccggtgctggtggacgccgacggcggcgaggcgaccgccgcgctgtcggccgtcctggcgtccgggcagccacgggcgctggtgcgcggcggcgaggtgctggtcccccggctggcacgggcggggagcgggcagcgggtgagccggccggaccctgacggcaccgtgctggtctttggcgcggaccaggagcaggccgccgagctcgccgggcacctggtcgccgcgtacggcatacggcatgtgcggctgctcgcccgcacggccgtaccggacctggtcgcgcgcctgaccgagctgggtgcgtccgtgactcagacggtccgcgcgcccggcgaccgggcatcgctggcggaggcgttccagacggccgggccgccggtcacggccgtattgcaagtggccggtccggagacgctgccgaccacgctcaccggcgaggtcgaactcggtccgctccaggacgcgctggccctggacgagctcacccgggaggcgcacccggcactgttcgtcctctcggcaccgatcgacaacggcccggcgcacgcggtcttccaggcggtggccaaccgtcggcacgccgcggggctgcccgcgctggccctcagctgggggccgcgcgaggagctgacgtctcgggagcggctcgccctgttcgacgcggcgaccacggtggacgacgcatcggtgctggccatacggcatgaactggccgcatcggccgtcgacaccggcgccgccgggcggctggcccggctccccgcggcggagcgcggccgtgccctgctcgacctggtgctgtccgaggtcggcgtgatcaccggcggccggccggtacacgaccgacagtcgttccgcgacatcggcatgacgtccaccagcgccgtggagctgcgcggccgactggcggcggcgaccggtctggcgctgcccgccacactcgccttcgactaccccaaccccgacgccctggcggcctacctcggcggccggctgttcggcgacacatccgcggcgggccccgacacggagccgacggaccccgccgctccatccggtgagccgatcgcgatcgtcgggatggcctgccggctgccgggcggtgtgacctcacccgaggagctgtgggaactgctgtcctcaggcggcgacggcatctccggcttcccgaccgaccgcggctgggacctggaacacctctaccaccccgacccggaccacccgggcacctcctacgtccgcgaaggcggcttcctccacgacgcaggcgacttcgacgccgccctcttcggcatctcgccacgcgaagcactcgccatggacccgcagcaacgactgctgctggaaaccacctgggaggtgctggaacgagcgggcatcgatcccacctcactccgcggcagccgcaccggcgtcttcgccggcgtcatgtaccacgactacatctcacgcctgcgcactgtgccaccggagttggagggctatctgagcagtggtggctcggggagcgtggtgtcgggccgggtgtcttacacgttcggattcgagggaccggccgtgtccgtcgacaccgcctgctcctcctccctggtcgccctgcacctcgccgtccaggcactacgcaccggcgaatgcaccctcgccgtcgccggcggcgtcaccgtcatggcctccccctcctcctacatcgaattcagccgccaacgcggcctctcccccgacggacgctgcaaatccttcgccgccgacgccgacggcgccgcctggtccgaaggcgccgccaccctcctcgtcgagcggctgtcggacgcgcagcggctcgggcatccggtgctgggggtggtgcgcggcaccgccgtcaaccaggacggcgcctccaacggcctcaccgctcccaacggaccctcccaacaacgcgtcatccgcgacgcactcaccaacgcccaactgaccgcaaccgacatcgacctcatcgaggcacacggcaccggcaccaaactcggcgacccgatcgaagcccaggcggtgctggcgatgtacggacaggaccgtgacctgccggtgtggcttgggtcgttgaagtccaacatcgggcacacccaggccgccgccggggtagcaggtgtgatgaaggcggtcctgtcgatgcggcacggggtgatgccgaagagcctgcatatcgacgagccgaccccggaggtcgactggtcggcgggtacggtcgagctactggccgaggcccgggactggccgggcgcggacgaacgcccccgacgcgcgggcgtgtcctcgttcggggtcagcggcaccaacgcgcacgtcatcctcgaacaggcgccgcccgcgcccgagccgacggagtcggcggagcccgtcgagccttccgaggcggccgggccctccggccccgtcgggcttgagctgggaccctccggtccggtgccgtgggtgctctccgcacagaacgaaaccgcgctgaaggacctggcccgtcaactggtgacggaaaccgaaggcacggtgcaccagatcgcgcattccctcatcacccaacgatccaccacactcccccaccgcgccgtcctcgtgggctccacccgcgaggaattcgccaccgcgctggaacagatcacccggcacacacccgacggcgggaagacagtcctcgtcttccccggacagggttcgcagtgggtcggcatgggacaacgcctctgggaaacctcacccctctaccgcgacaccatccacgaaatcgacacagccctgtccgaatacatcgactggtccgtcaccgacatcctcaccagccaacccggagcacccacctgggaccgcgtcgatgtgatccagccagttctgttcaccaccatgaccgccctcgccaccctctggcaacaccacggcctcacccccgacgccatcatcggccactcacaaggcgaaatcgccgccgcctacaccgccggagccctcaccctccaagacgccgcccgcatcaccaccctccgcagcaaagcactcctccccctcaccggccacggcaccatgatcagcgtcctcgcaccacccgaaaaaatccaggaaatagccgaccccgaccactggaacacccgcatctggatcgccgcccacaacgcacccaacaccaccaccatcaccggcgacacccaagccatcacccacctcacccaacaactctcccaccaccgcatcatgcgctggcaactccccggagtcgacttcgccggacactccggccacatcgaccaactacacaaccaactccagaaaatcctcgcacccatcaccccacaaaaacccaccatccccttctactccaccaccgacaacacctggatcaccgacaccaccctcgacgccgactactggtaccgcaacctacgccaacccgtcctcttccaacccgccatcaaccacctcaccaacaacggctacaccacctacatcgaaaccagcccccaccccaccctcacccccagcatccaggaaaccaaccccaacaccaccaccatccacaccctccacaacaaccaaaacgacacccacgccctcctcaccgcactcggccacgcccacacccacggccaccccatcacctggcacaccctcatcccacccaccaaaaccacccccctccccacctaccccttccaacacacccgctactggctcaacgacaaacccacagttgacacccaggacgccacccagctcggactcatcccgaccccacacccactcgttcccgccaccaccaccctcgcggaaaccggggccaccatcctcaccgggcacatcaaccccgcccaccacccctggaccaccgaccacgccgtcaacggcaccccgctcctcccaggcaccgcactggtcgacatggccctccacgccggcgaccacaccgaccacaccaccctcgacgaactcatcatccacacccccatcaccctcacccaccccaccaccatccaactcaccatcagtccgccagataacaccaacacccacaccctcaccgtccacacccgcaacagcccggacggtccctggaccgcccacgccaccggcaccctcacccagcaccaacacacacccgaccccccccaaaccacctggccccccaccgacgccgaacccatccccctggacggcacctaccaacgcctcgccaccaccggactcgaatacggccccaccttccaaggactcgacgcactctggcgccgagacagtcgcctcttcgccgacgtccgcctccccaacaccgaccacaccgacagcgccgacggctacggcatccaccccgcactcctcgacgccgccctccacgcactggtcgcggtctccgacggggacgaaatccggctgcccttcgcctggaccggcgtcaccctccacgccaccggtgccaccaagctgcgggtcgagctggagtgggacgcgtcggggtccgcgagcctgcgcgcgttcgacccgtccggccagccggtggtgacggtggagtcgctggcgagccgagtgatcagcccagagcagttgcgttcggcgagtgcgcgctccgggccgctgtaccggccggagtggatcgcctggtccggcgccggcacgccgggcggtgccgtggagttcgagcggtacgaggtgccgacggtcggcgacgacgtcctggccgacacccaccgccgcagcaccgagaccctgacccgaatacagcaacacctggccgcggacaccaccacccccctcgtcgtcgaagccacccacgacgacctcgccggcgcagcagtctggggactcatccgcaccgcccaaaccgaacacccaggccgcatcatcctcatcgacaccgacaaccaccccacctcccgcaaggcactacccaccctgatcgcctccggcgaaccccaagcccgcatccgcgacggcgccatcaccctcccccgactgaccgtggtcgctcccaccgagccggcgggagtcggcgaaggaaccgtgctgatcaccggtggcaccgggagcctcggctccctcatcgcccgccacctcgtgaccgaacacggcgtgcgcgacctcgtcctggtcagccgccaaggacccgacgcgcccggcgccaccgaactcatcgccgagctccaacagctcggcgcccaggtccgcgtccgctcctgcgacaccaccgaccgtgccgcactagccgcactcgtcgacgaggtcggcccgttcgcgggcgtcgtgcacacggcaggggcgctggccgacgcgaccgtcgacaacctggacgccgacgcactggccacaaccatcgccgccaaggcccacgccgcctggtggctccacgaacacacccaagaccacggcctgaccctgttcatggtcttctcctcgctggccagtgtgctcggcagcgccggacaggcgaactacgccgccgccaacagcttcctcgacgccctcgccacccaccgccgcacgctgggcctccccggcacctcactcgcctggggttcgtgggaacgcaccagcggcatgtccgcccacctcacccgcgcggaccacgaccggctggcccgtgccggcctgcggccgctcaccgacgagcaggggctggagttcttcgatggcgcgctcgccgtcgacctcggacaggtggtgacggccacgttcgacctgcccgctatcggccgctccggcgcggtgccggttctgctccgcggactggtgcgcgcgccacgccgagcggccgtcggggcggactccggcggggccgagccgtggacggaacggatcgcgacgctcgctccggatgcccgtgagcggtcggtgctgacgtcggtgatcgagcaggtggcccaggcgctcgggcatccggaccccggcgccatcgagccggaccaggcgttcaagagcctcggcttcgactccctgaccgccgtggagttccgcaaccggctgtcggcgatgaccgggctccagctgcccgccacgctcgtcttcgactatccggcggccggcgcggtcacgcggtacctgctggaccaggtctcccccgccccggcggccgccgggcccgacgacgacccggacgagcgggagttgcgccgggtcctggagcgggtgccggtcgcccggttccgcgaggccggggtgctggaggcgctgctgaagctggccggtcccgacccggcgcggacaccggacgcggccgaacccgacgaggacggcctgattgacgccatggataccgaggcgctgatccggcacgtgatggacggaaccggagcctga

SEQ ID NO: 14039 - protein, 2723 aa, Streptomyces hygroscopicus
MLRRELIRPLPELLKAHAARRGSQTAFADSRRGVSYAQLEARTRRLAGHLAQLRLLPGDRAAIYLGNCVETIESYLAIARASAIGVPINPHSSTAELAYLLDDSAARVIVTDHTRLPQVRRLQAERPHLTVVVTGDEESGAVPFDALAETEPQQPARDDLGLDDIAWMLYTSGTTGRPKGVLSTQRSCLWSVAASSAGVLGLSETDRVLWPVPLFHSLAHIYCVLSVTAVGATARITEAFDAEELLHTLRAEEFTFLAGVPTMYHYLLDAARDGDLSLPNLRVCLSAGAISTATLRAEFQETFGVPLLDCYGSTETCGLITANWPNGTQAEGSCGLPVPGLTVRIVDPETHESVETGEEGEIWVGGPSLMVGYHNQPEATEAALPRGWYRTGDLGRRDDLGYHTITGRLSELIIRSGENIHPTEVEQVLLRVPGVTDAAVVGSAHPTLGEVPVAFLVPAADGFDPDEVFAACREHLAYFKVPEELYEIGSIPRTGSGKIKRHALAQSPARLRAVSSGSFESLFRLEWTAPVPEAGPVDGDQATSAHRAGGSVTAGLEAPGSAVVDCPRGSLDEVLRAVRTGLTDRSGRVAVLTHGADHDPAQAAVWGLVESMRADAPHDAPVLVDADGGEATAALSAVLASGQPRALVRGGEVLVPRLARAGSGQRVSRPDPDGTVLVFGADQEQAAELAGHLVAAYGIRHVRLLARTAVPDLVARLTELGASVTQTVRAPGDRASLAEAFQTAGPPVTAVLQVAGPETLPTTLTGEVELGPLQDALALDELTREAHPALFVLSAPIDNGPAHAVFQAVANRRHAAGLPALALSWGPREELTSRERLALFDAATTVDDASVLAIRHELAASAVDTGAAGRLARLPAAERGRALLDLVLSEVGVITGGRPVHDRQSFRDIGMTSTSAVELRGRLAAATGLALPATLAFDYPNPDALAAYLGGRLFGDTSAAGPDTEPTDPAAPSGEPIAIVGMACRLPGGVTSPEELWELLSSGGDGISGFPTDRGWDLEHLYHPDPDHPGTSYVREGGFLHDAGDFDAALFGISPREALAMDPQQRLLLETTWEVLERAGIDPTSLRGSRTGVFAGVMYHDYISRLRTVPPELEGYLSSGGSGSVVSGRVSYTFGFEGPAVSVDTACSSSLVALHLAVQALRTGECTLAVAGGVTVMASPSSYIEFSRQRGLSPDGRCKSFAADADGAAWSEGAATLLVERLSDAQRLGHPVLGVVRGTAVNQDGASNGLTAPNGPSQQRVIRDALTNAQLTATDIDLIEAHGTGTKLGDPIEAQAVLAMYGQDRDLPVWLGSLKSNIGHTQAAAGVAGVMKAVLSMRHGVMPKSLHIDEPTPEVDWSAGTVELLAEARDWPGADERPRRAGVSSFGVSGTNAHVILEQAPPAPEPTESAEPVEPSEAAGPSGPVGLELGPSGPVPWVLSAQNETALKDLARQLVTETEGTVHQIAHSLITQRSTTLPHRAVLVGSTREEFATALEQITRHTPDGGKTVLVFPGQGSQWVGMGQRLWETSPLYRDTIHEIDTALSEYIDWSVTDILTSQPGAPTWDRVDVIQPVLFTTMTALATLWQHHGLTPDAIIGHSQGEIAAAYTAGALTLQDAARITTLRSKALLPLTGHGTMISVLAPPEKIQEIADPDHWNTRIWIAAHNAPNTTTITGDTQAITHLTQQLSHHRIMRWQLPGVDFAGHSGHIDQLHNQLQKILAPITPQKPTIPFYSTTDNTWITDTTLDADYWYRNLRQPVLFQPAINHLTNNGYTTYIETSPHPTLTPSIQETNPNTTTIHTLHNNQNDTHALLTALGHAHTHGHPITWHTLIPPTKTTPLPTYPFQHTRYWLNDKPTVDTQDATQLGLIPTPHPLVPATTTLAETGATILTGHINPAHHPWTTDHAVNGTPLLPGTALVDMALHAGDHTDHTTLDELIIHTPITLTHPTTIQLTISPPDNTNTHTLTVHTRNSPDGPWTAHATGTLTQHQHTPDPPQTTWPPTDAEPIPLDGTYQRLATTGLEYGPTFQGLDALWRRDSRLFADVRLPNTDHTDSADGYGIHPALLDAALHALVAVSDGDEIRLPFAWTGVTLHATGATKLRVELEWDASGSASLRAFDPSGQPVVTVESLASRVISPEQLRSASARSGPLYRPEWIAWSGAGTPGGAVEFERYEVPTVGDDVLADTHRRSTETLTRIQQHLAADTTTPLVVEATHDDLAGAAVWGLIRTAQTEHPGRIILIDTDNHPTSRKALPTLIASGEPQARIRDGAITLPRLTVVAPTEPAGVGEGTVLITGGTGSLGSLIARHLVTEHGVRDLVLVSRQGPDAPGATELIAELQQLGAQVRVRSCDTTDRAALAALVDEVGPFAGVVHTAGALADATVDNLDADALATTIAAKAHAAWWLHEHTQDHGLTLFMVFSSLASVLGSAGQANYAAANSFLDALATHRRTLGLPGTSLAWGSWERTSGMSAHLTRADHDRLARAGLRPLTDEQGLEFFDGALAVDLGQVVTATFDLPAIGRSGAVPVLLRGLVRAPRRAAVGADSGGAEPWTERIATLAPDARERSVLTSVIEQVAQALGHPDPGAIEPDQAFKSLGFDSLTAVEFRNRLSAMTGLQLPATLVFDYPAAGAVTRYLLDQVSPAPAAAGPDDDPDERELRRVLERVPVARFREAGVLEALLKLAGPDPARTPDAAEPDEDGLIDAMDTEALIRHVMDGTGA

SEQ ID NO: 14040 - DNA, 1922 bp, Populus trichocarpa x Populus deltoides (western balsam poplar x cottonwood)
  CDS (23)..(1669)
catttctctctctttccaatcaatggaggccaataaggatcaagtacaagaattcattttcaggtccaaactccctgacatctatatcccaaaccacctccctttacacacttattgcttcgaaaagctttcccaattcaaagacaacccttgcttgatcaatggccctaccggtgatatctacacttatgcggatgttgagctcacatcacgcaaagttgcctctggcctctacaagttaggcctccaacaaggcgatgttatattgctcttgctccaaaactcgccagaatttgtttttgcattccttggagcgtcgttcattggcgctattagctcaactgcaaaccctttctatacttcagctgagatcgcaaaacaagcaacagcatcaaaggcaaagctgataataacacatgcagcgtacgccgagaaagtgcaacagtttgctcaagaaaatgatcatgttaagataatgaccatcgattctcttacagaaaactgcttgcatttctcagagttgacaagctctgatgagaatgaaatccctactgtcaagattaagcctgatgatatcatggcactcccatattcgtcagggactacaggtctccctaaaggtgtcatgttgactcataaagggcttgttactagtgtggcacaacaagttgatggagagaaccctaatctctattttcacgagagggatgtgattctttgtgtgctgcctttgttccacatctattcactcaattccgtattcctttgtgggctaagagctggttcagcaattttggttatgcaaaaattcgatacggtttcattaatggaccttgtacagaaatataaggtgacaattgctccactcgtgccccctatctgtctggcaattgcaaaaagtccagtcgttgatcagtatgatctttcttcgatccggacagtactgtctggcgcagcacctttggggaaggagcttgaggatacagtcagagctaagctgcctaatgctaaacttggacagggatatggaatgacagaggcagggcccgtgatagcaatgtgcttagcttttgcaaaggaaccctttgagattaaatctggcgcatgtgggactgttgttagaaatgcagagatgaagattgtcgacccggaaaccggtgagtcccagccgcgaaataaaaccggcgagatttgcattaggggttgccaaataatgaaaggttatctaaatgatcctgaggcaactgaaaggacgatagacaaagatggatggttgcacacgggtgatattggatacattgatgaagatgaactctttatcgtggatcgtttgaaagaattgatcaaatacaaaggtttccaagtagcacctgctgagcttgaagcaatgttgattgctcatcccaacatctctgatgctgctgtagtacccatgaaagatgaagctgccggagaggttccggttgcttttgtggtgcgatcaaatggttccaagatcaccgaggatgaaatcaaacaatatatctcaaaacaggtgatcttttataagagaatcggtcgggttttcttcacggaggccatccccaaggccccgtcgggaaaaatcttgagaaaggacctcagagcaagggtttctgctggtgatcttccatgcacatcagattcctaatatgacatatatgcaaaccagcattagtttgaagttcagaggcagaatggatctgatgtgtttttcaaaagggtttcaaaagggagaggagaatatgtaaacttgaagatttcagagccttcaatgttcagttgttgctatcgacctaaactatgatgcttggtgaatagaagaacgagatttgtattaattaatggtggctagcgttgcaaagtcaaaccattcttgttagcaaacctccttcttcagtgtg

SEQ ID NO: 14041 - protein, 548 aa, Populus trichocarpa x Populus deltoides (western balsam poplar x cottonwood)
MEANKDQVQEFIFRSKLPDIYIPNHLPLHTYCFEKLSQFKDNPCLINGPTGDIYTYADVELTSRKVASGLYKLGLQQGDVILLLLQNSPEFVFAFLGASFIGAISSTANPFYTSAEIAKQATASKAKLIITHAAYAEKVQQFAQENDHVKIMTIDSLTENCLHFSELTSSDENEIPTVKIKPDDIMALPYSSGTTGLPKGVMLTHKGLVTSVAQQVDGENPNLYFHERDVILCVLPLFHIYSLNSVFLCGLRAGSAILVMQKFDTVSLMDLVQKYKVTIAPLVPPICLAIAKSPVVDQYDLSSIRTVLSGAAPLGKELEDTVRAKLPNAKLGQGYGMTEAGPVIAMCLAFAKEPFEIKSGACGTVVRNAEMKIVDPETGESQPRNKTGEICIRGCQIMKGYLNDPEATERTIDKDGWLHTGDIGYIDEDELFIVDRLKELIKYKGFQVAPAELEAMLIAHPNISDAAVVPMKDEAAGEVPVAFVVRSNGSKITEDEIKQYISKQVIFYKRIGRVFFTEAIPKAPSGKILRKDLRARVSAGDLPCTSDS

SEQ ID NO: 14042 - DNA, 2042 bp, Populus trichocarpa x Populus deltoides (western balsam poplar x cottonwood)
  CDS (29)..(1702)
ctctttcattctctgttccagacaaacaatggaggcgaaaaatgatcaagcacaagaattcattttcaggtccaaactccctgatatccacatcccaaaccacctccctttacacacttattgctttgaaaacctttcccgattcaaagacaatccctgtttgatcaatggccctaccggtgaaatccacacctacgcggaagttgaactcacatcacgcaaagtcgcttccggtctcaacaagttaggcatcaaacaaggcgatgttatattgctgttgctccaaaactcgccagaatttgtgtttgcgtttctcggagcatcaattattggtgctattagcacaaccgcaaaccccttctacactcccgctgaggtcgcaaaacaagcaacagcatcaaaggcaaagctgataattacacaggcagtttacgccgagaaagtgcaagaattcgtcaaggaaaatgtccatgtcaaaatagtgaccgttgactctccaccagaaaactacttgcatttttcagagttgacaaattctgatgaggatgatattcctgctgtcgagattaaccctgatgatgtcgtggcactcccttattcgtcagggacaacaggtctccctaaaggtgtcatgttgactcataaagggctcgttactagtgtggcacaacaagttgatggagagaaccctaacctctattttcacgagaaggatgtgattctttgtgtgttgcctttgttccacatctactcgctcaattccgtgttactttgtgggctaagggttggttcagcaattttgcttatgcaaaaattcgagattgttacgttaatggagcttgtacaaaaatataaggtgacaattgcgccatttgtcccccctgtcgtcctcgcagttgcaaaatgtccagtcgttgataagtatgatctttcttccattcggaccgtaatgtctggcgccgcaccaatggggaaggagcttgaggatacagtaagggctaagctgcctaatgctaaacttggacagggatacggaatgacagaggcagggcccgtgctatcgatgtgcttggcatttgcaaaggaaccctttgaaattaaatcaggtgcctgtgggactgttgttagaaacgccgagatgaagattgttgaccccgataccggtagatccctgccacgaaatcaatccggagagatttgcattagaggtagccaaatcatgaaaggttatctaaatgaccctgaggccactgaaaggactgtagacaatgatggatggttgcacaccggcgacattggatacatcgacggagatgatgagctctttatcgttgatcgactgaaagaattgattaaatacaagggttttcaagtagcacctgctgagcttgaagcaatgttgattgctcatcccgacatctctgattgtgctgtagtacccatgaaagatgaagctgccggagaggttcctattgcttttgtggtgcgagcaaatggttccaagattaccgaggacgaaatcaaacaatatatctcaaaacaggtggtcttttacaagagaattagtcgggtgttcttcacggaagcgattcccaaggctccatccggaaaaatcttgagaaaagacctaagagcaaggcttgcaactggcgacttcctcattaaattccaacatgacacatacatgcaaaaacagcagtagtctgaagtccagaggcagtatggtcttgctgtgttttcctttccttatcggccctccaaaagggacaggagaacatatagactggattgtttcaatgatcagtttgttcttatccttcaatgcaagttgaatagaagaatgagctttgtattaattaatatgctcagggtattgtaggacatgtttttgacgacgttaaaaacttgggacggaaaattctggtttgtataattgtatcaatctgcgttacatataataagtctcgtttcctttattttcttattattccacatgagttgtattatttatttattatgtaattggttttttattttttggt

SEQ ID NO: 14043 - protein, 557 aa, Populus trichocarpa x Populus deltoides (western balsam poplar x cottonwood)
MEAKNDQAQEFIFRSKLPDIHIPNHLPLHTYCFENLSRFKDNPCLINGPTGEIHTYAEVELTSRKVASGLNKLGIKQGDVILLLLQNSPEFVFAFLGASIIGAISTTANPFYTPAEVAKQATASKAKLIITQAVYAEKVQEFVKENVHVKIVTVDSPPENYLHFSELTNSDEDDIPAVEINPDDVVALPYSSGTTGLPKGVMLTHKGLVTSVAQQVDGENPNLYFHEKDVILCVLPLFHIYSLNSVLLCGLRVGSAILLMQKFEIVTLMELVQKYKVTIAPFVPPVVLAVAKCPVVDKYDLSSIRTVMSGAAPMGKELEDTVRAKLPNAKLGQGYGMTEAGPVLSMCLAFAKEPFEIKSGACGTVVRNAEMKIVDPDTGRSLPRNQSGEICIRGSQIMKGYLNDPEATERTVDNDGWLHTGDIGYIDGDDELFIVDRLKELIKYKGFQVAPAELEAMLIAHPDISDCAVVPMKDEAAGEVPIAFVVRANGSKITEDEIKQYISKQVVFYKRISRVFFTEAIPKAPSGKILRKDLRARLATGDFLIKFQHDTYMQKQQ

SEQ ID NO: 14044 - DNA, 2209 bp, Brassica napus (rape)
  CDS (55)..(2055)
ctcattcaccattcccgtttcatctttatttgtaagggtaatattaatacacatatggctgcagctgctgatcatgtggtgatagtggaagaaggacggcaagccaccgcagagcatccatcggcaggaccggtttatcgatgtaaatacgctaaagatggcctcctcgatcttcctgctgatcttgattctccttggcagctatttagtgaggctgtgaagcaatatccgaatgagcaaatgttaggccgtcgcgtaacggttgattctaaggtcggtccatacacatggatcacatatagggaagctcacgatgctgcattgcggattggatcagcaatcagaagccgaggcgttaatccgggaaactgttgtggaatatacggatctaattgtccagaatggattatcgctatggaggcctgcatgagccaagggataacttatgtacctttatacgacagtttaggtgtaaacgctgtagagttcatcatcaaccatgccgaggtttcgctggtattcgttcaagagaaggcactttcctccatcttagcatgccgcaagggatgttcttcgaatttgaagactattgtgagctttggtgaagtctcgactactcaaaaggaagaagctgagaaccaatgtgtttcgttattttcttggcatgagttcttactaatgggaaactcggatgagacaacacttcctcgtaagcaaaaaacagacatatgcacaataatgtacacaagcgggacgacgggagagcccaaaggtgtaatcttaagcaatgcagcgattatggtcgaagttttatccattgataaaatgcttcaagtcaccgatcgatcgtgtgacacaagtgatgtgtttttctcgtacttgccattagcacattgttatgatcaagtcatggagatctactttttatcaagaggctcctctgttggatactggcgtggcgacattcggtacttgatggatgatgttcatgcactgaaaccaactgtgttttgcggtgttccacgagtttacgacaaactctatgctggtgtaatgcaaaaaatctcagctggtggtttgatacgcaagaaactcttcgatttcgcttataactataaattggggaatatgagaaaaggattgtctcaagaagaagcttctcctcgtctagacagacttatgttcgataagataaaagatgcattaggaggaagagctcatatgttgttatcaggtgcagcacctttacctcgtcatgtagaggagttcttgagaatcatccctgcctctaatctctctcaaggttatggattgactgagagctgtggagggagcttcacgactttagcaggagtattttctatggtggggacagtgggtgtgccaatgcctacggtggaggcaaggctagtttctgtaccagagatgggttatgaagctttttccggggatgtggctagaggagagatttgtcttagaggaaattcaatgttctctggttaccacaaaagacaagacctaactaatcaagtcgtgatcaatggatggttccacacaggagatattggggaatggcaagaagatggatcgatgaagatcatagataggaagaagaacatcttcaagttgtctcaaggtgaatatgttgctgtcgaaaacctcgagaatacttactcaagatgccctctcattgctcagatatggatctatggaaacagcttcgagtcttttctggtagcagtagttgtacccgagagaaaggctattgaagattgggctaaacttaataaccaatcatctcccaatgattttgaatctctatgtcaaaatctcaaagctcaaaaatacttcttggatgagcttaactctaccgcaaagcaataccaacttaaagggtttgaaatgttaaaagcggttcatttggaaccaaatcttttcgatattgaaagagatcttataactccaactttcaagttgaaaaggccacagctcctcaaacattacaagagcataattgatcaactttacaccgaagcaaaggcgtccagagcatagaaccggacggctattcattttccgatgtttttttagttgtatgatatgtcaacattgtattcgaatcctcttatcatatattattcatatgatacactttacattatatattgttataagaaaattttaaaagtaaaaaaaaaaaaaaaaaaaa

SEQ ID NO: 14045 - protein, 666 aa, Brassica napus (rape)
MAAAADHVVIVEEGRQATAEHPSAGPVYRCKYAKDGLLDLPADLDSPWQLFSEAVKQYPNEQMLGRRVTVDSKVGPYTWITYREAHDAALRIGSAIRSRGVNPGNCCGIYGSNCPEWIIAMEACMSQGITYVPLYDSLGVNAVEFIINHAEVSLVFVQEKALSSILACRKGCSSNLKTIVSFGEVSTTQKEEAENQCVSLFSWHEFLLMGNSDETTLPRKQKTDICTIMYTSGTTGEPKGVILSNAAIMVEVLSIDKMLQVTDRSCDTSDVFFSYLPLAHCYDQVMEIYFLSRGSSVGYWRGDIRYLMDDVHALKPTVFCGVPRVYDKLYAGVMQKISAGGLIRKKLFDFAYNYKLGNMRKGLSQEEASPRLDRLMFDKIKDALGGRAHMLLSGAAPLPRHVEEFLRIIPASNLSQGYGLTESCGGSFTTLAGVFSMVGTVGVPMPTVEARLVSVPEMGYEAFSGDVARGEICLRGNSMFSGYHKRQDLTNQVVINGWFHTGDIGEWQEDGSMKIIDRKKNIFKLSQGEYVAVENLENTYSRCPLIAQIWIYGNSFESFLVAVVVPERKAIEDWAKLNNQSSPNDFESLCQNLKAQKYFLDELNSTAKQYQLKGFEMLKAVHLEPNLFDIERDLITPTFKLKRPQLLKHYKSIIDQLYTEAKASRA

SEQ ID NO: 14046 - DNA, 2360 bp, Brassica napus (rape)
  CDS (76)..(2079)
atccattcaactctctcgattacatatagcagagagaaagttgtggttctagagagagaaagcgagagagagatcatgacgcagcagctagagaaattcatcttccaagtcgaggaagggagagaaggtagcgatggaagaccatccgttggacctgtgtaccgcagtgtcttcgccaaggacgggttcccggagccgatcgaaggaatggatagttgctgggatgttttccgcatgtctgttgagaagtatccaaacaatccgatgcttggccgccgtgagattgtagacgggaagccggggaagtatgtatggcaaacgtaccaagaagtctacgacattgttataaagctgggaaactctctccgaagttgtggagttgaggagcaagcgaaatgtggtatctatggtgctaattctcccgagtggatcataagcatggaggcatgtaatgcacatggactctattgtgtccctctgtatgatacactaggcgctggtgctgtggagttcattattacccattctgaggtttcaattgtctttgtggaggagaagaagatctctgagttatttaagacatgcccaaaggccacagagtacatgaagaccgttgtgagcttcggtggtgtcacacgtgaacaaaaagaagcagctgaaacttttgggttggtcatatatgcttgggatgagtttttgaagctgggcgaaggaaagcaatttgatcttccaatcaaaaagaagagtgacatttgcacgatcatgtatactagtggaaccactggtgatccaaagggagtgatgatatctaacgaaagcattgttacccttatcgctggagtgatccgtctactgaaaagcgctaacgaagccttgactgtgaaagatgtgtacctttcttaccttcctctcgcccacatctttgaccgagttatcgaggagtgttttatccaacatggtgctgcaattggcttctggcgtggggatgtcaagctgttgatagaagaccttggcgagcttaaaccaactattttttgcgctgtacctcgtgtgctagatagagtttactcaggtcttcagcagaagcttgctgctggtggattcttcaaaaagtttatgtttgattctgcattttcctttaaatatggacatatgaagaaaggacagtctcatgtagaggcctctccattatgtgacaaacttgtattcagcaaggttaaacaagggctcggaggcaacgtgaggatcattctatcgggagctgctcctctcgctagtcacgtagagtcatttctaagagtggtggcttgctgtcatgttctccaaggatacggtctaaccgagagctgtgctgggacttttgtctcgctgccggaccgactggacatgctcgggacagttggaccaccagtgccaaacgtggatatacgccttgaatctgtacccgagatggaatatgatgctcttgcaagtactccacgtggtgaaatctgcattcggggaaagacccttttctctggatactacaaacgtgaagacctctcaaaagaggttcttattgatggatggctgcacacaggtgatgttggggaatggcaaccaaatggaagcatgaagataatcgacaggaagaagaatatctttaaactctcacaaggagagtatgttgcggtcgagaacttggaaaacatctatggtgaagtacaagcggttgattccgtgtgggtgtacgggaacagctttgaatccttcctaatcgcagtcgccaatccaaaccagcatatccttgagaaatgggctgcagaaaacggtgtgagcggtgactacaacgctctctgtcaaaacgcaaaggcaaaggaattcatcctcggagaacttgtgaaaatgggcaaagagaaaaagatgaaggggttcgagatcattaaggcggttcatctagacccagtgccgtttgacatggaacgcgatcttcttactcccacttacaaaaagaagaggcctcaattgctgaaacactaccagtgtgtgatcgatgaaatgtacaagaccacaaatgagagcttagcttccagaaagtaaatccctcctcaaatataactctcggtgtcttttgctttttctttgggtctctcactgtgcacgacgaaaactttgtcactaggctcttcttatatcatgtgtaaaatatttggatattacatagcatcagatcagagctgctacacttcgtcttcttttgctttttctcttttcaaatctaccttatctgttgaattactaagtttaaatgttaatcctttcaaactcttgagcttaaaatatcccatctggttgtgggtttatatggaaaaaaaaaaaaa

SEQ ID NO: 14047 - protein, 667 aa, Brassica napus (rape)
MTQQLEKFIFQVEEGREGSDGRPSVGPVYRSVFAKDGFPEPIEGMDSCWDVFRMSVEKYPNNPMLGRREIVDGKPGKYVWQTYQEVYDIVIKLGNSLRSCGVEEQAKCGIYGANSPEWIISMEACNAHGLYCVPLYDTLGAGAVEFIITHSEVSIVFVEEKKISELFKTCPKATEYMKTVVSFGGVTREQKEAAETFGLVIYAWDEFLKLGEGKQFDLPIKKKSDICTIMYTSGTTGDPKGVMISNESIVTLIAGVIRLLKSANEALTVKDVYLSYLPLAHIFDRVIEECFIQHGAAIGFWRGDVKLLIEDLGELKPTIFCAVPRVLDRVYSGLQQKLAAGGFFKKFMFDSAFSFKYGHMKKGQSHVEASPLCDKLVFSKVKQGLGGNVRIILSGAAPLASHVESFLRVVACCHVLQGYGLTESCAGTFVSLPDRLDMLGTVGPPVPNVDIRLESVPEMEYDALASTPRGEICIRGKTLFSGYYKREDLSKEVLIDGWLHTGDVGEWQPNGSMKIIDRKKNIFKLSQGEYVAVENLENIYGEVQAVDSVWVYGNSFESFLIAVANPNQHILEKWAAENGVSGDYNALCQNAKAKEFILGELVKMGKEKKMKGFEIIKAVHLDPVPFDMERDLLTPTYKKKRPQLLKHYQCVIDEMYKTTNESLASRK

SEQ ID NO: 14048 - DNA, 2242 bp, Brassica napus (rape)
  CDS (21)..(2126)
cgttgattcgcgcatcagcgatgacgtcgacttccttgggaccttcgatgcttctctcgtacggctcttcttcccgtgactttcatgatctccggttcagattgatttcgggtcctcgtgttcgagttccttcgttccggagatttcggattcactgcgtgtccaagggaaaggacgtgacgccaatcattgaaagctcttcatcgtcaggaggagatgctgctttaagctatagtgaatggaaggctgtcccagatatctggagatcttctgcagaaaagtatggggataaaattgcacttgtagatccttaccatgacccacctttgaaattgacatacaaccagttggaacaagagattctggactttgctgagggattacgagctgttggagtgaaagcagatgagaagattgcactttttgctgataattcctgtagatggcttgtctcagatcaaggtataatgtctacaggagcagtcaatgttgtcagaggatctaggtcctctgttgaagaattactgcagatataccaacattctgaaagtgtagctcttgttgtggacaatcctgagtttttcaaccgcatcgctgatacatttacatccaaagtgtctctgaggtttctgatacttctctggggtgagaagtcatcattggttacacaggggatgcagattccagtttacagctacacagacattaaaaacctaggacaggagaaacgtgcaggatctaacgatacaaggaaatccatcaatccagatgacacagccgcgattatgtataccagtggtaccaccgggaatcccaaaggcgttatgcttacacatcggaatctcttacaccagataaaacatttatctgcatatgtacctgctgaagctggcgatagatttctaagcatgttgccttcatggcatgcctacgaacgtgcttgcgaatacttcatattcacatgtggagttgagcaaatgtatacgtctataagattcttaaaggaagatctaaagcggtatcaaccacactatcttatatccgttcctttggtatatgagacactttacagtggtattcaaaagcagatttccacaagttcagctgcccgtaaatatctagcacttacactgatcaaaatcagtctcgcatatatggagatgaagcgaatttatgagggtatgtgtctgacaaaagagcaaaagcctccaatgtatattgtctctttggttgattggttgcgggcgagagtagttgctgctttattgtggccattacatatgttggccaaaatactaatctacaagaaaatccatgcctctattgggatatcaaaggctggtatcagcggaggtggtagtttacccattcacattgacaagttttttgaggccatcggtgtgattctacaaaatggttatggtttgacagagacatccccggttatctgtgcacggacgcttagctgtaacgttattggctcagctggatatccaatgcatggtacagagttcaaaattgtagatcctgagactaatactgttctccctcctggttcaaagggcattgtcaaagtcagaggcccacagattatgaaaggttattataagaatccaacaaccacaaagcaagttctaaatgaaagtggatggttcaacacaggagatatgggctggatcgctcctcatcactcaacgggaaggagtcgccgctgtggaggtctcatcgttcttgaaggccgtgccaaagacacaattgttctctccacaggtgaaaacgtggaaccattagagattgaagaagctgccatgagaagcagattgatagatcaaatcgtggttattggacaggatcaacgacgccttggagctatcataatgccaaacaaagaggaagcagaaaagctagatcctgaaacatcccaacttagcagcgaaaaattaaagagcttagtttaccaagaactgaggaaatggacatcagaatgctcgttccaagtcggaccagtcttgatcgtggatgagcccttcacgatagacaatggcttaatgacaccaacgatgaagattagaagggacaaggtcgtggctaagtacaaagacgagattaatcaactttacaattaactacagtttgattaatcttcttcctttgttgatgtaattataaaaatagaagcgtactctattaagaatcagcaaataaattaacaattaaacaattaaaaaaaaaaaaaaaaaaa

SEQ ID NO: 14049 - protein, 701 aa, Brassica napus (rape)
MTSTSLGPSMLLSYGSSSRDFHDLRFRLISGPRVRVPSFRRFRIHCVSKGKDVTPIIESSSSSGGDAALSYSEWKAVPDIWRSSAEKYGDKIALVDPYHDPPLKLTYNQLEQEILDFAEGLRAVGVKADEKIALFADNSCRWLVSDQGIMSTGAVNVVRGSRSSVEELLQIYQHSESVALVVDNPEFFNRIADTFTSKVSLRFLILLWGEKSSLVTQGMQIPVYSYTDIKNLGQEKRAGSNDTRKSINPDDTAAIMYTSGTTGNPKGVMLTHRNLLHQIKHLSAYVPAEAGDRFLSMLPSWHAYERACEYFIFTCGVEQMYTSIRFLKEDLKRYQPHYLISVPLVYETLYSGIQKQISTSSAARKYLALTLIKISLAYMEMKRIYEGMCLTKEQKPPMYIVSLVDWLRARVVAALLWPLHMLAKILIYKKIHASIGISKAGISGGGSLPIHIDKFFEAIGVILQNGYGLTETSPVICARTLSCNVIGSAGYPMHGTEFKIVDPETNTVLPPGSKGIVKVRGPQIMKGYYKNPTTTKQVLNESGWFNTGDMGWIAPHHSTGRSRRCGGLIVLEGRAKDTIVLSTGENVEPLEIEEAAMRSRLIDQIVVIGQDQRRLGAIIMPNKEEAEKLDPETSQLSSEKLKSLVYQELRKWTSECSFQVGPVLIVDEPFTIDNGLMTPTMKIRRDKVVAKYKDEINQLYN

SEQ ID NO: 14050 - DNA, 2287 bp, Brassica napus (rape)
  CDS (25)..(2058)
ttttttcagattccgaatcggaaaatggattctacctccgccgcacgccgccgcataaacgctatccactcccatctcgtcacgtcttcccgctcttcccctctcctcctcagctccaatcccaccgcgggcgagttctatctcgataatggctatagcgtcgtgcttccggagaagctgagcactggcaagtggcacgtctacagatctgctcgatctccgttcaagctcgttagtaggttcccggatcatcctgacatcgccactctccatgacaactttgagcatgctgttcatgactttcgggattacaagtacttaggaactcgcgttcgtgtcgacggaactgttggagactacaaatggatgacatatggagaagttggtacagcaagaactgctctaggttctggtttagttcatcatggcatcaccacgggatcttctgttggaatttactttatcaaccgcccagagtggctcattgtcgatcaagcttgtgcttcttattcgtatgtgtctgttcctttgtatgatactcttggtcctgatgctgtaaagtttatcgtcaatcatgcaaatgtgcaagccatattctgtgtggctgagacgttaaactccttacttagcggcttgtctgagatgccaagcgtacgcctggtggtggttgttggagggttgaatgaatctttgccttcgcttcccccatccgcaggagttaaagttgtatcatattcggtgttactgaaccagggccgtagtaaccctcagccgttttgtccaccaaaacccgatgatgttgcaaccttatgctatacaagcggaacaactgggaccccaaagggagtcgtattgactcatgcaaacttgattgcaaatgttgctggatccagttttagtgtgaaatttttctcttcagatatttacatttcatatcttccactggcacacatttacgaacgagcaaatcagatcctagcagtgtacttcggagttgccgttggtttctaccaaggggacaatatgaaactactggatgatctggctgctctgagacctactgtattcagcagcgtcccccgattatacaatagaatatatgatggtattactaatgcagtaaaaacctcgggtgggctgaaagagaggctcttcaatgctgcatataatgcaaagaaacaggctctcttgaatggaaaaagtgcgtctcccatatgggacaggttggtatttaataagataaaagacagacttggaggacgagttcgttttatgacgtctggggcttcacctttgtctcctgaagtgttggagtttttgaagatatgctttggaggaagggtatcagaaggatatggaatgactgaaacatcttgtgttataagtggaatggacgagggtgataacctcactggacatgttggctctcctaatccagcttgtgaagtaaagcttatggatgtcccggaaatgaactatacatcagcggatgaaccacatcctcgtggtgagatatgtgttagaggtcccatcatctttagaggctattacaaggatgaagttcaaacgagagaggtgattgatgaagatggatggcttcacactggagatataggtctttggttgccgggaggacgtctaaaaattatcgacaggaagaagaacatcttcaaattggctcaaggggagtatatagctccagagaaaattgaaaacgtctatgccaaatgcagatttgtgggccaatgcttcatatatggtgatagctttaattcatcattggtggctgttgtatcggttgatccagatgtgcttaaaagctgggctgcttcagaaggcataaagggagaactgagagagttgtgcaataacccgagagtgaaagcagcagtattatcagacatggacgctgttgggagagaatctcagttgagaggctttgagtttgcaaaagctgtaacattggtgctggagccattcacgctagaaaatggcttgttgacaccaacattcaagattaagagaccacaagcaaggaatacttcgcagaagcaataacaaacatgtacaaggagcttgctgcttctgatcccacggctaataaagctttgtgattcgtgtgtaattcgagtgattaataaaaaagtcctaaaattgtaattcttttttatttttatttttgcttcatgtttcattgaatgttcgttaaggtaataaaggtgctacagtatagatactaaaaagtttgccttgtgtgataagaaagtcaaaaaaaaaaaaaaaaaaa

SEQ ID NO: 14051 - protein, 677 aa, Brassica napus (rape)
MDSTSAARRRINAIHSHLVTSSRSSPLLLSSNPTAGEFYLDNGYSVVLPEKLSTGKWHVYRSARSPFKLVSRFPDHPDIATLHDNFEHAVHDFRDYKYLGTRVRVDGTVGDYKWMTYGEVGTARTALGSGLVHHGITTGSSVGIYFINRPEWLIVDQACASYSYVSVPLYDTLGPDAVKFIVNHANVQAIFCVAETLNSLLSGLSEMPSVRLVVVVGGLNESLPSLPPSAGVKVVSYSVLLNQGRSNPQPFCPPKPDDVATLCYTSGTTGTPKGVVLTHANLIANVAGSSFSVKFFSSDIYISYLPLAHIYERANQILAVYFGVAVGFYQGDNMKLLDDLAALRPTVFSSVPRLYNRIYDGITNAVKTSGGLKERLFNAAYNAKKQALLNGKSASPIWDRLVFNKIKDRLGGRVRFMTSGASPLSPEVLEFLKICFGGRVSEGYGMTETSCVISGMDEGDNLTGHVGSPNPACEVKLMDVPEMNYTSADEPHPRGEICVRGPIIFRGYYKDEVQTREVIDEDGWLHTGDIGLWLPGGRLKIIDRKKNIFKLAQGEYIAPEKIENVYAKCRFVGQCFIYGDSFNSSLVAVVSVDPDVLKSWAASEGIKGELRELCNNPRVKAAVLSDMDAVGRESQLRGFEFAKAVTLVLEPFTLENGLLTPTFKIKRPQARNTSQKQ

SEQ ID NO: 14052 - DNA, 1915 bp, Populus tremuloides (quaking aspen)
  CDS (83)..(1690)
ccctcgcgaaactccgaaaacagagagcacctaaaactcaccatctctccctctgcatctttagcccgcaatggacgccacaatgaatccacaagaattcatctttcgctcaaaattaccagacatctacatcccgaaaaaccttcccctgcattcatacgttcttgagaacttgtctaaacattcatcaaaaccttgcctgataaatggcgcgaatggagatgtctacacctatgctgatgttgagctcacagcaagaagagttgcttctggtctgaacaagattggtattcaacaaggtgacgtgatcatgctcttcctaccaagttcacctgaattcgtgcttgctttcctaggcgcttcacacagaggtgccatgatcactgctgccaatcctttctccacccctgcagagctagcaaaacatgccaaggcctcgagagcaaagcttctgataacacaggcttgttactacgagaaggttaaagattttgcccgagaaagtgatgttaaggtcatgtgcgtggactctgccccggacggtgcttcacttttcagagctcacacacaggcagacgaaaatgaagtgcctcaggtcgacattagtcctgatgatgtcgtagcattgccttattcatcagggactacagggttgccaaaaggggtcatgttaacgcacaaagggctaataaccagtgtggctcaacaggtagatggagacaatcctaacctgtattttcacagtgaagatgtgattctgtgtgtgcttcctatgttccatatctatgctctgaattcaatgatgctctgtggtctgagagttggtgcctcgattttgataatgccaaagtttgagattggttctttgctgggattgattgagaagtacaaggtatctatagcaccagttgttccacctgtgatgatggcaattgctaagtcacctgatcttgacaagcatgacctgtcttctttgaggatgataaaatctggaggggctccattgggcaaggaacttgaagatactgtcagagctaagtttcctcaggctagacttggtcagggatatggaatgaccgaggcaggacctgttctagcaatgtgcttggcatttgccaaggaaccattcgacataaaaccaggtgcatgtggaactgtagtcaggaatgcagagatgaagattgttgacccagaaacaggggtctctctaccgaggaaccagcctggtgagatctgcatccggggtgatcagatcatgaaaggatatcttaatgaccccgaggcaacctcaagaacaatagacaaagaaggatggctgcacacaggcgatatcggctacattgatgatgatgatgagcttttcatcgttgacagattgaaggaattgatcaagtataaagggtttcaggttgctcctactgaactcgaagctttgttaatagcccatccagagatatccgatgctgctgtagtaggattgaaagatgaggatgcgggagaagttcctgttgcatttgtagtgaaatcagaaaagtctcaggccaccgaagatgaaattaagcagtatatttcaaaacaggtgatcttctacaagagaataaaacgagttttcttcattgaagcaattcccaaggcaccatcaggcaagatcctgaggaagaatctgaaagagaagttgccaggcatataactgaagatgttactgaacatttaaccctctgtcttatttctttaatacttgcgaatcattgtagtgttgaaccaagcatgcttggaaaagacacgtacccaacgtaagacagttactgttcctagtatacaagctctttaatgttcgttttgaacttgggaaaacataagttctcctgtcgccatatggagtaattcaattgaatattttggtttctttaatgat

SEQ ID NO: 14053 - protein, 535 aa, Populus tremuloides (quaking aspen)
MNPQEFIFRSKLPDIYIPKNLPLHSYVLENLSKHSSKPCLINGANGDVYTYADVELTARRVASGLNKIGIQQGDVIMLFLPSSPEFVLAFLGASHRGAMITAANPFSTPAELAKHAKASRAKLLITQACYYEKVKDFARESDVKVMCVDSAPDGASLFRAHTQADENEVPQVDISPDDVVALPYSSGTTGLPKGVMLTHKGLITSVAQQVDGDNPNLYFHSEDVILCVLPMFHIYALNSMMLCGLRVGASILIMPKFEIGSLLGLIEKYKVSIAPVVPPVMMAIAKSPDLDKHDLSSLRMIKSGGAPLGKELEDTVRAKFPQARLGQGYGMTEAGPVLAMCLAFAKEPFDIKPGACGTVVRNAEMKIVDPETGVSLPRNQPGEICIRGDQIMKGYLNDPEATSRTIDKEGWLHTGDIGYIDDDDELFIVDRLKELIKYKGFQVAPTELEALLIAHPEISDAAVVGLKDEDAGEVPVAFVVKSEKSQATEDEIKQYISKQVIFYKRIKRVFFIEAIPKAPSGKILRKNLKEKLPGI

SEQ ID NO: 14054 - DNA, 1713 bp, Populus tremuloides (quaking aspen)
  CDS (1)..(1713)
atgatgtccgtggccacggttgagcccccgaaaccggaactctcccctccacaaaaccaaaacgcaccatcctctcatgaaactgatcacattttcagatcaaaactaccagacataaccatctcgaacgacctccctctgcacgcatactgctttgaaaacctctctgatttctcagataggccatgcttgatttcaggttccacgggaaaaacctattcttttgccgaaactcacctcatatctcggaaggtcgctgctgggttatccaatttgggcatcaagaaaggcgatgtaatcatgaccctgctccaaaactgcccagaattcgtcttctccttcatcggtgcttccatgattggtgcagtcatcaccactgcgaaccctttctacactcaaagtgaaatattcaagcaattctctgcttctcgtgcgaaactgattatcacccagtctcaatatgtgaacaagctaggagatagtgattgccatgaaaacaaccaaaaaccgggggaagatttcatagtaatcaccattgatgacccgccagagaactgtctacatttcaatgtgcttgtcgaggctagcgagagtgaaatgccaacagtttcaatccttccggatgatcctgtggcattaccattctcttcagggacaacagggctcccaaaaggagtgatactgacccacaagagcttgataacaagtgtggctcaacaagttgatggagagatcccaaatttatacttgaaacaagatgacgttgttttatgcgttttacctttgtttcacatcttttcattgaacagcgtgttgttatgctcgttgagagccggttctgctgttcttttaatgcaaaagtttgagataggatcactgctagagctcattcagaaacacaatgtttcggttgcggctgtggtgccaccactggtgctggcgttggccaagaacccattggaggcgaacttcgacttgagttcgatcagggtagtcctgtcaggggctgcgccactggggaaggagctcgaggacgccctcaggagcagggttcctcaggccatcctgggacagggttatgggatgacagaggccgggcctgtgctatcaatgtgcttagccttttcaaagcaacctttcccaaccaagtctgggtcgtgtggaacggtggttagaaacgcagagctcaaggtcattgaccctgagaccggtcgctctcttggttacaaccaacctggtgaaatctgcatccgtggatcccaaatcatgaaaggatatttgaatgacgcggaagccacggcaaacaccatagacgttgagggttggctccacactggagatataggttatgtcgacgacgacgacgagattttcattgttgatagagtgaaggaaatcataaaattcaaaggcttccaggtgccgccagcggagcttgaggctctccttgtaaaccacccttcaattgcggatgcggctgttgttccgcaaaaagacgaggttgctggtgaagttcctgtcgcgtttgtggtccgctcagatgatcttgaccttagtgaagaggctgtaaaagaatacattgcaaagcaggtggtgttctacaagaaactgcacaaggtgttcttcgttcattctattcccaaatcggcttctggaaagattctaagaaaagacctcagagccaagcttgccacagccaccaccatgtcctag

SEQ ID NO: 14055 - protein, 570 aa, Populus tremuloides (quaking aspen)
MMSVATVEPPKPELSPPQNQNAPSSHETDHIFRSKLPDITISNDLPLHAYCFENLSDFSDRPCLISGSTGKTYSFAETHLISRKVAAGLSNLGIKKGDVIMTLLQNCPEFVFSFIGASMIGAVITTANPFYTQSEIFKQFSASRAKLIITQSQYVNKLGDSDCHENNQKPGEDFIVITIDDPPENCLHFNVLVEASESEMPTVSILPDDPVALPFSSGTTGLPKGVILTHKSLITSVAQQVDGEIPNLYLKQDDVVLCVLPLFHIFSLNSVLLCSLRAGSAVLLMQKFEIGSLLELIQKHNVSVAAVVPPLVLALAKNPLEANFDLSSIRVVLSGAAPLGKELEDALRSRVPQAILGQGYGMTEAGPVLSMCLAFSKQPFPTKSGSCGTVVRNAELKVIDPETGRSLGYNQPGEICIRGSQIMKGYLNDAEATANTIDVEGWLHTGDIGYVDDDDEIFIVDRVKEIIKFKGFQVPPAELEALLVNHPSIADAAVVPQKDEVAGEVPVAFVVRSDDLDLSEEAVKEYIAKQVVFYKKLHKVFFVHSIPKSASGKILRKDLRAKLATATTMS

SEQ ID NO: 14056 - DNA, 2001 bp, Arabidopsis thaliana (mouse-ear cress)
  CDS (1)..(2001)
atgacgtcgcagaaaagattcatctttgaggtggaagccgctaaggaagccacagatggaaatccctcggttggtcctgtctatcgtagtacttttgctcagaacggattcccgaacccgatcgatggtatccaaagctgctgggatattttccgcacggctgttgagaagtatccaaacaatcgaatgcttggtcgccgtgagatttcgaacgggaaggcaggaaagtacgtgtggaaaacatacaaagaagtatacgacattgtcataaaacttggaaattctctacgtagttgcgggattaaggagggagaaaaatgtggtatatatggtataaattgttgtgagtggatcattagcatggaggcatgtaatgcacatggcctttattgtgtccctttatacgatacgttaggcgctggtgcagtggaattcatcatttctcatgcagaggtttcaattgctttcgtggaggagaagaagatccctgagctttttaagacttgtccaaactcaacaaaatatatgaagactgttgtgagctttggcggtgtcaaaccggaacaaaaagaagaagctgaaaaattgggattggtaatacattcgtgggatgagtttttgaagctgggtgagggtaagcaatatgagcttcccattaaaaagccaagcgacatatgcacgattatgtatactagcggaacaactggtgacccgaagggagttatgatttcaaatgaaagcattgttactataactactggagtgatgcatttcctagggaatgtgaatgcaagcctatctgagaaggatgtgtatatttcttatcttcctctcgcgcacgtctttgatcgggcaatcgaggaatgtattattcaagtaggtggttcaattggtttctggcgcggggatgtcaaattgttgattgaagaccttggtgagctaaaaccaagtatcttttgcgccgttcctcgtgtcctagatcgagtatacacaggactacagcagaaactatctggtggtggtttcttcaaaaagaaggtgtttgatgttgctttttcctataaatttggaaatatgaagaaaggacagtctcatgtggcagcttctccattttgtgacaaacttgtattcaacaaggttaaacaaggacttggaggcaatgtgaggattattctgtctggagcggctcctctcgctagtcacatagaatcttttctaagagttgttgcatgttgtaatgttctacaaggatatggtctaactgagagttgtgctggaacttttgcaacgttcccagacgaactagacatgcttgggactgttggtccacccgtgccaaacgtcgatatacgccttgaatctgtcccggaaatgaattatgatgctcttggaagtactccgcgaggcgaaatatgcatacgaggaaaaactttattttcagggtactacaaacgtgaagacctcacaaaagaggtttttatcgacggatggttgcacacaggtgatgttggtgagtggcaaccaaatggaagcatgaagataattgaccggaaaaagaacatcttcaaactcgcgcaaggagagtatgtcgctgttgagaatttagaaaatgtctacagtcaagtagaagttattgaatcgatatgggtatatggaaacagctttgagtccttccttgtcgcaatcgctaacccggcccaacaaactcttgaacgatgggctgtggagaatggagtgaatggagacttcaactccatctgccaaaacgcaaaggcaaaagcattcatacttggagaactcgttaaaacagccaaagagaacaagttgaagggttttgagatcataaaagatgttcatctggaaccagtggcgttcgacatggaacgagaccttcttactccaacctacaaaaagaagaggcctcaattgctcaaatactatcagaatgtgatccatgaaatgtacaagacaacaaaggaaagtctagcttccggacagtaa

SEQ ID NO: 14057 - protein, 666 aa, Arabidopsis thaliana (mouse-ear cress)
MTSQKRFIFEVEAAKEATDGNPSVGPVYRSTFAQNGFPNPIDGIQSCWDIFRTAVEKYPNNRMLGRREISNGKAGKYVWKTYKEVYDIVIKLGNSLRSCGIKEGEKCGIYGINCCEWIISMEACNAHGLYCVPLYDTLGAGAVEFIISHAEVSIAFVEEKKIPELFKTCPNSTKYMKTVVSFGGVKPEQKEEAEKLGLVIHSWDEFLKLGEGKQYELPIKKPSDICTIMYTSGTTGDPKGVMISNESIVTITTGVMHFLGNVNASLSEKDVYISYLPLAHVFDRAIEECIIQVGGSIGFWRGDVKLLIEDLGELKPSIFCAVPRVLDRVYTGLQQKLSGGGFFKKKVFDVAFSYKFGNMKKGQSHVAASPFCDKLVFNKVKQGLGGNVRIILSGAAPLASHIESFLRVVACCNVLQGYGLTESCAGTFATFPDELDMLGTVGPPVPNVDIRLESVPEMNYDALGSTPRGEICIRGKTLFSGYYKREDLTKEVFIDGWLHTGDVGEWQPNGSMKIIDRKKNIFKLAQGEYVAVENLENVYSQVEVIESIWVYGNSFESFLVAIANPAQQTLERWAVENGVNGDFNSICQNAKAKAFILGELVKTAKENKLKGFEIIKDVHLEPVAFDMERDLLTPTYKKKRPQLLKYYQNVIHEMYKTTKESLASGQ

SEQ ID NO: 14058 - DNA, 2273 bp, Arabidopsis thaliana (mouse-ear cress)
  CDS (24)..(2024)
agagagagagagagagagagatcatgtcgcagcagaagaaatacatcttccaagttgaagaaggcaaagaaggtagcgatggaagaccatcagttggtccagtgtaccggagtatctttgccaaggacggatttcccgacccgatcgaaggaatggatagttgttgggatgttttccgcatgtctgttgagaagtatccaaacaatccaatgctgggacgccgcgagattgtagatggaaagccgggtaagtatgtctggcaaacataccaagaagtctacgacattgtcatgaaacttggaaattctctcagaagtgttggagttaaggacgaagcaaaatgtggtatctatggtgcaaattctcctgagtggattatcagcatggaggcttgtaatgcacatggactctattgtgtaccgttatatgatacactaggtgctgatgctgtggaattcatcatttcccattcagaggtttcaattgtctttgtggaagagaagaagatctctgagttgttcaagacatgcccaaactcgacagagtacatgaaaactgttgtgagcttcgggggtgtctcacgtgaacaaaaagaagaagctgaaacttttgggttggttatatatgcttgggatgaatttttgaagctgggtgaaggaaagcaatatgatctcccaatcaaaaagaaaagcgacatttgcacgattatgtatacgagtggaaccactggtgacccaaagggagtgatgatatctaacgaaagcattgtgactctaatcgctggagtgatccgtctactgaaaagtgctaacgaggctctgactgtgaaagatgtgtatctttcttatcttcctcttgcccacatctttgaccgagttatcgaggagtgtttcattcaacatggtgctgcaattggcttctggcgaggggatgtaaaattgttgatcgaagaccttgctgagcttaaaccaactattttttgtgctgtacctcgtgtcctggatagagtatactcaggtcttcagaagaagctttctgatggtggattcttaaaaaagttcatatttgattctgcattttcctataaatttggttatatgaagaagggacagtctcatgtggaggcctctccactttttgacaaacttgtgttcagcaaggttaaacaaggactcggaggcaatgtgaggattattctatctggagctgctcctcttgctagtcacgtagagtcatttctaagagtggtggcatgctgtcatgttctccaaggatacggtcttactgaaagctgtgctggaacttttgtctcgctgccagatgaactaggtatgctcggcacagttggtccaccagtgccaaacgttgatatacgccttgaatccgtccccgagatggaatatgatgctcttgcgagtactgcacgtggtgaaatctgcattcggggaaagacccttttctctggttactacaaacgtgaagatctcacgaaagaggttctcattgatggatggctgcacacaggtgatgttggtgagtggcaaccagatggaagcatgaagataattgacaggaagaagaatatctttaaactctcacaaggagagtatgttgcggtggagaacatagaaaacatatacggtgaagtacaagctgttgattccgtgtgggtgtacggtaacagctttgagtccttcctaatagctatcgccaacccaaaccagcatatccttgaacgctgggctgcagaaaacggtgtgagtggtgactatgacgctctctgtcaaaatgaaaaggcaaaggaattcattctcggagaacttgttaaaatggccaaagagaaaaagatgaaagggttcgagatcatcaaggcgattcatcttgacccagtgccatttgacatggaacgagatcttcttacgccgaccttcaaaaagaaaaggcctcagttgctgaaatactaccagagtgtgatcgacgaaatgtacaagaccataaatgcaaaatttgcttccagagggtagattcctcctcactctcggtccttgggtctctcattttgcatgacgaagactttgttaataggctcttctctcatctgtgtacaatatttgaatatttcatagcatcagatcagtccagagctgctacactgtttttcttttctatctttttttggaaatttacttttatgttctatacttgaatgctatctctttgccaaaaaaaaaaaaaaaagaatgctatctaacttttctttttaataaaatttt

SEQ ID NO: 14059 - protein, 666 aa, Arabidopsis thaliana (mouse-ear cress)
MSQQKKYIFQVEEGKEGSDGRPSVGPVYRSIFAKDGFPDPIEGMDSCWDVFRMSVEKYPNNPMLGRREIVDGKPGKYVWQTYQEVYDIVMKLGNSLRSVGVKDEAKCGIYGANSPEWIISMEACNAHGLYCVPLYDTLGADAVEFIISHSEVSIVFVEEKKISELFKTCPNSTEYMKTVVSFGGVSREQKEEAETFGLVIYAWDEFLKLGEGKQYDLPIKKKSDICTIMYTSGTTGDPKGVMISNESIVTLIAGVIRLLKSANEALTVKDVYLSYLPLAHIFDRVIEECFIQHGAAIGFWRGDVKLLIEDLAELKPTIFCAVPRVLDRVYSGLQKKLSDGGFLKKFIFDSAFSYKFGYMKKGQSHVEASPLFDKLVFSKVKQGLGGNVRIILSGAAPLASHVESFLRVVACCHVLQGYGLTESCAGTFVSLPDELGMLGTVGPPVPNVDIRLESVPEMEYDALASTARGEICIRGKTLFSGYYKREDLTKEVLIDGWLHTGDVGEWQPDGSMKIIDRKKNIFKLSQGEYVAVENIENIYGEVQAVDSVWVYGNSFESFLIAIANPNQHILERWAAENGVSGDYDALCQNEKAKEFILGELVKMAKEKKMKGFEIIKAIHLDPVPFDMERDLLTPTFKKKRPQLLKYYQSVIDEMYKTINAKFASRG

SEQ ID NO: 14060 - DNA, 1972 bp, Pinus taeda (loblolly pine)
  CDS (143)..(1756)
ctcattcaattcttcccactgcaggctacatttgtcagacacgttttccgccatttttcgcctgtttctgcggagaatttgatcaggttcggattgggattgaatcaattgaaaggtttttattttcagtatttcgatcgccatggccaacggaatcaagaaggtcgagcatctgtacagatcgaagcttcccgatatcgagatctccgaccatctgcctcttcattcgtattgctttgagagagtagcggaattcgcagacagaccctgtctgatcgatggggcgacagacagaacttattgcttttcagaggtggaactgatttctcgcaaggtcgctgccggtctggcgaagctcgggttgcagcaggggcaggttgtcatgcttctccttccgaattgcatcgaatttgcgtttgtgttcatgggggcctctgtccggggcgccattgtgaccacggccaatcctttctacaagccgggcgagatcgccaaacaggccaaggccgcgggcgcgcgcatcatagttaccctggcagcttatgttgagaaactggccgatctgcagagccacgatgtgctcgtcatcacaatcgatgatgctcccaaggaaggttgccaacatatttccgttctgaccgaagccgacgaaacccaatgcccggccgtgaaaatccacccggacgatgtcgtggcgttgccctattcttccggaaccacggggctccccaagggcgtgatgttaacgcacaaaggcctggtgtccagcgttgcccagcaggtcgatggtgaaaatcccaatctgtatttccattccgatgacgtgatactctgtgtcttgcctcttttccacatctattctctcaattcggttctcctctgcgcgctcagagccggggctgcgaccctgattatgcagaaattcaacctcacgacctgtctggagctgattcagaaatacaaggttaccgttgccccaattgtgcctccaattgtcctggacatcacaaagagccccatcgtttcccagtacgatgtctcgtccgtccggataatcatgtccggcgctgcgcctctcgggaaggaactcgaagatgccctcagagagcgttttcccaaggccatcttcgggcagggctacggcatgacagaagcaggcccggtgctggcaatgaacctagccttcgcaaagaatcctttccccgtcaaatctggctcctgcggaacagtcgtccggaacgctcaaataaagatcctcgatacagaaactggcgaatctctcccgcacaatcaagccggcgaaatctgcatccgcggacccgaaataatgaaaggatatattaacgacccggaatccacggccgctacaatcgatgaagaaggctggcttcacacaggcgacgtcgggtacattgacgatgacgaagaaatcttcatagtcgacagagtaaaggagattatcaaatataagggcttccaggtggctcctgctgagctggaagctttacttgtggctcatccgtcaattgctgacgcagcagtcgttcctcaaaagcacgaggaggcgggcgaggttccggtggcgttcgtggtgaagtcgtcggaaatcagcgagcaggaaatcaaggagttcgtggcaaagcaggtgattttctacaagaaaatacacagagtttactttgtggatgcgattcctaagtcgccgtccggcaagattctgagaaaggatttgagaagcagactggcagcaaaatgaaaatgaatttccatatgattctaagattcctttgccgataattataggattcctttctgttcacttctatttatataataaagtggtgcagagtaagcgccctataaggagagagagagagcttatcaattgtatcatatggattgtcaacgccctacactcttgcgatcgctttcaatatgcatattactataaacgatatatgttttttttttt

SEQ ID NO: 14061 - protein, 537 aa, Pinus taeda (loblolly pine)
MANGIKKVEHLYRSKLPDIEISDHLPLHSYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEIMKGYINDPESTAATIDEEGWLHTGDVGYIDDDEEIFIVDRVKEIIKYKGFQVAPAELEALLVAHPSIADAAVVPQKHEEAGEVPVAFVVKSSEISEQEIKEFVAKQVIFYKKIHRVYFVDAIPKSPSGKILRKDLRSRLAAK

SEQ ID NO: 14062 - DNA, 2103 bp, Caenorhabditis elegans
  CDS (1)..(2103)
atgtcctatcgaggattaaatttgattacccgacaagtgatttcacgcttgacatttcgatattctggtctttttactaggattacttacccgatttccgttcaagatcgtggattcttctttggaaaacgtcgtgtaccaagatgtgatctaaaaaaccaatcgattattcaagaagatggaggtagaaaggctgcgtggcttggagacggtcctctacaacacggatggtttgaaggcgttttgacaacatattcagggatccgtcgtggaccaactgtcggtggaaaagaaatgttggggaaaagagtgatgaaagatggaaaattggaatgggaatggatttcatatgatcaagcattcgaaacatctgatcatgcttcacaagctatcagaaagttgggaattgaaattggggaagaatcaaaaattggtatctactcgaataatcgtccagagtggattctctcagaaatggcaatacataacttcagcaacgtttctgttccactttacgacactattactaacgatgatatgcattatattactaacctttgcgaaatttctttgatgttcgttgacgccgaaataaaaactaaacaactcattcgcgataagtcctatttatcaagcttgaagtatatcgttcaatttaacgagtgctcagatgacattaaagaaatggcacgggaaaatgatttccgtctttggagtttcaatgagtttgtagaaatgggaaagaaacaaaagcatcgtccacatgttccaccaacaccagaaacattggcaacaatttcattcacttctggaacaactggacgtccgaaaggtgttatgctgactcatttgaatatgtgctccgccacaatgtcatgtgaagagtttgaaaatgaagctggagttcaagatgcttatctgtcttatcttcctcttgctcatatctacgaaagactctgcctactctctaacttcatgattggatcgcgaatcggattttctcgtggtgatcccaagcttctagtagatgacgttcaggctctggctcctcggtcatttgctactgttccacgtgttattgataaaatccataaggcagtcatgaagcaagttcaggataaaccactcaagaaaatgattttgaatgcggcaatagcctataaactataccattataagatgacaggcaaagctactcgtaaaacatgggtagataagtatgttttgcataaaatccagatgcttctcggtcctaacatcagacaattgattcttggagctgcaaaatcagacgtttccgcaatgaggtttgctcgtggggcttttggagttgaggttctggaaggatacggacaaactgaaacatctggaccaacaacacttcaattggttggagatacacgtattggatgtgttggaccaccgatggcttgtgcgatgataaaattaattgatgttcctgaacttggatattctgttgataaaaatggtggagaagtacttgtgaagggtcataacgtcacttcaggatattacaagaatccagaagcaactgcatcatctttcactgaagatggatacatgaaaactggagatattggaagattcactgctgaaggatctcttcaaattattgatcgacgcaaaaacgttttcaaaatgccacaaggaaagtttgtggctccagatctcacagaatccctctacacttcttcgagttttgtccaacagatttacgttcatggcgatatggaaaaaccgtggcttgtagcaatcgttgtcccagatccagagtatcttgcttcatatgcgctaaccaaacacaacatcaatgggaaaacctatgaacaattgtgcaacattccgattctcgcagatgatgtgctgcgacaatttgtagaactcacagaagaagataaaaggccaagatatgaaggggtgtacggcgttcacttgacgccagttgctttttcggctgaaaatgggttgacaacacctacattgaagaataagagaaatgctatcgcacagtttttcaaagcggaaattgatggaatgtataagaagattgagactagtgaactttcgaatttggcaaaatga

SEQ ID NO: 14063 - protein, 700 aa, Caenorhabditis elegans
MSYRGLNLITRQVISRLTFRYSGLFTRITYPISVQDRGFFFGKRRVPRCDLKNQSIIQEDGGRKAAWLGDGPLQHGWFEGVLTTYSGIRRGPTVGGKEMLGKRVMKDGKLEWEWISYDQAFETSDHASQAIRKLGIEIGEESKIGIYSNNRPEWILSEMAIHNFSNVSVPLYDTITNDDMHYITNLCEISLMFVDAEIKTKQLIRDKSYLSSLKYIVQFNECSDDIKEMARENDFRLWSFNEFVEMGKKQKHRPHVPPTPETLATISFTSGTTGRPKGVMLTHLNMCSATMSCEEFENEAGVQDAYLSYLPLAHIYERLCLLSNFMIGSRIGFSRGDPKLLVDDVQALAPRSFATVPRVIDKIHKAVMKQVQDKPLKKMILNAAIAYKLYHYKMTGKATRKTWVDKYVLHKIQMLLGPNIRQLILGAAKSDVSAMRFARGAFGVEVLEGYGQTETSGPTTLQLVGDTRIGCVGPPMACAMIKLIDVPELGYSVDKNGGEVLVKGHNVTSGYYKNPEATASSFTEDGYMKTGDIGRFTAEGSLQIIDRRKNVFKMPQGKFVAPDLTESLYTSSSFVQQIYVHGDMEKPWLVAIVVPDPEYLASYALTKHNINGKTYEQLCNIPILADDVLRQFVELTEEDKRPRYEGVYGVHLTPVAFSAENGLTTPTLKNKRNAIAQFFKAEIDGMYKKIETSELSNLAK

SEQ ID NO: 14064 - DNA, 2064 bp, Caenorhabditis elegans
  CDS (1)..(2064)
atgaccaacgaaacagccttaacagtggcagccgcaattcttggttccacttattttttgtattgtaaactgttaaaaaccgcaaaattatcacttccaaatgggctttctgttgataagcaagctgttgaagtaaagggtcaaccaggagtatggaaaagtgctctaatggaaaatgagtccgaagacgttctcactagattctacccagaagtcgccacacttcatgacgtctttgtcaaaggaaaaacggaaagcaatggcggtccatgtgtgggtacccggtcatctggcgacgcagattacgagttcctaacctatgatgatgttcatgaacaggcgaagaatttatcaatgacattagtacatgagtttggactgactccagccaacaccaccaacatcggaatctacgctcgaaactcaccacaatggctcgtcagcgccgtcgcgtgcgtcgagcagtcaatggtagtggttccactctacgacacccttggtgcagaagccgccacttttatcatttctcaagcggaaatcagtgtggtcattgtggattcgttcaagaaagcagagagtttgatcaagaacagagaaaatatgccaacgttgaagaatatcattgttatcgatagtgcggatgagttgaaggatggaactgccatcatcgacaccatccgcgtcgaatctctcacaaacgccttgaacctcggatcccgttacccattcaccaataacctcccaaaaccagatgacaactacattatttgctatacgtcaggaaccactggaaccccgaaaggagttatgctgacccactcaaacattgtcgccaatattagcggattcttgaagattctatttgcattccaaccgtcgatgattgatgcgacgcaggtccacatctcctacctcccactttcccatatgatggagcagctcactcactggacacttcttgggtttggatctaagattggttacttccgtggaagcattcaaggcctcactgatgatatcaagacactgaagcctactgtgttcccggttgttccacgacttttgaatcgactctatgatgcgattaccagcaaagtccaacagcaagggtttatggcaaaactggtgtacaattttgcttttgcccgcaagctcagtctcgtcaaagccggaaaagtcggtcgtgacactatctgggatcgtctggtgttcaacaaaatccaacaacaaataggaggaaaagtagatctcatggttacaggatccgcgccaatctcttccaccgttcttgagacctgcagagtcacacttggaaccacaattgtcgaagggtacggtcagaccgagtgcaccgcattggcaacgtttacctggatgggagacccgagcaccgggcattgtggggctccggcgccatgtgctttggtgaagctcggggatgtgccggatttgaactactttgcgaaggatggaaaaggagagatccgaatcaagggaccatgtgtgacgaaagggtactacaaggatccagagagaaccgccgagttgtttgatgaagagggattcctgcaaaccggagacatcggagagatgcttccaaacggaactattcgaatcattgaccgaaagaagcacattttcaaactggcgcagggagaatacgtggcaccagaaaaaattgagcaggtctacattaggacacccgttgtgcaacaggtctatgtcgatggagatagcttggaaagatggctcatcgctgttgtcgtgccagaacccgatgtgcttaaagaatggaatgataaacaaggatccggatcaagaaaaattgaagaaatctgcaatgacgagaaggctaaggagttcgtgctcagtgagctgcatgcaattggaaaagctaacaagttgaattctatcgagcaagttaaaaaagtgatcttaacgtctgacacgtttactgtcgaaaatggacttctaaccccaacgctgaaagcaaaacgaccacaattgaggctgaaatataaggatggcatggcaaaagtgtataagcaatttccaaatctttaa

SEQ ID NO: 14065 - protein, 687 aa, Caenorhabditis elegans
MTNETALTVAAAILGSTYFLYCKLLKTAKLSLPNGLSVDKQAVEVKGQPGVWKSALMENESEDVLTRFYPEVATLHDVFVKGKTESNGGPCVGTRSSGDADYEFLTYDDVHEQAKNLSMTLVHEFGLTPANTTNIGIYARNSPQWLVSAVACVEQSMVVVPLYDTLGAEAATFIISQAEISVVIVDSFKKAESLIKNRENMPTLKNIIVIDSADELKDGTAIIDTIRVESLTNALNLGSRYPFTNNLPKPDDNYIICYTSGTTGTPKGVMLTHSNIVANISGFLKILFAFQPSMIDATQVHISYLPLSHMMEQLTHWTLLGFGSKIGYFRGSIQGLTDDIKTLKPTVFPVVPRLLNRLYDAITSKVQQQGFMAKLVYNFAFARKLSLVKAGKVGRDTIWDRLVFNKIQQQIGGKVDLMVTGSAPISSTVLETCRVTLGTTIVEGYGQTECTALATFTWMGDPSTGHCGAPAPCALVKLGDVPDLNYFAKDGKGEIRIKGPCVTKGYYKDPERTAELFDEEGFLQTGDIGEMLPNGTIRIIDRKKHIFKLAQGEYVAPEKIEQVYIRTPVVQQVYVDGDSLERWLIAVVVPEPDVLKEWNDKQGSGSRKIEEICNDEKAKEFVLSELHAIGKANKLNSIEQVKKVILTSDTFTVENGLLTPTLKAKRPQLRLKYKDGMAKVYKQFPNL

SEQ ID NO: 14066 - DNA, 2172 bp, Caenorhabditis elegans
  CDS (1)..(2172)
atgctcaatcaaagtgtgcggtttttggctcgccgagcaaattctcagatccggcgttccaatcttctgaagactggctcacttgcagctcaagatcgtggctttttcttcgggaaacgtcgtgaaccaagatgcgatttgaaaaatcaatcaattgttcaagcagatggaagtagaaagtctgcatggctcggagacaaaccacttcgacacgaatcgttcattggaatactgactacttatgcggggattcgccgcggaccaactgtcggtggaaaagaaatgttagggaagagagtgatgaaaaatggaaaattggaatgggaatggataacgtatgagcaagcattcgaaatatctgataatgtatcacaagctatcagaaagttgggaattgagattggcgataagtctaatattgggatttactcaaaaaatcgaccagagtgggtcttgtccgacatggcaattcacaacttcagcaatgtttctgttccaatatacgataatatacccaatgaagatatgcattacataaccaacctttgtgaaatcccgttaatgtttgtcgatagtgaagataagactactcaactcatcaaagacaaaacctatttgtcaaaaagtttgaaatacattgtacaatttgacaaggtatccgatgagatgaaggcaatggcggagagcaataatttccaattgtggagttttgatgagtttgtagaactgggaaagaagcatgagcatcgtccacatgctccaccaacacctgagacgctggcaacaatctcattcacttctggaactactgggcgtccgaaaggagccatgctgactcacttgaacttgtgctctacaacagttgcctgcgaagaatttgagcatgttgagggggagctggattcgtatctttcttatcttccattggctcatgtgtacgagagacactgcactcttgcgcacttcaaaatcggatcaaatttccataattttttaaacaaatttgttgaagtgttctttttttttaaaagaatttcctctaaagttacaaaaattttcagaagaatcggcttctcccgtggtgatccagctcttttggtagaggacattcaagcacttgctccacgtacatttgcctgcgttcctcgagttttaggcaagatctataagtctgtaatgagccaagtgcaggataagccggtgaaaaagatgattctaaactctgcaatagcttacaaattgtatcattacaaaatgaccggaaaagctacccgggatactttggtggacaaatatattctgcacaagattcagatgattctcggccccaatatcaaacaatttctgattccggctgcaaaaactgataattcctcaatgagatttgctcgtggagcctttggaattgagatccttgagctatacggcctaaccgagacttccgggcctacaacaattcagttggttggagatatgttgggatctgttgggccgcctatctcatgtacctcgataaaacttgtcgatattgcggaacttggatactttgtcgatgaaaatggaggtgaagtccttgtaaagggtcataacgtcacttcaggatattacaaggatcccaaagcaactgcatcagcattcacagaagatggatttatgaagactggagatattggaaaattcactcctgaaggaactctccagcttatagatcgccgcgacaacgtactaaaacttcctcaaggagagtttgtagctccggatctcacagagtctttgtacatttcatcaaaatttgtacaacaaatttgtgtgcatgggaataaggaaaaaccatggctcgtagcagtcgtcgttccagatccagagtacctggcttctcatgccaatctggagcacaatatcgagggaaagacctacgaggagttgtgcaaaattccggctctcgctgaagatgtgctccatgcccttataaaattttttatttgggtatttgccatacatctcactcccatcgccttctcaccgcaaaatggcttgacaactccaactcataaaaacaagaggactgcaattgcacagttcttcaagaaacaaattgtagaaatgtttgacaggattgagaaagaagaagaaggcaccgaattgaccacaaaaatcgaaaatgctcattga

SEQ ID NO: 14067 - protein, 723 aa, Caenorhabditis elegans
MLNQSVRFLARRANSQIRRSNLLKTGSLAAQDRGFFFGKRREPRCDLKNQSIVQADGSRKSAWLGDKPLRHESFIGILTTYAGIRRGPTVGGKEMLGKRVMKNGKLEWEWITYEQAFEISDNVSQAIRKLGIEIGDKSNIGIYSKNRPEWVLSDMAIHNFSNVSVPIYDNIPNEDMHYITNLCEIPLMFVDSEDKTTQLIKDKTYLSKSLKYIVQFDKVSDEMKAMAESNNFQLWSFDEFVELGKKHEHRPHAPPTPETLATISFTSGTTGRPKGAMLTHLNLCSTTVACEEFEHVEGELDSYLSYLPLAHVYERHCTLAHFKIGSNFHNFLNKFVEVFFFFKRISSKVTKIFRRIGFSRGDPALLVEDIQALAPRTFACVPRVLGKIYKSVMSQVQDKPVKKMILNSAIAYKLYHYKMTGKATRDTLVDKYILHKIQMILGPNIKQFLIPAAKTDNSSMRFARGAFGIEILELYGLTETSGPTTIQLVGDMLGSVGPPISCTSIKLVDIAELGYFVDENGGEVLVKGHNVTSGYYKDPKATASAFTEDGFMKTGDIGKFTPEGTLQLIDRRDNVLKLPQGEFVAPDLTESLYISSKFVQQICVHGNKEKPWLVAVVVPDPEYLASHANLEHNIEGKTYEELCKIPALAEDVLHALIKFFIWVFAIHLTPIAFSPQNGLTTPTHKNKRTAIAQFFKKQIVEMFDRIEKEEEGTELTTKIENAH

SEQ ID NO: 14068 - DNA, 1797 bp, Streptomyces coelicolor
  CDS (1)..(1797)
atgcgcgagttcagccttccggccttgtacgaggtccccgcggacggaaacctgaccgacatcgtccgcagaaacgccgcgcagcatcccgatgtcgccgtcatcgcccgcaaggtgggaggcgtctggcaggacgtcaccgcgcgcgccttcctcgccgaggtgcactccgccgccaaggggctcatcgcctccggtgtccagccgggcgaccgggtcggcctgatgtcccgcacgcgctacgagtggacgctgctggacttcgcgatctggagcgcgggcgcgatcaccgtgccggtgtacgagaccagctcgccggagcaggtgcagtggatcctcggcgactcgggcgccacggcgtgcgtggtggagtcggccgggcacgccgccgccgtcgagtcggtgcgcgagcagctgcccgccctcaagaacgtctggcagatcgacgccggcgccgtggaggagctggggcggctgggccaggacgtcacggaccgcaccgtcgaggagcgcggctcgatcgcgaaggcggacgaccccgcgaccatcgtgtacacctccggcaccacgggccgccccaagggctgcgtcctgacccaccgcagcttcttcgcggagtgcggcaacgtcgtcgagcggctgcgtccgctcttccgcaccggtgagtgctcggtcctcctcttcctgccgctcgcccacgtcttcggccgcctggtccaggtcgcgccgatgatcgcgccgatcaagctgggcaacgtccccgacatcaagaacctcaccgacgagctggccgccttccggcccacgctgatcctcggcgtgccccgcgtcttcgagaaggtgtacaactcggcgcgcgccaaggcccaggcggacggcaagggcaagatcttcgacaaggccgccgacaccgcgatcgcgtacagcaaggccctggacgccccgtcgggcccgtccgtcggcctgaagatcaagcacaaggtcttcgacaagctcgtctacagcaagctccgcacggtcctcggcgggcgcggcgagtacgccatctccggcggcgccccgctcggcgagcggctggggcacttcttccgcggcatcggcttcacggtcctggagggctacggcctgaccgagtcctgcgcggccaccgccttcaacccctgggaccggcagaagatcggcacggtgggccagccgctgcccggctcggtggtgcgcatcgcggacgacggcgaggtgctgctgcacggcgagcacctgttcaaggagtactggaacaacccgggcgcgaccgcggaggcgctggccgacggctggttccacaccggcgacatcggcaccctggacgaggacggctacctgcggatcaccggccgcaagaaggagatcatcgtcaccgccggcggcaagaacgtcgccccggccgtcatggaggatcgcatccgcgcgcacgcgctggtcgcggagtgcatggtggtcggcgacgggcggcccttcgtgggcgcgctggtcaccatcgacgaggagttcctcggacgctggtgcgcggagcacgggaagccggccggctcgacggcggtgtcactgcgggaggatccggaactgctcgcggcgatccaggacgcggtcgacgacgggaacgcggcggtgtccaaggcggagtcggtgcggaagttccgggtgctgggggcgcagttcaccgaggactcggggcatttgactccgtcgttgaagctgaagcggaatgtcgtcgcgaaggactatgccgacgagatcgaggcgatctactccaagtag

SEQ ID NO: 14069 - protein, 598 aa, Streptomyces coelicolor
MREFSLPALYEVPADGNLTDIVRRNAAQHPDVAVIARKVGGVWQDVTARAFLAEVHSAAKGLIASGVQPGDRVGLMSRTRYEWTLLDFAIWSAGAITVPVYETSSPEQVQWILGDSGATACVVESAGHAAAVESVREQLPALKNVWQIDAGAVEELGRLGQDVTDRTVEERGSIAKADDPATIVYTSGTTGRPKGCVLTHRSFFAECGNVVERLRPLFRTGECSVLLFLPLAHVFGRLVQVAPMIAPIKLGNVPDIKNLTDELAAFRPTLILGVPRVFEKVYNSARAKAQADGKGKIFDKAADTAIAYSKALDAPSGPSVGLKIKHKVFDKLVYSKLRTVLGGRGEYAISGGAPLGERLGHFFRGIGFTVLEGYGLTESCAATAFNPWDRQKIGTVGQPLPGSVVRIADDGEVLLHGEHLFKEYWNNPGATAEALADGWFHTGDIGTLDEDGYLRITGRKKEIIVTAGGKNVAPAVMEDRIRAHALVAECMVVGDGRPFVGALVTIDEEFLGRWCAEHGKPAGSTAVSLREDPELLAAIQDAVDDGNAAVSKAESVRKFRVLGAQFTEDSGHLTPSLKLKRNVVAKDYADEIEAIYSK

SEQ ID NO: 14070 - DNA, 2094 bp, Neurospora crassa
  CDS (1)..(2094)
atggcgaacacagggcccggaaacgtgcctttgcacttcatccagaaacctccctttaccgtcgaggaccccaatgcccaaccgatcccaggcgagaccattccccgccgacatcccaaggctaagaatggcctcgcgactcgccctgcccccggagtcaacaccactctagacctcctcactagaaccgtggagctgtacggtgatgagcgcgccataggaagccgcaagctgatcaagcttcacaaggacatcaaaaaggtccccaaggtcgttgacggcgagaccgtcatggtggacaaggaatggcaatgctttgagcttactccgtattcgtacatcacctatggagaatatttcaccatcgtgaagcagataggcgctggtcttcgcaagctcggcttggaacccaaggacaaattgcacatctttgctactacgagcccccaatggctcggcatgtcgcatgccgcctcgtcccagtctctcaccattgttaccgcatacgacaccctcggtgagagcggcgtccaacactcccttgtccagagcaaggcgagcgccatgttcaccgaccctcaccttctcaagacagctacgaacccgctcaaggaggctacatccgtcaaggtcgtcatctacaacaaccacactacgcagcccgtgtcccaagacaagattgatgccttcaaggccgagcacccggaccttaccgtgctctctttcgaagagcttcgtgctctcggcgaagagaaccccgtcccactcacaccccccaatccggacgatacctactgcattatgtacacctccggcagcaccggtccaccgaagggcgttcccgtcagtcacgctggctttgtcgccgccgtagccggtctctacgccgtcatggaggaatccgtcacccaccgcgaccgagttctcgcctacctgccgcttgcccacatcttcgaactcgtcctcgagaacctcggcgtcttcgttggcgggacccttgggtactcaaatgcccgtaccctttccgacaccagcatgcgcaactgcccgggcgacatgcgcgccttcaagcccaccatcatggtcggcgttccgcaggtttgggagaccgtcaagaagggcatcgagggcaaggtcaacagcgccggcgccctcaccaaggccctgttctggggcgcctacaacatcaagtccttccttgtctccaataacctacccggaaagaccatctttgatgatctcgtctttggccaggtgcgcaccatgacgggtggcgagctgcgcttcattgtcaacggcgccagtggtatcgccgcctccacgcagcatttcatgtccatggtggttgcgcccatgctaaacggatatggcctaaccgagacctgcggcaacggcgccctcggctcccccatgcaatggacctccaacgccatcggcgccatgcccgccgccgtggaaatgaaactcgtctccctccccgaactcaactatcacaccgacacggttccgccccagggagaaatcctcttccgtggcgcctgcgtcataaaagagtactacgaaaaccccgaagaaaccgccaaggccatcacccccgacgggtggttcaaatccggcgacattggcgagatcgacgccaacggccatttgcgggtaatcgaccgcgtcaagaacctcgtcaagctccagggcggcgagtacattgccctggagaaactcgaggctgtgtatagaggagccgtgtttgtgcataacattatggtgcatggtgacaatagtgccccgaggccgatcgcggtggtggtacctaatgagaaagcgttggcagagaaagcagaggagttgggactaggcgcggaagcgccgggtgagatgcacaggaataggaagttgagggatgcggtgctgaaggagttgcagagtgtgggaaggagggctgggttaagtggaatggagacggtggcgggggtggtgttggttgatgatgagtggacgccggcgaatggttttgttactgctacgcaaaagattaataggagagcggtgaaggaaaggtactcgaaggagatttcggattgtcttgatgggaaataa

SEQ ID NO: 14071 - protein, 697 aa, Neurospora crassa
MANTGPGNVPLHFIQKPPFTVEDPNAQPIPGETIPRRHPKAKNGLATRPAPGVNTTLDLLTRTVELYGDERAIGSRKLIKLHKDIKKVPKVVDGETVMVDKEWQCFELTPYSYITYGEYFTIVKQIGAGLRKLGLEPKDKLHIFATTSPQWLGMSHAASSQSLTIVTAYDTLGESGVQHSLVQSKASAMFTDPHLLKTATNPLKEATSVKVVIYNNHTTQPVSQDKIDAFKAEHPDLTVLSFEELRALGEENPVPLTPPNPDDTYCIMYTSGSTGPPKGVPVSHAGFVAAVAGLYAVMEESVTHRDRVLAYLPLAHIFELVLENLGVFVGGTLGYSNARTLSDTSMRNCPGDMRAFKPTIMVGVPQVWETVKKGIEGKVNSAGALTKALFWGAYNIKSFLVSNNLPGKTIFDDLVFGQVRTMTGGELRFIVNGASGIAASTQHFMSMVVAPMLNGYGLTETCGNGALGSPMQWTSNAIGAMPAAVEMKLVSLPELNYHTDTVPPQGEILFRGACVIKEYYENPEETAKAITPDGWFKSGDIGEIDANGHLRVIDRVKNLVKLQGGEYIALEKLEAVYRGAVFVHNIMVHGDNSAPRPIAVVVPNEKALAEKAEELGLGAEAPGEMHRNRKLRDAVLKELQSVGRRAGLSGMETVAGVVLVDDEWTPANGFVTATQKINRRAVKERYSKEISDCLDGK

SEQ ID NO: 14072 - DNA, 1860 bp, Corynebacterium glutamicum
  CDS (1)..(1860)
atgaatttgaccatgacttcacctaataccctgcaggaatacactgaacctgccaagtacaccatcggagaatctgaaacctgcctgaccgcccttctagatcagattaagactcgaccttacggagttttgttcagcaagcctgccaactatgagtgggtgaatgtaactgccaaagaatttcaggacgaggtttttgcggttgcaaaaggaattatttcagtcggcgtagagcagggagaccgtgtcgcgctgctgtccaatactcgctatgagtgggctgtgcttgatttcgctatctgggccgctggcgcagtgagcgtgcctatctacagctcctcttcactgtcccaaattgagtggatcattgaggattccggcgctgttttggccattaccgaaacccctgatcataccgacttgatgaagaacctggtcatcggtgaagacggaactccagcgattaagggttcaccttccaagctgcgccgcattctagagatcaactcttcggcgttggagaccttgaagtttgagggccgcgagctttctgatgagctggtgtgggaacgcattcatgcaaccaaggccgctgacctggcgtctttggtgtacacctctggcacaactggtaggccgaagggctgcgagttgtcccactaccactggttggctgaggtccgagcgctgatcaccaatgacatcggagcgatcgcgatgccaggttcaaggttgctcaccttccttcctttggcgcacgttcttgctcgcgcagtgcacttggccttcgctgtcaccggtgcaacccagtcccactggtctgatttcagcacccttactttggaactgcagcgttcccgcccgaacctgattttgggtgttccacgcgtgtttgaaaaggtccgcaacgccgctgctgctaatgctgctgacggtggcgcaatcaagcgcatcatgtttgagcgtgccgaaaaggcggccattgaatactccatggctcttgatactgcagaaggcccaagcaagtcccaggttatggcacataaagcgtttgacaagctggtgtactccaagatccgtgcagctgtcggtggcgatgtgcagtacgccatcaccggtggttcagcgatggggcaggagctgctgcacttcttccgcggtgtgggcatgaccatctacgaaggttatggtctgacggaatctgcggctgctgcagcggtggacttcactgatcaaaagatcggcactgtgggtaagccgatgggtggcatgaccatcaagatcaatgaagatggcgaaatcatgctaaaaggcgagatgttgttccagggatattggaacaacccagaagccacagcagaagccctccacgacggttggttcaacaccggcgatctgggtgagctgttggagtctggacacctggtgatcaccggacgtaagaaagatctgatcgtgaccgcgggcggcaagaacgtttccccaggacccatggaagacatcatccgcgcacacccactggtcagccaggccatggtggtgggcgatggtaaaccattcgttggcctgctggtgaccttggatccagatatgttgaagcggtggaagctgaaccacaacattgcggaatcccgcacggtttctgagattgctactgatcctgcactgcgtgcggaaatccaggatgcagtcaacaacgctaatgccacggtgtctcattcagaggcgatcaagcggttctacatccttgatcgcgacctgaccgaggaagccgacgagctgaccccaacgctgaaggtcaagcgcaacgttgttgttcgccgttacgcagacgccatcgaccacatctacaaccgatga

SEQ ID NO: 14073 - protein, 619 aa, Corynebacterium glutamicum
MNLTMTSPNTLQEYTEPAKYTIGESETCLTALLDQIKTRPYGVLFSKPANYEWVNVTAKEFQDEVFAVAKGIISVGVEQGDRVALLSNTRYEWAVLDFAIWAAGAVSVPIYSSSSLSQIEWIIEDSGAVLAITETPDHTDLMKNLVIGEDGTPAIKGSPSKLRRILEINSSALETLKFEGRELSDELVWERIHATKAADLASLVYTSGTTGRPKGCELSHYHWLAEVRALITNDIGAIAMPGSRLLTFLPLAHVLARAVHLAFAVTGATQSHWSDFSTLTLELQRSRPNLILGVPRVFEKVRNAAAANAADGGAIKRIMFERAEKAAIEYSMALDTAEGPSKSQVMAHKAFDKLVYSKIRAAVGGDVQYAITGGSAMGQELLHFFRGVGMTIYEGYGLTESAAAAAVDFTDQKIGTVGKPMGGMTIKINEDGEIMLKGEMLFQGYWNNPEATAEALHDGWFNTGDLGELLESGHLVITGRKKDLIVTAGGKNVSPGPMEDIIRAHPLVSQAMVVGDGKPFVGLLVTLDPDMLKRWKLNHNIAESRTVSEIATDPALRAEIQDAVNNANATVSHSEAIKRFYILDRDLTEEADELTPTLKVKRNVVVRRYADAIDHIYNR

SEQ ID NO: 14074 - DNA, 1653 bp, Photinus pyralis
  CDS (1)..(1653)
atggaagacgccaaaaacataaagaaaggcccggcgccattctatcctctagaggatggaaccgctggagagcaactgcataaggctatgaagagatacgccctggttcctggaacaattgcttttacagatgcacatatcgaggtgaacatcacgtacgcggaatacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgaacatttcgcagcctaccgtagtgtttgtttccaaaaaggggttgcaaaaaattttgaacgtgcaaaaaaaattaccaataatccagaaaattattatcatggattctaaaacggattaccagggatttcagtcgatgtacacgttcgtcacatctcatctacctcccggttttaatgaatacgattttgtaccagagtcctttgatcgtgacaaaacaattgcactgataatgaattcctctggatctactgggttacctaagggtgtggcccttccgcatagaactgcctgcgtcagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttttacgatcccttcaggattacaaaattcaaagtgcgttgctagtaccaaccctattttcattcttcgccaaaagcactctgattgacaaatacgatttatctaatttacacgaaattgcttctgggggcgcacctctttcgaaagaagtcggggaagcggttgcaaaacgcttccatcttccagggatacgacaaggatatgggctcactgagactacatcagctattctgattacacccgagggggatgataaaccgggcggggtcggtaaagttgttccattttttgaagcgaaggttgtggatctggataccgggaaaacgctgggcgttaatcagagaggcgaattatgtgtcagaggacctatgattatgtccggttatgtaaacaatccggaagcgaccaacgccttgattgacaaggatggatggctacattctggagacatagcttactgggacgaagacgaacacttcttcatagttgaccgcttgaagtctttaattaaatacaaaggatatcaggtggcccccgctgaattggaatcgatattgttacaacaccccaacatcttcgacgcgggcgtggcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagtccaaattgtaa

SEQ ID NO: 14075 - protein, 550 aa, Photinus pyralis
MEDAKNIKKGPAPFYPLEDGTAGEQLHKAMKRYALVPGTIAFTDAHIEVNITYAEYFEMSVRLAEAMKRYGLNTNHRIVVCSENSLQFFMPVLGALFIGVAVAPANDIYNERELLNSMNISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGGVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKSKL

SEQ ID NO: 14076 - DNA, 1962 bp, Caenorhabditis elegans
  CDS (1)..(1962)
atggttcagaaaaagatgctaacccacccggaattattttctcggctagttgatggaccggaaaggattcgagaaagtgtacaggtcccaaaaccaataaccgggtgcccagacggaatcaccaaaaccgtgtgggatgtgcttactcgaagtgcccagctcaacccaaatgctccgctattcggagaaagtgtgaacggcagacatgtgtataccacttatcgcgaagctgttgaagaagccacaataattggatcaggcattgtggcaattatgcaaaagaatcaatccactaacaaattgattggaatcgctggaattcactcgagaaaatatatgcacacgatgcatggaattagcgggtttgacctgactacagtaccactttatcatcaatcgaaattggagactttgtgcgacatcatcgacaactgcaagctggaaatcattttctgcgaaaacgcaaagcgcgccgaagggttcctgtcgtcgaaactcggagatcgtcttcgttcgttgaagaccttaattattcttgacaagacgactacccttcagaagcatgatgacgtggaagtgatgagcttggatgaattcaaggagatcgggaaaaggaataagagaaatccagtgaaaccaaaacccgagacaacctatgtgatttgccataccagtggtactacaggacgtcctaaaggtgttgaaatgtcacatggaagcctcgtgacgtcagtctccggaatcttcacctcctggacaatagcctataaatggaagtttggactggaagacacttacttcagttttctatccttagctcacatctatgagcatttgattcaaacgttgactatatactttggagggaaaattggaatttatgatggtaacactgccacactcattccgcagattcagaagttggagccaacgattgtttcgttggtgccacggctcttgaataagctctatgaagctgtgcacgatggggtggcgaagaagggattcattgcgaggaagctatttgattatgcgaaaaagaccaaggctcgtcagctccagcgcggtgtgctccgttatgacactttctttgacaaaatcgttttcaagaagctaaaactgatgctcggcgggaagctcaaggttctcacttctggtggggctccaatcacaaaagaggtcaaaacgttcaccagatatgcctatgggtgtccccttgtagagggttatggacagacggaatgtagtgcagccggtacactgactcttccatgggacactacttatggaaatgttggtgggccggctccttgggctcaggttaagctggtggatgttccggagaagaattatttttcaatgaatgatgaaggagaggtgtgcttccgtggaaatgcgatgatgactggatactttcaagatcctgaattaaccgcaaaaaccatcgattcggaaggttggctccacactggagatatcggaaaatggcttccaaccggcggcctccaaatcatagatcgcaaaaacgagatgttcaagctcagccaaggagattttgtatcgccaattcaaatcgaagcaatctacgcaaattccccgcttatcactcaaatatatgtcaccggaaaaactgaacgatcgtttttagttggaattgtggttctagacttgccacgattcaagcaacttccgctggtgaaggcgttggacggaaaagagagcatcgagatgataatggagaataaggaagtgaaaaatgcagttattgcagagttgaataaatatgcaaagcagaatggacttcaaacaattgagcttatcagaaatgtgcatttgacattgcaggaatttaccgaagaaaatggcttgataacttcaacccttaaaaatcgcagaaagattttggaagactactttgcaccccaaattgcaaagatgtacaaggaagttgaagcgctgtaa

SEQ ID NO: 14077 - protein, 653 aa, Caenorhabditis elegans
MVQKKMLTHPELFSRLVDGPERIRESVQVPKPITGCPDGITKTVWDVLTRSAQLNPNAPLFGESVNGRHVYTTYREAVEEATIIGSGIVAIMQKNQSTNKLIGIAGIHSRKYMHTMHGISGFDLTTVPLYHQSKLETLCDIIDNCKLEIIFCENAKRAEGFLSSKLGDRLRSLKTLIILDKTTTLQKHDDVEVMSLDEFKEIGKRNKRNPVKPKPETTYVICHTSGTTGRPKGVEMSHGSLVTSVSGIFTSWTIAYKWKFGLEDTYFSFLSLAHIYEHLIQTLTIYFGGKIGIYDGNTATLIPQIQKLEPTIVSLVPRLLNKLYEAVHDGVAKKGFIARKLFDYAKKTKARQLQRGVLRYDTFFDKIVFKKLKLMLGGKLKVLTSGGAPITKEVKTFTRYAYGCPLVEGYGQTECSAAGTLTLPWDTTYGNVGGPAPWAQVKLVDVPEKNYFSMNDEGEVCFRGNAMMTGYFQDPELTAKTIDSEGWLHTGDIGKWLPTGGLQIIDRKNEMFKLSQGDFVSPIQIEAIYANSPLITQIYVTGKTERSFLVGIVVLDLPRFKQLPLVKALDGKESIEMIMENKEVKNAVIAELNKYAKQNGLQTIELIRNVHLTLQEFTEENGLITSTLKNRRKILEDYFAPQIAKMYKEVEAL

SEQ ID NO: 14078 - DNA, 3525 bp, Mycobacterium leprae
  CDS (1)..(3525)
atgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgccgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcgcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatagcggagaccccaaactgctggcgcactaccaggaactggcaaccgaccacctggaggtcatcgccggcgacaaaggcgaagtagatctggaattggaccggcaaacgtggcgacgactggccgacacggtcgatctgatcgtcgaccccgccgccctggtcaaccacgtgctgccgtacagcgagctattcggccccaatacgttaggcaccgccgagctgattcggatcgcgctgaccagtaagcaaaagccgtacatctatgtgtcgacaatcggcgtcggtaatcagattgagccagcaaaattcaccgaagactccgacatccgagtcattagcccgacgcgcaacatcaacaacaactatgccaacggctacggcaacagcaagtgggccggcgaagtgctgctgcgcgaagctcacgacctatgcggtctgccggtcacggtcttccgctgcgacatgatcttggccgacaccagctatgccggtcagctcaacgtccccgacatgtttactcgaatgatgctgagtctagccgccaccggcatcgcacccggctcgttctacgagctagacgccgagagcaatcggcaacgcgcccactacgacggtctgcccgtcgagttcatcgccgaagcgatctccaccctgggagaccaaagcctgcacgatcgagacgggttcacgacctatcatgtaatgaacccgcacgacgacggcatcggtatggacgagtttgtggactggttaattgatgccggctgccctatacaacgcatcaacgactacgacgaatggctgcgacggtttgagatttcgctgcgcgccctgcccgaaaggcagcgtcacagctcactgttgccgttgttgcacaactaccagaagccggagaagccattgcacgggtcgctggcacccacaatccggttccgtacggccgttcaaaacgcgaacattggtcaggacaaagatattccgcatatctcgccggcaatcatcgccaaatatgtcagcgatctgcagctgctcgggctggtttga

SEQ ID NO: 14079 - protein, 1174 aa, Mycobacterium leprae
MSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 14080 - DNA, 2460 bp, Plasmodium falciparum
  CDS (1)..(2460)
atgggtaaagtttttactatttatgtttttgttatttatctaatttatataagaccaaatgttagccaatttactagtgaatatgaagggtactcagaaatatgtgaaaaggcaaccaatgaaaatgaatcgtgtgtatactgcatgaaggatcataaaaggaaaagttcaaaatatgtatataaacatattgtgagaatgttttttgaaaaacataccttaaataataataaaatagccttaatagaacatcaatgtggtgaacctcaaaattatatgacttatggaaatttttttaaaaaagtattatcttttagtaattctttgaatacatatgagggaagtaatattccagaaaaaatatataacgaagaaatgaataatggaaaatttaagttattaggtatatatggtagtaattctataaattggctagttgccgatttgggtgctatgcttagtggtgttactacattagtgatgcattcgaaattcagtatggacgtaattgttgatatattaaatgagacaaaattagaatggttatgtttagatttagatctggttgaatgtttaatggcacgtagaaatgaattaccgcacttgaaaaatcttataattttagatattgtagctaaacaaggtatgataaattcaaataatgaaaaagaaaaaaaaaaatcgaatttaaaaagcaatggacaggtaaataatataaataataaaaaaggaagtgatttatcgaaaaatttggaggatatacgtttgagtcctatagaatatgataaggataaattagaaaagtttaatgctttaaaagaaaaatttcataattgtgaaaagagactaatattatttgatgacatgacaaagacgaaaagtacaaattttaatattataaatgaggatcctgattttgttacttcaattgtgtatacttctggaacatctggaaagccaaagggtgttatgttgagcaacaaaaatttatttaatcaattatattccttatacaatcatagtgtaagagaatcatatagttttgaatatcatttatcttatttacctatatcacatgtacttgaaagaacatttgcgtatagcatcatattgtttggaggaacactaaatatatggagtaaggatcttaattatttttccaaagatatatttaattcgaaagattttataatgggaggagtacctaaggtttttagtagaatgtatactaatattgtgacagaaattaataatttatccccttttaaaagattcattataaacactgttatgtcattacggaagtctaataaaaatggatggttgggtaaatttcttgaaaatacatttcatgtttcaagtaaaataaaagagaaggttaatcctaatttagaagttatattaaatggtggtggaaaattatcggcagatattgcccaggatttatgtactttattaaatatcaattattgtcaaggttatggattaactgaaactggaggtggtatttttggtaatcacgcaaaagacacaaattttttatgcataggaggacctattgctgctaatacaaaatataaagtaagatcatgggaaacctataaagctaaggatactttacctaaaggagaattattagttaagagtgattctgtatttaaaggatatttcttagaaaaggagtctacaaaaagggcttttacccacgatggttattttataacaggagatgtggttcaaattaatagaaatggatctttaaaatttttagatagatcaaaaggattagttaaattatcacaaggagaatatattgaaacggatatgttaaataatctttattcagaagtactttttataaatttttgtgttgtatatggtgatgattctatggatggccctctagcaataatatctgttgataaaaatttatttttcaattgtttaaaagatgataatatgttagaaataactggagttaatgaaaaaaattatttaaataaattaactgatgataatataaataataatatttttcttgattatgttaaagaaaaaatgttagaagtttataaggaaacaaatttaaatagatacaatattattaataacatatatttaacttcaaaagtttgggacacaaataattaccttactccaacatttaaggttaaaaggttccatgtgtttaaagattatgcttttttcattaatgatgttaaaaaaatatataaaaataaattaaaaggatgtactggtattagtgttattagtgaaaaaagagatgaagaaaaaaaaaatgacagaaaaaaagaagaaaaaggttcaaaaaaattaataaatgattcaaattcaaaaccacacaaaaacgatatgggaaaacatgaaaaaaatgttgaaaataaaaaggtcaaattaggagctacatatggaccaagtcaaaaagaaatgaataaataa

SEQ ID NO: 14081 - protein, 819 aa, Plasmodium falciparum
MGKVFTIYVFVIYLIYIRPNVSQFTSEYEGYSEICEKATNENESCVYCMKDHKRKSSKYVYKHIVRMFFEKHTLNNNKIALIEHQCGEPQNYMTYGNFFKKVLSFSNSLNTYEGSNIPEKIYNEEMNNGKFKLLGIYGSNSINWLVADLGAMLSGVTTLVMHSKFSMDVIVDILNETKLEWLCLDLDLVECLMARRNELPHLKNLIILDIVAKQGMINSNNEKEKKKSNLKSNGQVNNINNKKGSDLSKNLEDIRLSPIEYDKDKLEKFNALKEKFHNCEKRLILFDDMTKTKSTNFNIINEDPDFVTSIVYTSGTSGKPKGVMLSNKNLFNQLYSLYNHSVRESYSFEYHLSYLPISHVLERTFAYSIILFGGTLNIWSKDLNYFSKDIFNSKDFIMGGVPKVFSRMYTNIVTEINNLSPFKRFIINTVMSLRKSNKNGWLGKFLENTFHVSSKIKEKVNPNLEVILNGGGKLSADIAQDLCTLLNINYCQGYGLTETGGGIFGNHAKDTNFLCIGGPIAANTKYKVRSWETYKAKDTLPKGELLVKSDSVFKGYFLEKESTKRAFTHDGYFITGDVVQINRNGSLKFLDRSKGLVKLSQGEYIETDMLNNLYSEVLFINFCVVYGDDSMDGPLAIISVDKNLFFNCLKDDNMLEITGVNEKNYLNKLTDDNINNNIFLDYVKEKMLEVYKETNLNRYNIINNIYLTSKVWDTNNYLTPTFKVKRFHVFKDYAFFINDVKKIYKNKLKGCTGISVISEKRDEEKKNDRKKEEKGSKKLINDSNSKPHKNDMGKHEKNVENKKVKLGATYGPSQKEMNK

SEQ ID NO: 14082 - DNA, 2105 bp, Lithospermum erythrorhizon
  CDS (59)..(1969)
caaaaaattctccttttctttggtttcctctcacttcaatcaaatttgaaacaccaaaatggacactcaaaccaaaacagaccaaaaagacataatcttcagatcaaaactccctgatatatacatcccaaaacatctgccattgcattcttattgtggtgaaaacatttctcaattcagctcaagaccatgcttaataaatggctcaaatgatagagtatatacttatgcagaagttgaaataacttcaagaaaagttgcagcagggcttcataaacatgggatcaaacaaactgaaaccatcatgcttttgctcccaaattgccctgaatttgtttttgcatttcttggtgcttcatatataggagcagtctccacaacagccaacccatttttcacctcctctgaaatcatcaaacaagccaaagcatccaaaacaaagctcatcatcacagtatccaccactgtcccaaaactcaaggacttttctcaagaaaaccatgtcaagatcatgtgcattgatgataaaattgatggttgtctccatttctcatcagaccttgaaaattcagacgaaaccaccttgccagacgtcgaaatccgccccgacgacgtcgtggcattaccctattcgtcagggactacagggctaccaaaaggagtcatgcttactcacaaaggactagtaacaagtgttgcacaacaagttgatggagacaatgcaaacttgtatatgcatcacgaagatgttgtgatgtgcactttgcctctattccatatatattcaatgaattcaatcttgctttgtggattaagagttggggctgcaatattattaatgcataaatttgagattgtcacatttcttgaattgatacaaaggtataaggtgacaattggaccatttgtgcccccaattgtgttggctattgctaagagtaatgtggttgatcagtatgatttgtcgacggtgaggaccgtcatgtcaggggcggcaccgctagggagtgagcttgaagatgctgttagagcaaagttccctaatgcaaaacttggtcagggttatgggatgacagaagcagggccagtgttggctatgtgtctggcttttgcaaaagagccatttgagatcaaatcaggggcatgtggtacagtcgttagaaattcagagatgaaaatcatagacaccgaaactggtgcctctttgcctcgtaaccaatctggtgaaatttgcattaggggagaccaaattatgaaaggttatctgaacgatcccgaggcgacagagaggacaatagacaaagaggggtggttacatacaggtgatattgggtacattgatgatgatgatgagcttttcattgtggatcgtctgaaagagcttattaaatataaggggttccaagttgctcctcctgaacttgaagctcttcttgttcctcatcctaatgtctctgatgctgcagttgtctcaatgaaagatgagggggcaggagaggtgccagttgcatttgtcgtgaggtcaaatggttccacaaccactgaggatgaaatcaagcaattcgtatctaaacaggtgatattctacaagagaataaaccgtgtgtttggtgtggactcaattcctaagtctccatctggaaagattgtgaggaaagacttgagagccaagttggctgctagattcctcaatggtcctacaactaatgtggtgccaaatggtggtaatgtagctaaagataatgtgccaaatggggtgtccaacggcgtttcgaaggccaatggtggcgttgctaaagaaggggttgctaacggagtaccaactgacggcgactatggtgtagctacaaaaggagttgcaaatggtatttccaacggtgtttataaacaagtgtcaaatggtgttgtttcaaatggagtggcaaatgggattgtttcaaatgggattgcaaatggtgtacacaattagggtattaaataaaaaactcaatatcaagaaagaaagaaaaagtgttcaattcaatttaagtacttgttttgagcattaataatgaatcattttatgtaatccttgattagacaattatatatttctttattcctgt

SEQ ID NO: 14083 - protein, 636 aa, Lithospermum erythrorhizon
MDTQTKTDQKDIIFRSKLPDIYIPKHLPLHSYCGENISQFSSRPCLINGSNDRVYTYAEVEITSRKVAAGLHKHGIKQTETIMLLLPNCPEFVFAFLGASYIGAVSTTANPFFTSSEIIKQAKASKTKLIITVSTTVPKLKDFSQENHVKIMCIDDKIDGCLHFSSDLENSDETTLPDVEIRPDDVVALPYSSGTTGLPKGVMLTHKGLVTSVAQQVDGDNANLYMHHEDVVMCTLPLFHIYSMNSILLCGLRVGAAILLMHKFEIVTFLELIQRYKVTIGPFVPPIVLAIAKSNVVDQYDLSTVRTVMSGAAPLGSELEDAVRAKFPNAKLGQGYGMTEAGPVLAMCLAFAKEPFEIKSGACGTVVRNSEMKIIDTETGASLPRNQSGEICIRGDQIMKGYLNDPEATERTIDKEGWLHTGDIGYIDDDDELFIVDRLKELIKYKGFQVAPPELEALLVPHPNVSDAAVVSMKDEGAGEVPVAFVVRSNGSTTTEDEIKQFVSKQVIFYKRINRVFGVDSIPKSPSGKIVRKDLRAKLAARFLNGPTTNVVPNGGNVAKDNVPNGVSNGVSKANGGVAKEGVANGVPTDGDYGVATKGVANGISNGVYKQVSNGVVSNGVANGIVSNGIANGVHN

SEQ ID NO: 14084 - DNA, 2213 bp, Lithospermum erythrorhizon
  CDS (265)..(2022)
cttgaactttcctgcattcttgcacatttcttgttctaatttatttatttataaatcatttcaagaaaagaagtaaggtgctttggtatacccaagccaaggagagttggttagaagagaaagagtgagatagagaaccaaatttaaaagaaagctcatcacagaagtgaggtgggaataaatcccagaaaaacacaaaaacaaggcaatattattaccacctatagtattatcaccaaaccaaccgaacaacaacaaataacaatgttgtctgtagcttcccctgaaacccaaaagccagagctttcctccattgctgcccccccttcttccaccccccaaaaccaatcctccatttctggagataacaactccaatgaaaccatcatcttcagatccaaactacctgatatacccatctccaataacctccctctccacacatactgcttccagaatgcttctgaataccccaacagaacatgcatcattgatagcaaaactggaaaacaatacactttttctgaaacagattcaatctgcagaaaagttgcagctggattatcaaatcttggcatccaaaaaggagatgtgatcatggtcctcctccaaaactgtgctgaattcgttttcaccttcatgggtgcttccataataggtgcagtcatcaccacaggaaaccccttctacacaactgcagaaatcttcaaacaagtcaacgtctccaacacaaaactcatcattactcaatccaactacgttgacaagctccgtaacaccaccataaacgaatccgacaacaaatatccaaaacttggagaggattttaaggtgatcacaattgatacccccccagaaaactgcctacccttttcactcctcattgaaaacacccaagaaaaccaagttacatcagtttccatcgactcaaacgacccaatagcattaccattttcctcaggcaccacagggttaccaaaaggagtgatcctaacacacaaaagcctcattacaagcgttgcacaacaagtagatggagacaacccaaacttgtacctaaaacatgatgatgtagtactatgtgtacttcctttgttccatatatactccctaaattcagtacttttgtgttcattaagagctggagcagcagtgttgatcatgcagaaatttgagataggggcattgttggaacttatacaaagccaccgtgtatcggtggcggcggtggtgcctccgctagtattggcgttggcaaagaatccaatggtggataaatatgatctgagttcgataagggtggtgttgtcgggggcggcgccgctggggagggagttggaactagcgttacttaatagagtcccacatgccatttttgggcagggttatggcatgactgaagctggaccagtactatcaatgtccccttcatttgcaaagcacccatacccagcaaaatccgggtcatgtggaactgtagttagaaatgcagacctcaaggtgattgaccccgaaaccggttcctccctcggccgaaaccaacctggagaaatttgcattcgtggcgaacagatcatgaaaggctatctcaacgaccccgaggcaactgccaggaccgttgacatcgaggggtggctccataccggtgacattggctatgtggacgacgatgatgaagtgttcattgttgatagggtgaaggaactcatcaaattcaaggggttccaagttccaccagctgagcttgaggctctcctcatttcccaccccaacattgctgatgctgctgttgtaccgcaaaaagatgctgctgctggagaagtccctgttgcttttgtggttccttctaatgatggctttgaattaacagaagaagctgtcaaagaattcatttctaaacaggttgtgttctacaaaaggttgcacaaggtgtactttgtccactctattccaaagtcgccgtccggcaagattttgaggaaagatctcagagccaaactggccgccgccgcctcctcttgaattcttattgttcgatagttgcataaaagttattattgccatgtattatggctaattaataaataataggaattatttttcaaatgtagtcattattgtttatctatgtgaatgtttgcatgagactgagtaattgaactcattgatgagttcttttgttatgtgtgagaatggaatccaaccattttact

SEQ ID NO: 14085 - protein, 585 aa, Lithospermum erythrorhizon
MLSVASPETQKPELSSIAAPPSSTPQNQSSISGDNNSNETIIFRSKLPDIPISNNLPLHTYCFQNASEYPNRTCIIDSKTGKQYTFSETDSICRKVAAGLSNLGIQKGDVIMVLLQNCAEFVFTFMGASIIGAVITTGNPFYTTAEIFKQVNVSNTKLIITQSNYVDKLRNTTINESDNKYPKLGEDFKVITIDTPPENCLPFSLLIENTQENQVTSVSIDSNDPIALPFSSGTTGLPKGVILTHKSLITSVAQQVDGDNPNLYLKHDDVVLCVLPLFHIYSLNSVLLCSLRAGAAVLIMQKFEIGALLELIQSHRVSVAAVVPPLVLALAKNPMVDKYDLSSIRVVLSGAAPLGRELELALLNRVPHAIFGQGYGMTEAGPVLSMSPSFAKHPYPAKSGSCGTVVRNADLKVIDPETGSSLGRNQPGEICIRGEQIMKGYLNDPEATARTVDIEGWLHTGDIGYVDDDDEVFIVDRVKELIKFKGFQVPPAELEALLISHPNIADAAVVPQKDAAAGEVPVAFVVPSNDGFELTEEAVKEFISKQVVFYKRLHKVYFVHSIPKSPSGKILRKDLRAKLAAAASS

SEQ ID NO: 14086 - DNA, 2091 bp, Candida glabrata
  CDS (1)..(2091)
atggtacaagtctctgctatatacggcaaagctgccaacgagcatgaaactgctccaagggttaatgcgctgagagctcgtgatgggcccttgactagacctttggactctaatgcgtctactgtgtatgaattggctctagaatccttccaaaaaggtggcaaccgtagaggtatgggctggagagagatcactgagatacatgaagaagtgaagattatcgtcaagaagatcgacggtaagaatgttccacaggagaagacgtggttgtactacgaaatgactccctaccgtcacaacacttacagagagcttatctctattatgcataacttgggtcgtggtatggttaaagctggtattaaacctaacggcgaaaacaaattgcacatctttgcctctacgtcccataaatggatgaagatgttcttgggtgcccaatctcaaaacatcccagtggtaaccgcctacgacactcttggtgaacgtggtttaatccactcaatgttgcaaaccgagtcaaacgcagtcttcacagacaacgacttgctgacaaaattgattaacccattgaaagaggccaaagatcttaaattcttgattcactctgaaaccattaatcctaaggacaccagacaaaacggtaaattgtacaaaaatgcaaaggaagcccttgctaagatcaaggaagtaagaccagatctaacaattatcagttttgatgaacttctgagattaggtaagaagagtaaacacgaaattgaaccacacccacctaaaccagaagatctgtcatgtatcatgtatacctctggttctacaggtgatccaaagggtgttgtcctaactcatgcaaacatcgtcgcaggtgtcggtggtgtctgccataatgtctacggcgatgttggccaaaacgaccgtattatcgctttcttgccattggctcatatatttgaattggcctttgaattagctgcattctattggaatggtatccttggttacgccaatgtcaagaccctaacaaacctatctgtacgtagatgtcaaggtgacatggttgagttcaaaccaaccattatggttggtgtcgctgccgtctgggaaactgtcagaaagggtatcctggccaaactaggggaattaccagcctacactcaaaagattttctggacggcctacaaatctaaggttaagctagatgaagctggtttaccaggtggtggcctcatctcaaagctagttttcaaaaaagtcaaggaggccactggtggttgtctgagaattatcatgaacggtggttctccaatcagtgaagatgcccaaagatttttaactaatgtcctatgtcctatgttgatcggttacggtttgaccgaaactgtcgctaatgcaacagtgctttccttaaaagcattcaaatacggtattgcaggtgatctaagtggtgctatccaagttaagttagtcgatgctgcagaattgggctacttggcaaaggacaatcaaggtgaaatctggattaagggtgctcctgttatgtctgagtatttcaagaatgaagaagagacaaagaaggcattgactgaagacggttggttccgtactggtgatattggtgaatggaatgaagacggccaattgattatcattgacagaaaaaagaatctggtgaagaccctaaatggtgaatatattgctttggaaaagctagaatctctctacagatccaacaagtatgttcaaaacatttgtgtatacgccgatcaaactaaggtcaaaccagtaggtattgttgttggtaacatgaagcctttggaagccttagctaattcattgggtctactaactggagaagagaccattgactctgttttacatgacaagaaattggctgcagctgtattgaaggatatgctagctaccggtaagagccaaggtctgaacggtattgaactattgcaaggtattgtgtttttcgatgacgaatggactccacaaaatggttacgttacttctgcacaaaaattgaagagaaaggaaatcttagaagcagtaaaagaccaagtcgaggccgtttacaaaaattag

SEQ ID NO: 14087 - protein, 696 aa, Candida glabrata
MVQVSAIYGKAANEHETAPRVNALRARDGPLTRPLDSNASTVYELALESFQKGGNRRGMGWREITEIHEEVKIIVKKIDGKNVPQEKTWLYYEMTPYRHNTYRELISIMHNLGRGMVKAGIKPNGENKLHIFASTSHKWMKMFLGAQSQNIPVVTAYDTLGERGLIHSMLQTESNAVFTDNDLLTKLINPLKEAKDLKFLIHSETINPKDTRQNGKLYKNAKEALAKIKEVRPDLTIISFDELLRLGKKSKHEIEPHPPKPEDLSCIMYTSGSTGDPKGVVLTHANIVAGVGGVCHNVYGDVGQNDRIIAFLPLAHIFELAFELAAFYWNGILGYANVKTLTNLSVRRCQGDMVEFKPTIMVGVAAVWETVRKGILAKLGELPAYTQKIFWTAYKSKVKLDEAGLPGGGLISKLVFKKVKEATGGCLRIIMNGGSPISEDAQRFLTNVLCPMLIGYGLTETVANATVLSLKAFKYGIAGDLSGAIQVKLVDAAELGYLAKDNQGEIWIKGAPVMSEYFKNEEETKKALTEDGWFRTGDIGEWNEDGQLIIIDRKKNLVKTLNGEYIALEKLESLYRSNKYVQNICVYADQTKVKPVGIVVGNMKPLEALANSLGLLTGEETIDSVLHDKKLAAAVLKDMLATGKSQGLNGIELLQGIVFFDDEWTPQNGYVTSAQKLKRKEILEAVKDQVEAVYKN

SEQ ID NO: 14088 - DNA, 2091 bp, Candida glabrata
  CDS (1)..(2091)
atggctgttactgtaactgtaggagaagcgcgccctggggagactgctccgcgtcgggctgccaaggttgctgagaaggcgctggacaggccgcctaacatgaagtgttctactgtgtatgagtttattcttgagtgttgtgagaagcacggcgggaagaatgctattgggtggagagatattattgacgtgcacgaggagaccaagactattgagaagttcaacaagaagagcgggcagatggagaaagtggacaagaactggctgtactacgagctttccgggtaccactacaacacctttactgaggttattgaggtgatgcactcggtcgggcgtggtctggttaagctgggcatggagcccaagtccgaggacaagctgcacatatttgccgccacctctcacaagtggatgaagatgttcttgggtgcgcaatcccagggcatccctattgtcactgcttatgacaccttgggtgagaaaggtctgatccactccttgaagcagaccagctctgcggcgatattcacagacaaccagcttctgggtaaactgattaacccattgaaggtcgccgagaagattagatacgtgatatactacgataacatctccgcagaggacaagagacaaggcgggaaactatatcgcgaggcccaggaggctgtcgataagatcaaggaggtgagaccagatatcaagctggtgagcttcgatgaattactggagttgggccaaaaagcaaagggcgagattgaaccacaccctcctaccagagacgacatctcctgtattatgtacacatctggttccacaggtgatcctaagggtgttgtcttgaaacacagcaacgtggtagctggtgtaggtggtgcaaccataaatgtctgcgactacgtcggtgacactgacaaactgatctgcttcttgcccctggctcacatctttgaaatggcttttgagctgttgtccttccattggggttcctgtatcggttatgccaatgtcaagacattgactagcgcatctgtaagaaactgtaagagtgacttagaggaattccaaccaactattatggtcggtgttgctgccgtatgggaaactgttaagaaaggtattttgaaccagatcaacgaattgcctcgtgtcaccaagggtatcttctgggctgcttaccattccaaattgaagatgcaaaagatgggtattccaggtggtgatactatcggtaatatcatattcaaaaaggtaagaaaggccactggtggccatttaagataccttttgaatggtggttctccaatcagtgtcaatgctcaggaatttatctcaaacttaatctgcccaatgctaattggttacggtttgactgaaacatgtgctagtttgtgtattttgaaccctggccatttcgagtatggtgttgttggtgatttaactggttgtgtcactgttaagctggtcgacgttgaagaactgggttactttgccaaggacaacaaaggtgaaatatgggtgaaaggtgaaaacgtgctccctgaatattacaagaatgaggaagaaactaaggaatctttaactgaggatggttggttcaagaccggtgacattggtatgtggactgacaccggtagtctaaaaatcatcgacagaaagaaaaacctagtcaaaactatgaacggtgaatacattgcattggagaaattggaatcagtttatagatctaactcctacgttcaaaacatctgtgtttatgctgaccaaaacaaggttaagcctgtgggtatcatcgttcctaaccacacaccattggtcaaattggccaaggaacttggaataatgaaaaagcaggaaacagacatcgaaccatacttgcacaataaaaaacttcaaaatgcagtatttgaagacatgatcaaaacggctaagaagcaaggcttagttggcatcgaattgttacaaggtgctgtgttcttcgatgacgaatggacacctcaaaatgggtttgtcacctctgctcaaaaacttcaaagaaaaaagattctaaaggcagttgaaaaggacgtcgaaagtgtgtacgccgattaa

SEQ ID NO: 14089 - protein, 696 aa, Candida glabrata
MAVTVTVGEARPGETAPRRAAKVAEKALDRPPNMKCSTVYEFILECCEKHGGKNAIGWRDIIDVHEETKTIEKFNKKSGQMEKVDKNWLYYELSGYHYNTFTEVIEVMHSVGRGLVKLGMEPKSEDKLHIFAATSHKWMKMFLGAQSQGIPIVTAYDTLGEKGLIHSLKQTSSAAIFTDNQLLGKLINPLKVAEKIRYVIYYDNISAEDKRQGGKLYREAQEAVDKIKEVRPDIKLVSFDELLELGQKAKGEIEPHPPTRDDISCIMYTSGSTGDPKGVVLKHSNVVAGVGGATINVCDYVGDTDKLICFLPLAHIFEMAFELLSFHWGSCIGYANVKTLTSASVRNCKSDLEEFQPTIMVGVAAVWETVKKGILNQINELPRVTKGIFWAAYHSKLKMQKMGIPGGDTIGNIIFKKVRKATGGHLRYLLNGGSPISVNAQEFISNLICPMLIGYGLTETCASLCILNPGHFEYGVVGDLTGCVTVKLVDVEELGYFAKDNKGEIWVKGENVLPEYYKNEEETKESLTEDGWFKTGDIGMWTDTGSLKIIDRKKNLVKTMNGEYIALEKLESVYRSNSYVQNICVYADQNKVKPVGIIVPNHTPLVKLAKELGIMKKQETDIEPYLHNKKLQNAVFEDMIKTAKKQGLVGIELLQGAVFFDDEWTPQNGFVTSAQKLQRKKILKAVEKDVESVYAD

SEQ ID NO: 14090 - DNA, 2226 bp, Candida glabrata
  CDS (1)..(2226)
atgagcttctcagtgactgagttggtagagacatctcctcggtatgctgaattgaagaagagattatccgggtataagcccggatctgatgagtaccttcgcgcgctgatggatactttcccactgtctaaccacccagactatagaaagttcctgcaggcgcaggctgttcctgtgccaggatcacaggcgaaggggttcagtccagtttacagaagtattctgtctaccgaacgtttagtcacgtgtatggataaaaacctagcaacctactatgactactttctattcagcgctaggaactggccagataacgattgtctaggtcgtaggccttacaatgacgaaaaacaagattgggagcagtactatgaattcgactcctaccagcggactttagaacggtcccaggcactgggtagtggtattatgactttagtcaataccaagagacgtcggaaattaacagacaacaaggatttaattgtggccatcttgtctcacaaccgtccagaatggatattgactgatttggcatgccaggcatactccttaccgaacactgcgctttatgaaactttgggaccagaaacctcagagtacataatgaatttaaccgagtccccaattttaatctttgccaagtcgaatatgtacaatgttttgaagattttacctcaattgaaacatttaaacactttagtgtgtatagaggatttgagcgatgaagagctgcacatgctaaatacgtcctctctaccaaatgccactaatgcaaatggggagaaaatctcagtacatacactttcccaggtcgaaaaattgggcgctttgaataagatcccaattattaaacccaaaccggatgacttatatacgatctctttcacttctggtacaactggtctaccaaaaggtgttgaaatgagtcatactaatatcgcctctgggctagcctttgccttctctacatttagaaagaatccagataaggcccacagacaactttatgacttatgtttcttgccattggcacatatctttgaaagaatgatttgtgcgtatgatttggccattggtgcaggtttaggtttcttacatatccctgatccttcagcgctggtggaagatttaaagatcttgaaacctgacaacctagcactcgtcccacgtattttaactcggttcgaagctggtatcaagaactcgtttgataaatcggctgttagtagagccatttcaggaacgattgtgaatgctaagatcaacaggtactcaactaaggctggtccagatgactctctggttaactctctcatttacaagaaagtcctgattaacaaagttcgcgaacaacttggtctctccagaactgactttatggttacgggttcagcaccaattgccaaagagaccttgttgtttttgaagagttgcttagatgttggtgttagacaagggtacggacttactgaatcttttgctggtatatgtatcagtgaacaagatgagaaagacgtaggctcttgtggtcctattggtatatctgctgaatgtagattaaagtctgttcctgatatgggatatgatgcggagagggacctgaaaggtgagttgcaacttcgtggtcctcaaatatttgacagatatttcaagaatccagatgagacgaacaaggctatcgataaggacggctggttctcaactggtgatgttagctacattgacaagaagggacgtttacatattattgaccgtgtcaagaacttcttcaaactagcacacggtgagtatattggccctgaaaagattgaaaacacttacttatcgtcttctccatatatcactcaagcatttgtgtatggtaactcgctgcaaaatttcttggttggtattttgggattagatctagagtccttaagacctcaattgatgcactcccacccagaaataaagtcctggacggatgagaaattattggaccaaattaactcggacaaaaagttaagacttgtcttgttgcaattaattaaccgatcttgtgttggattacaaggttttgaaaaacttcataatatctacgttggattagaaccattaaaggtagaagacgatgtcgtaacaccaacattaaagataaaaagacaaaaggcttccaaattttttaaggatattcttgatgatctctacaaagaaggctctgttataaaagctcaaaaactgtaa

SEQ ID NO: 14091 - protein, 741 aa, Candida glabrata
MSFSVTELVETSPRYAELKKRLSGYKPGSDEYLRALMDTFPLSNHPDYRKFLQAQAVPVPGSQAKGFSPVYRSILSTERLVTCMDKNLATYYDYFLFSARNWPDNDCLGRRPYNDEKQDWEQYYEFDSYQRTLERSQALGSGIMTLVNTKRRRKLTDNKDLIVAILSHNRPEWILTDLACQAYSLPNTALYETLGPETSEYIMNLTESPILIFAKSNMYNVLKILPQLKHLNTLVCIEDLSDEELHMLNTSSLPNATNANGEKISVHTLSQVEKLGALNKIPIIKPKPDDLYTISFTSGTTGLPKGVEMSHTNIASGLAFAFSTFRKNPDKAHRQLYDLCFLPLAHIFERMICAYDLAIGAGLGFLHIPDPSALVEDLKILKPDNLALVPRILTRFEAGIKNSFDKSAVSRAISGTIVNAKINRYSTKAGPDDSLVNSLIYKKVLINKVREQLGLSRTDFMVTGSAPIAKETLLFLKSCLDVGVRQGYGLTESFAGICISEQDEKDVGSCGPIGISAECRLKSVPDMGYDAERDLKGELQLRGPQIFDRYFKNPDETNKAIDKDGWFSTGDVSYIDKKGRLHIIDRVKNFFKLAHGEYIGPEKIENTYLSSSPYITQAFVYGNSLQNFLVGILGLDLESLRPQLMHSHPEIKSWTDEKLLDQINSDKKLRLVLLQLINRSCVGLQGFEKLHNIYVGLEPLKVEDDVVTPTLKIKRQKASKFFKDILDDLYKEGSVIKAQKL

SEQ ID NO: 14092 - DNA, 2094 bp, Rattus norvegicus
  CDS (1)..(2094)
atgcagacccaggagatcctgaggatcctgcggctgcccgagctatcggacttgggccagtttttccgcagcctctcagccaccacccttgtgagtatgggtgcactggctgccatccttgcatactggctcactcaccggccaaaggccttgcaaccaccatgcaacctcctgatgcagtcggaagaagtagaggacagtggtggagcccggcgatctgtgattggggattgcactcagttgcttacccactactatgacgatgcccggacgatgtaccaggtgttccgacgtgggcttagcatctcagggaatggaccctgtcttggcttccggaagccagagcaaccttaccagtggctgtcctatcaagaggtggccaaaagggctgaattcctggggtcaggacttctccagcatgactgtaaagtgggcacagagcagttcattggcgtttttgcacaaaatcggccagagtggatcattgctgagctggcctgctacacatattccatggtggtggtaccgctctatgacacactgggcccagggtctatccgctacatcatcaatacagcggacatctgcactgtaatcgtggataagccgcataaggctatactcctgctagaacacgtggagaggaaggagactccgggcctcaagctggtcatcctcatggagccatttgacgatgccctgagagagaggggaaagaagtgcggggtggacatcaagtccatgcaggctatagaggactccggccaagagaatcatcgtgtccccgtgcccccacggcccgatgacctctccattgtgtgtttcacgagcggtacaacagggaaccccaaaggtgcgatgctcacccacgggaacgtggtggccgatttctcgggctttctgaaagtcacagagaaagtgatctttccgagacaggacgatgtgctcatctccttcctgcctctggctcacatgtttgagagagtgatccagtctgttgtctactgccatggagggcgtgtgggcttcttccagggagacatccgcctcctctcagacgacatgaaagctctccgccccaccatcttccctgtggtcccacggctgctgaatcggatgtatgacaagatcttccaccaggcagacacctcactgaagcgctggctcctggagtttgcagcaaagcgcaagcaggctgaggtccggagcggaatcatcagaaacaatagtatctgggatgaactcttctttaataagattcaggccagtcttggagggcacgtgagaatgattgttaccggagcagcccccgcatcaccaacagtcctgggattcctacgagcagctctggggtgccaggtctatgaaggttatgggcaaactgaatgcacagctgggtgtaccttcacaacgccaggggactggacatcagggcacgtgggagcccctctgccctgcaaccacatcaagctggtcgacgcagaggaactcaactactggaccagcaaaggagaaggagagatctgtgtgaaaggaccaaatgtgttcaaaggctacttaaaagacgaggacaggacaaaggaggccctggacagtgacggctggcttcacacgggagacattggaaaatggctgccggagggaacgcttaaaatcatcgatcggaaaaagcacatatttaaacttgctcagggggaatacgttgcgcccgagaagattgagaacatctacatccgaagtgagcctgtggcgcaaatctacgtccatggggacagcttaaaggcctttctggttggcattgttgtgcctgaccctgaagtcatgccttgctgggctcagaagaaaggaatcgaagggaactaccaggaactctgcaaaagtaaggaattgaagaaagccattctggatgacatggtgatgttggggaaagaaagtggactgcattcttttgaacaggttaaagccatttacatccattgtgacatgttctcagttcaaaatggcttgctgacaccaacactaaaggctaagaggcccgagctgagagagtacttcaaaaagcaaatagaagagctgtactcaatctccatgtga

SEQ ID NO: 14093 - protein, 697 aa, Rattus norvegicus
MQTQEILRILRLPELSDLGQFFRSLSATTLVSMGALAAILAYWLTHRPKALQPPCNLLMQSEEVEDSGGARRSVIGDCTQLLTHYYDDARTMYQVFRRGLSISGNGPCLGFRKPEQPYQWLSYQEVAKRAEFLGSGLLQHDCKVGTEQFIGVFAQNRPEWIIAELACYTYSMVVVPLYDTLGPGSIRYIINTADICTVIVDKPHKAILLLEHVERKETPGLKLVILMEPFDDALRERGKKCGVDIKSMQAIEDSGQENHRVPVPPRPDDLSIVCFTSGTTGNPKGAMLTHGNVVADFSGFLKVTEKVIFPRQDDVLISFLPLAHMFERVIQSVVYCHGGRVGFFQGDIRLLSDDMKALRPTIFPVVPRLLNRMYDKIFHQADTSLKRWLLEFAAKRKQAEVRSGIIRNNSIWDELFFNKIQASLGGHVRMIVTGAAPASPTVLGFLRAALGCQVYEGYGQTECTAGCTFTTPGDWTSGHVGAPLPCNHIKLVDAEELNYWTSKGEGEICVKGPNVFKGYLKDEDRTKEALDSDGWLHTGDIGKWLPEGTLKIIDRKKHIFKLAQGEYVAPEKIENIYIRSEPVAQIYVHGDSLKAFLVGIVVPDPEVMPCWAQKKGIEGNYQELCKSKELKKAILDDMVMLGKESGLHSFEQVKAIYIHCDMFSVQNGLLTPTLKAKRPELREYFKKQIEELYSISM

SEQ ID NO: 14094 - DNA, 1707 bp, Collimonas fungivorans
  CDS (1)..(1707)
atggataaatacgtggataaattttggctcaaatcgtatccggaaggcgtggccccggagattgactactcccaataccagtcgctggcgcagttgctggaagaggcgttccagaaatacgcgccgcgcaacgcctatgcctgcatgggcaaatacctgacgtatgccgaggttgaccagctgtcccgcaaagtcggcgcctggctgcagggcaaaggcctggaaaagggcgcgcgagtcgccatcatgatgcctaacgtgctgcaatatccggtggcgatcgccgccatcttgcgtgccggttatatcgtggtcaacgtcaatccgctgtacaccccgcgcgagcttgagcatcagctgaacgactcgggcgcggaagccatcttcatactcgaaaatttcgccactaccctgcagcaggtcatcgcccgcaccaaggtcaagcatgtggtggtcgccagcatgggcgatctgatgggcgtcaaaggcctggtggtcaacctggtggtgcgccatgtcaagaagatggtgccgagtttctccttgcccggttccgtgccgttcaacagtgtcttgtcgcaaggggcctcgctgcagctgaaaccggttgcgctgacgcccgacgacaccgctttcctgcaatacacaggcggcactaccggcgtctcgaaaggggcaactctgtcgcatcgcaacgtggtggccaacgtgctgcaggctgaagcctggctcgctcccggcttgaacaacggcccgaaagtcgagcagctggtgtttgtctgcgccttgccgctgtatcacatcttcgccttgacggtatgcggcatgctcggcatgcgcgagggcgccttgaacctgctggtcccgaatccgcgcgacatcgccggcctgatcaaggaaatgtcgaagtaccagatcaataccttcccggcggtcaatacgctgtacaacgccttgctgaaccatcccgatttcgccaagctggatttctccggctaccgggtctgcgtcggcggcggcatggcggtgcaaaaggcggttgcggacaagtggaaagaagtcaccggctgcccgatcatcgaaggctacggcttgtcggaaacttcgcccatcgcttgcgccaatccatgcgacatcaaggaatacagcggcaccatcggcctgcctttgccgtcgaccgagatcgccatcctggacgacgccggcaatccggtagcactgggccaggccggcgaaatcgcgatccgcggaccgcaggtcatgcgcggctactggaaccgcgatgacgaaaccgccaaggtcatgaccgctgacggctttttcaagtcgggcgatatcggcatcatggatgagcgcggttacaccaagatcgtcgaccgcaagaaagacatgatcctggtctccggtttcaatgtctatccgaacgaagtcgaaggcgtggtggtgcagcatccgggcgtgctggaatgcgcatgcgtcggtgtgccggacgaacatgccggcgaagtggtgaagatttttgtggtgcgcaaggatccgtcgctgaccgccgagcaactgatggcttattgccgtgagcagctgaccggctacaagcggccgaaatatatcgagttccgcaccgacctgccgaagaccaacgtcggcaagatcctgcgccgcgaattgcgcgacgagaaaccggctgagcaaaaacaggcggcctga

SEQ ID NO: 14095 - protein, 568 aa, Collimonas fungivorans
MDKYVDKFWLKSYPEGVAPEIDYSQYQSLAQLLEEAFQKYAPRNAYACMGKYLTYAEVDQLSRKVGAWLQGKGLEKGARVAIMMPNVLQYPVAIAAILRAGYIVVNVNPLYTPRELEHQLNDSGAEAIFILENFATTLQQVIARTKVKHVVVASMGDLMGVKGLVVNLVVRHVKKMVPSFSLPGSVPFNSVLSQGASLQLKPVALTPDDTAFLQYTGGTTGVSKGATLSHRNVVANVLQAEAWLAPGLNNGPKVEQLVFVCALPLYHIFALTVCGMLGMREGALNLLVPNPRDIAGLIKEMSKYQINTFPAVNTLYNALLNHPDFAKLDFSGYRVCVGGGMAVQKAVADKWKEVTGCPIIEGYGLSETSPIACANPCDIKEYSGTIGLPLPSTEIAILDDAGNPVALGQAGEIAIRGPQVMRGYWNRDDETAKVMTADGFFKSGDIGIMDERGYTKIVDRKKDMILVSGFNVYPNEVEGVVVQHPGVLECACVGVPDEHAGEVVKIFVVRKDPSLTAEQLMAYCREQLTGYKRPKYIEFRTDLPKTNVGKILRRELRDEKPAEQKQAA

SEQ ID NO: 14096 - DNA, 2112 bp, Trypanosoma brucei
  CDS (1)..(2112)
atgggtggctgcgttgcatcccttattgagagcagaaacacaaaatctcttgtcgataacgatgacattctgcaatacaacaaactgccatgccaaatccgtgtagttgcgggaacagaacgggaggatgcatcaccggtctaccgtaagtttgacgttactgatgaggatttcgaaaagatgtcacatgatgcgtaccatggggagccactaatacaactaatccgtgagatttgtgggctacggggggaaaaggttgcaatggcctaccgcaatatgcagcgggtagagagaaatgtggtgaaggatgcgagcggcaagtcaaaaacgatggatatgtatgttttctcaccggggcgccgaaatataagctataagcagctttgggaaaccgtcgaaaatttttctaaaggtctctgtgaaattgggcttcaggagcgacaatgccttgctctgtttgaagagacgcgttgggagtggtacgcgtcgttgctttccgcctggtgccacaacatgattgtggcaacagtgtacgccaatctgggtgaggatgcactccgttacgcgttaagggaagctcaatgcggctgcatcatctgtaacgggaagaatgtccccgtactccttgacaaagtgaagttgaaagaaatgggaaatccagtggttatttacttggatgatttacccaccaacgtagatattatggacctaagggtgtacaaatggtctaccgtggtggagatgggtgcgaagagcgaaaaggctcagttaaacatcccaacttgtgaaaattgtgatgatagcgctcttatcatgtacacaagcggcactacgggggatccaaagggtgtagtgcacacacacggaagccttgctagtggcgtctatgcgctcagcattcgactgtccgaagtatttggtgacccacgagatgacgaaacgtactgctcgtaccttcctttggcccacattatggaactggctgtgctgtcaatccttatgctcaggggatgcctcattggtttcggttctcctcgaacaattaccaacactttttctaaaccacacggtgatttggtcgaatatcgaccgtttgttctctctgctgtcccgcgtgtgttcgataccattaaaaaaaatgttgaggcaatgctacccagtcccgggtcaataaagcgtacagtctttgaaaggggatatcaggcccgtctcaaggctctgagggatggaaaggagactccctacctcaatgaaaaagttttcaataaggtccgtcaggcaacaggtgggaatgtgcggctttacttttctggtggggcgccactgtctccagctactcaggagttcatcaacgtggtactggggactgttattcagggttggggcctaacggagactgtgtgttgtggagggactcagttcccaggcagcctcgagtccgaaagtattggtcggatgatcgacactgtggagttgcgccttctcgacacacccgaatatcggcatacggataaaccagaacctcgtggagaaattttgttgcgcgggccattcctctttaaagagtattacaaacagaaggccctgacggaggaggttattgattccgagggatggttccacacgggtgatgttggctgcgtttcgaaaaacggtaccttgcgcatcattggtcgcgtgaaggcccttgtaaagaattccaacggcgagtatttggctttggagtccttggaggccacttacgggcaaaacaagttgtgcacaccaaacggcgtgtgtgtgctcgttcatccacagcgcagttatatagctgcactggccctcacaacagagcaacttatcatgcccttcgcaaaggagcataaaatccgcggaacatatcccgagatactcgaaaatgttgaactccgcaagaaggtgtgtgaatcatttcaagaaactggaagggccgctggaaagaaaagcttcgaaattgtgcgggacgtgcgcctactgagtgatgaatggaccccagaaaatggggttctaacagcggccgccaagttgaagaggcgaatcattgatgaacgttacaaagaactgatcgaagagatattccgcaatgatgtttga

SEQ ID NO: 14097 - protein, 703 aa, Trypanosoma brucei
MGGCVASLIESRNTKSLVDNDDILQYNKLPCQIRVVAGTEREDASPVYRKFDVTDEDFEKMSHDAYHGEPLIQLIREICGLRGEKVAMAYRNMQRVERNVVKDASGKSKTMDMYVFSPGRRNISYKQLWETVENFSKGLCEIGLQERQCLALFEETRWEWYASLLSAWCHNMIVATVYANLGEDALRYALREAQCGCIICNGKNVPVLLDKVKLKEMGNPVVIYLDDLPTNVDIMDLRVYKWSTVVEMGAKSEKAQLNIPTCENCDDSALIMYTSGTTGDPKGVVHTHGSLASGVYALSIRLSEVFGDPRDDETYCSYLPLAHIMELAVLSILMLRGCLIGFGSPRTITNTFSKPHGDLVEYRPFVLSAVPRVFDTIKKNVEAMLPSPGSIKRTVFERGYQARLKALRDGKETPYLNEKVFNKVRQATGGNVRLYFSGGAPLSPATQEFINVVLGTVIQGWGLTETVCCGGTQFPGSLESESIGRMIDTVELRLLDTPEYRHTDKPEPRGEILLRGPFLFKEYYKQKALTEEVIDSEGWFHTGDVGCVSKNGTLRIIGRVKALVKNSNGEYLALESLEATYGQNKLCTPNGVCVLVHPQRSYIAALALTTEQLIMPFAKEHKIRGTYPEILENVELRKKVCESFQETGRAAGKKSFEIVRDVRLLSDEWTPENGVLTAAAKLKRRIIDERYKELIEEIFRNDV

SEQ ID NO: 14098 - DNA, 1692 bp, Photobacterium profundum
  CDS (1)..(1692)
atggataaggtttggcttaaccgctatccggaagatgtaccggctgaaattaacccggatgcatacccgtcactggttgaaatgtttgagcaatctgtacataagtttgcagatcaaacagcatttattaatatgggccaggtaatgactttccgtaagttggaagagcgcagccgtgcttttgcagcttatttacaaaatgacttgaagctaaagaaaggcgaccgtgtagcggtaatgatgcctaacttgttgcagtatccaattgctttattcggtattcttcgtgctggttgtgtcgtcgttaacgttaacccactttacacaccacgtgagctagaacatcaacttaacgattcaggcgcgaaagcgattgtgatcgtctcaaactttgcacacactttagaaaaagttgttaaaaatacatgtgttagccatgttattttaaccagccttggcgatcagctttctcgtccgaaaggtacattggttaacttcgttgttaagtacgtgaaaaagatggtgccaaagtaccaccttccacatgctacatcgatgcgggcagcattaaagaaaggtcgtcgtatgcagtacgtcaaaccctttttatcaggcgaagatacagcattcctccaatatactggtggtacgacaggtgttgcaaagggagctattctgactcaccgcaatatgcttgctaacgtgatgcaagcgaaaggtgcttacgggcctgtattaactgatagtcgagagttaattgttacggctctgcctttgtatcacgtgtttgctctgacggtgaactgcttattgtttattgaaattggtggtcagaacttattgattactaacccacgagatatcccgacatttgttaaagaactgcaacgttatcaatttacagcgattaccggcgtgaatacgttgtttaacgcattattgaataacgaagatttccatgagttagatttcagtaaattacgtttatctgttggtggtggaatggctgttcagcgtgcggttgctgaaaagtggaaagacattacgaaaacgtatttgcttgaaggttatggtttaacagaatgtgcaccacttgtggcggcttaccctcataatctggttgactataatggctcgattggcttacctgtaccttcaacggatgtacgtattgtcgacgacgaaggtaatgtactcccgaacgatcaaacgggtgagcttcaggtgcgaggccctcaggtgatgaaaggttactgggaacgccctgaggcgacgaaagatgtcttgactgatgatggttggctttcaactggtgatgttgttcgttttgatgatgaaggtttcctgcacattgttgatcgtaagaaagacatgattcttgtttctggatttaatgtttatccgaatgaaattgaagatgttatagcgcttcaccccaaagtgcttgaagtcgcagcaatcggccaagaacacgaagtgtcaggcgaaattgtgaaagtgtgtgttgtgcctcgtgattcgagtctaacgcgcgatgagcttttaacgcattgtcgtgagtatttgacagggtataaaattcctagaattgttgaattccgcgaagagttaccaaagactagcgtaggtaaaattttacgtcgtgctttgcgtgaagaatcgggaaacgcagctaaatctcaagatgcataa

SEQ ID NO: 14099 - protein, 563 aa, Photobacterium profundum
MDKVWLNRYPEDVPAEINPDAYPSLVEMFEQSVHKFADQTAFINMGQVMTFRKLEERSRAFAAYLQNDLKLKKGDRVAVMMPNLLQYPIALFGILRAGCVVVNVNPLYTPRELEHQLNDSGAKAIVIVSNFAHTLEKVVKNTCVSHVILTSLGDQLSRPKGTLVNFVVKYVKKMVPKYHLPHATSMRAALKKGRRMQYVKPFLSGEDTAFLQYTGGTTGVAKGAILTHRNMLANVMQAKGAYGPVLTDSRELIVTALPLYHVFALTVNCLLFIEIGGQNLLITNPRDIPTFVKELQRYQFTAITGVNTLFNALLNNEDFHELDFSKLRLSVGGGMAVQRAVAEKWKDITKTYLLEGYGLTECAPLVAAYPHNLVDYNGSIGLPVPSTDVRIVDDEGNVLPNDQTGELQVRGPQVMKGYWERPEATKDVLTDDGWLSTGDVVRFDDEGFLHIVDRKKDMILVSGFNVYPNEIEDVIALHPKVLEVAAIGQEHEVSGEIVKVCVVPRDSSLTRDELLTHCREYLTGYKIPRIVEFREELPKTSVGKILRRALREESGNAAKSQDA

SEQ ID NO: 14100 - DNA, 1650 bp, Methanococcus maripaludis
  CDS (1)..(1650)
atgctttttacaaatgatactatcggagaattctttgaaaagcaagctcaaaaagatcctgacagggaatttttagtatatcctgacagaaatctccgatttacatacaaagaattcgatgaaagaacagatctccttgcaaaaggccttttagaaattggaattaaaaaaggagatcatattggaatatgggctagaaatgttccagactggcttacattcatgtttgcaactgcaaaaataggtgttgttttagtaaccgtaaacacggcatataaaagccacgaacttgcatatgttatgaaacagtctgatatgaaagcccttgcaattattgatagttttagggatgtaaattacctcgagatactctatgaactcgttccagaattaaaaacgagtcagaggggaaaattaaatagtgaagaattcccatacttaaaaaacgtaatctacgttggacaagaaaaacaccgcggaatgtacaatacaactgaactcatgcttttaggaaattacgtttctgatgaaaagctgattgaagctaaaaaaggtctggattctgatgatgtaataaatatgcagtatacttctggaaccacgggttttccaaaaggtgtaatgcttacccataaaaatatactgaataacgggtattacatcggcgaaaaacagaaatttacagaagaagagcgattatgtttgccagtaccactttttcactgttttggaatagttttgggcgtacttgcacttttaacccatggcggaactcttgtaatgcttgaaatatttgatccattactggtacttgcagcaatacaaaaagaaaaatgtactgcagtttatggagttcctacaatgtttattgctgaattttcacacccaatgtttgaaatgtttgatctttcatcacttagaactggaattatggctggatcgacctgcccaattgaggcaatgaaaaaagtaatgtctgatatgtacatgcgagaaattactatttcttatggccttacagaagcgtcaccagtgtttacaatgaccagtgttgacgatccctttgaaaaacgggttgaatcagttggaaaagcaatgccgcactgtgaagtaaaaataatagatcctgaaactggagaaacacttgctccaggaaacgttggagaaatctgctgtaggggctacaatgtaatgaaaggatattacaaaatgcctgaaaaaactgctgaagtcattgaaaaagatggatggcttcacagcggagatttagcggttgaagacgaagatggatactataaaatcgttggaagaataaaagacatgattattcgtggtggagaaaatatataccctcgagaaattgaggaatttttatacaccatgccgggaattaatgatgcacaagttgttggaatccctgacgaaaaatacggggaaattgttggtgcatttgtaatccctaaagaaggatacgaaattaaagaagaagatgtcagggactttgcacttgaaaaaattgcaaggtataaagttccaaaacacgtgtttgtcgtagaagaattcccaatgaccgcaagcggaaaaatacaaaagtttaaattaactgaacttgcagttgaactcttgaaaaagaaaaaagaagaattataa

SEQ ID NO: 14101 - protein, 549 aa, Methanococcus maripaludis
MLFTNDTIGEFFEKQAQKDPDREFLVYPDRNLRFTYKEFDERTDLLAKGLLEIGIKKGDHIGIWARNVPDWLTFMFATAKIGVVLVTVNTAYKSHELAYVMKQSDMKALAIIDSFRDVNYLEILYELVPELKTSQRGKLNSEEFPYLKNVIYVGQEKHRGMYNTTELMLLGNYVSDEKLIEAKKGLDSDDVINMQYTSGTTGFPKGVMLTHKNILNNGYYIGEKQKFTEEERLCLPVPLFHCFGIVLGVLALLTHGGTLVMLEIFDPLLVLAAIQKEKCTAVYGVPTMFIAEFSHPMFEMFDLSSLRTGIMAGSTCPIEAMKKVMSDMYMREITISYGLTEASPVFTMTSVDDPFEKRVESVGKAMPHCEVKIIDPETGETLAPGNVGEICCRGYNVMKGYYKMPEKTAEVIEKDGWLHSGDLAVEDEDGYYKIVGRIKDMIIRGGENIYPREIEEFLYTMPGINDAQVVGIPDEKYGEIVGAFVIPKEGYEIKEEDVRDFALEKIARYKVPKHVFVVEEFPMTASGKIQKFKLTELAVELLKKKKEEL

SEQ ID NO: 14102 - DNA, 1782 bp, Bdellovibrio bacteriovorus
  CDS (1)..(1782)
atgacgaagcccaccactttgggtcattccattctaagcatgcgcagccgcaaccctcaccacgtggctgtcaaatacaaggtcaacgattcctggaaagaaaaaagctggaatgaatactactccgacatcgaagccgtcggctgtgccctgctgtctttgggaatcaaacccggtgaccgagttgccatcatggccaacacccgtgttgaatggtccacaacggatctgggcatctttggtatcaaggccatcaccgttccgatctatcagaacaacaccgccgacgatgtggaatacattctgaacaactccgaatcccgtatcctgatttgcgaaagccgcggccctttgaaaacctttgaatccgtccgatccaaatgcccgaaagtggaaaaggtcatcgtctttgacgagacctgcccgaacccggatgtggtcacgtggccgaagcttttgcagatgggaaaagactatctggcaaaacaccccagccagttccaggagctgtgtgcatccctgactcaggaagatatcgccacgattttgtacacttccggaaccaccggccgcccgaaaggggtggtcatgacacaccttcaggccatcagcgaagtcagtgaagcattccctctttgtggcgccaccgaagctgacacctccttgtctttcctgccctatgcccacattttgggtcgtattgagcactggggtcacgcttacatcggattcaccctggccttcgcagaaagcttggagaagatccgcggcaatttgaccgaagtgcgcccgacattcatgatttctgttccgcgcatctttgaaaaaatctatgcggcagtcatagcccagatccaaacccagcctttgaaaatgaaagtcttcaactgggccctggaaattggcaccaaagtcggcgaatacaaaatgagcggccaagttctgccgctggatctgctggttaagtacgaacttgcaaaaaaacttgtcctggacaaaattccgacggcattcggtggtcgcctgcgcttcgccatcagtggtggtgcgccgatcccgcgtgaaattgccctgttcttccacgccgcgggcattctgattctggaaggctatggtctgactgaaaccacagccgccgttacggtcaatacacctttcaactataaattcggcagcgtcggccgtcccattggcgaagtgaagctgaagattgcggaagatggcgagattctggtaaagagcgacaaggtgatgaaggaatactataaaaatcctgaagccaccaaggaagccttcaccgatggctggttccacaccggcgacattggagaaatcctgcctggtggtgacctaaaaatcactgatcgcaaaaaagatctgattaaaaccgcaggtggcaagtacgtggcaccgcagcgcctggaaggactgctcagtctgtccccatacattgccaacgttttggtccacggtgaccaaagaaagtacatcgtggctttggtcacactggaccgcccgactgtggaaaatctggccaaggaaaaacaggtcagctattccgactggaattccttggtacagtccccgtttgtgcaggatctgatcaggaaagctgtggccgaaaccaactcgcagctggcgagctttgaaagcatcaaaaaatacgtcattcttcccaatgaatttacagtggaaggcggcgaactgacaccgtccctgaaagtgaaaagaaaagtgctggatcaacgcttcaaggacaaaatcgaagagctctatctatga

SEQ ID NO: 14103 - protein, 593 aa, Bdellovibrio bacteriovorus
MTKPTTLGHSILSMRSRNPHHVAVKYKVNDSWKEKSWNEYYSDIEAVGCALLSLGIKPGDRVAIMANTRVEWSTTDLGIFGIKAITVPIYQNNTADDVEYILNNSESRILICESRGPLKTFESVRSKCPKVEKVIVFDETCPNPDVVTWPKLLQMGKDYLAKHPSQFQELCASLTQEDIATILYTSGTTGRPKGVVMTHLQAISEVSEAFPLCGATEADTSLSFLPYAHILGRIEHWGHAYIGFTLAFAESLEKIRGNLTEVRPTFMISVPRIFEKIYAAVIAQIQTQPLKMKVFNWALEIGTKVGEYKMSGQVLPLDLLVKYELAKKLVLDKIPTAFGGRLRFAISGGAPIPREIALFFHAAGILILEGYGLTETTAAVTVNTPFNYKFGSVGRPIGEVKLKIAEDGEILVKSDKVMKEYYKNPEATKEAFTDGWFHTGDIGEILPGGDLKITDRKKDLIKTAGGKYVAPQRLEGLLSLSPYIANVLVHGDQRKYIVALVTLDRPTVENLAKEKQVSYSDWNSLVQSPFVQDLIRKAVAETNSQLASFESIKKYVILPNEFTVEGGELTPSLKVKRKVLDQRFKDKIEELYL

SEQ ID NO: 14104 - DNA, 1932 bp, Rhodopseudomonas palustris
  CDS (1)..(1932)
atgatggactatgccggccgcgtcgcggcagccgacaccttccccaagctgctccggctcaatgcaagggaattcgggaccgagatcgcgctgcgcgagaaagatctcgggctgtggcgggtgttcacctgggccgactatcaggcccgcgtgcacgacttcgcgctcggcatggtcgaactcgggctcaagcgcggcgacgtgattggcatcatcggcgacaaccggcctgactgggtttcggcagagatcgccacccatgcgatcggcggcctgagcctcgggctgtaccgcgacgtgctcgatgaggaggccgactatctgctcaactacggcgaggccaagctggtgttcgccgaggacgaggagcaggtcgacaagctactcggcctcgccgaccgcgcgccgcatctgaagcacatcgtctattccgatccgcgcgggatgcggaaatatgacgatccgcgcctcttgccggccgatcagctcgccaagctgggccgcgatcgcgccagccgcgagccgggcctgtacgaccggctggtcgacgccacgcagggcgaggacgtcgcgatcctgtgcaccacctcgggcaccacggcgcaccccaagctggcgatgctggcgtccgggcgcgtgctgaaacactgcgcgacgtatctgtcgttcgatccgaaggggccagacgacgaatacgtctcggtgctgccgctgccctggatcatggagcaggtctacgcgctcggcaaagggctgctgtgccggatgacggtcaacttcgtcgaagagcccgacacgatgatgaacgacttccgcgagatcgcgccgaccttcgtgctgttcgcgccaagggtctgggaaggtatcgccgcggacgttcgcgcccgggtgatggacgcctcgccgctgaagcagcgactttacaacgccggcatgagggccgggctggctgcgctcgaccatggccagcattcggcgttcgccgacgcggtgctgttccgcgcgctgcgcgaccggctcggcttcacgcggctgcgctcggccgcaaccggcggcgccgcgctcggcccggacaccttccgattcttccgcgccatgggcgtgccgctgcgcacactgtacgggcagaccgaactgctcggcgcctacacgctgcacaagccggatgcggtcgatcccgacaccaccggcgtgccgatgggcgccgagatcgagatcaaggtcctgaaccccgacgtccagggcatcggcgaagtggtggtgcgccaccccaacatgttcctcggctactacaagaacccggaagcctcgaccgccgacatcaaggacggctggatgcattccggcgacgccggctatttcaacggcgccggccagctcgtcatcatcgaccgcatcaaggacctcgccgagctgtcccatggagaacggttctcgccgcaatacatcgagaacaagctgaagttctcgccctacgtcgccgaagcggtgatcctcggcgccggccgcgacatgctggcggcgatgatctgcatccgctactcgatcatctcgaaatgggcggagaagaagcggatcgccttcaccacctattcggacctcgcctcccgccctgaagtctacgagctgctgcgccgcgaggtcgcgagcgtcaacgccaccctgccaccggcccaacgcatcagccgcttcctgctgctctacaaggagctcgacgccgacgacggcgagctgacccgtacccgcaaggtccgccgctcggtgatcaacgagaagtacggcgacatcatcgacggcatctatagtggacgtagcgacatctcggtcgataccgccatcaagttccaggacggcaccacccagcggatccgcaccacgctgagggtggtcgacctcggcgccggccacgcgcatgcggaggccgcggaatga

SEQ ID NO: 14105 - protein, 643 aa, Rhodopseudomonas palustris
MMDYAGRVAAADTFPKLLRLNAREFGTEIALREKDLGLWRVFTWADYQARVHDFALGMVELGLKRGDVIGIIGDNRPDWVSAEIATHAIGGLSLGLYRDVLDEEADYLLNYGEAKLVFAEDEEQVDKLLGLADRAPHLKHIVYSDPRGMRKYDDPRLLPADQLAKLGRDRASREPGLYDRLVDATQGEDVAILCTTSGTTAHPKLAMLASGRVLKHCATYLSFDPKGPDDEYVSVLPLPWIMEQVYALGKGLLCRMTVNFVEEPDTMMNDFREIAPTFVLFAPRVWEGIAADVRARVMDASPLKQRLYNAGMRAGLAALDHGQHSAFADAVLFRALRDRLGFTRLRSAATGGAALGPDTFRFFRAMGVPLRTLYGQTELLGAYTLHKPDAVDPDTTGVPMGAEIEIKVLNPDVQGIGEVVVRHPNMFLGYYKNPEASTADIKDGWMHSGDAGYFNGAGQLVIIDRIKDLAELSHGERFSPQYIENKLKFSPYVAEAVILGAGRDMLAAMICIRYSIISKWAEKKRIAFTTYSDLASRPEVYELLRREVASVNATLPPAQRISRFLLLYKELDADDGELTRTRKVRRSVINEKYGDIIDGIYSGRSDISVDTAIKFQDGTTQRIRTTLRVVDLGAGHAHAEAAE

SEQ ID NO: 14106 - DNA, 1659 bp, Rhodopseudomonas palustris
  CDS (1)..(1659)
atgtcccatcccggtgagcagtactatccacccggcgttcgctgggatgcggtgatcgcgagggggacgttgccggagctgctggcgcaggccgcgaaggactatgcgtcgcggccggcgttggagtttcgtgatcggcagatcacctacaccaagctcgaagcgatggccgagaccgcggcagccgcgctgctcgcagcaggctatggccgcgactcctcggtcgcgctgtatatcggcaacacgccggaccatccgatcaatttcttcggggcgctgaaggccggcgcccgcgtcgtgcatctgtcgccgctcgatggcgagcgggcgctatcgcacaagctcagcgactccggcgcgcgggtgctgatcacaaccgattccgccgcgctgctgccgatggccgagaggtttctcgccaaggggctgctcgatcgcctgatcgtgtgcagcgatgcgagctggggcgagtccgcgacgccactggcgccgctgcccagcgatccgcgggtgattacttacgccgacttcatcaagggcgcctccaagcccatggcctggccggcgattgtgccggacgatatcgcgctgttgcagtacaccggcggcaccaccggcctgccgaagggcgcgatgctaacccattcgaatctgacctcggcggtggcgatctacgacgtctggggtctggtgcgcgccaacagcggcggcattcatcgcgtgatctgcgtgctgccgctgttccacatctacgcgctcaccgtcatcctgctgcgctgcctgaagcagggcgacctgatctcgctgcatcagcgcttcgacgtcgccgcagtgttccgtgacatcgaggaaaagcgcgccaccgtgtttcccggcgtgccgacgatgtggatcgcgctcgccaacgatccgtcgctggagaagcgtgacctgtcgtcgctgacgatggccggctccggcggcgcgccgctgccggtcgaggttgcgcggctattcgagcgcaaaaccaatctgaagctgaagagcggctggggcatgaccgagacctgctcgcccggcaccggccatccgccggaagggccggataagccgggctcgatcggcctgatgctgccgggcatcgaactggacgtcgtcgcactcgatgatccgaagcgcgtgctaccgccgggcgaagtcggcgagctccgcgttcgcggtcccaatgtcaccaagggctattggaatcggccggaggagtccgcccacagttttgtcggcgatcgttttctgaccggcgacatcggctatatggaccaggatggctacttcttcctggtcgaccgcaagaaggacatgatcatctccggcggcttcaacgtctatccgcagatgatcgagcaggcgatctatgagcacccggcggtgcaggaagtgatcgtgatcggcgtgccggacgattaccgcggcgaggcggcgaaagcgttcgtcaagctgcgcgagggcgccaagccgttcagcatcgacgagctgcgcgccttcctcaccggcaagctcggcaagcacgaactgccgaccgcggtggagtttctcgacgaactgccgcgtaccacggtgggtaaactgtcccgccacgaactgcgcagccagcagaccacgaccaagacacagaccaagtaa

SEQ ID NO: 14107 - protein, 552 aa, Rhodopseudomonas palustris
MSHPGEQYYPPGVRWDAVIARGTLPELLAQAAKDYASRPALEFRDRQITYTKLEAMAETAAAALLAAGYGRDSSVALYIGNTPDHPINFFGALKAGARVVHLSPLDGERALSHKLSDSGARVLITTDSAALLPMAERFLAKGLLDRLIVCSDASWGESATPLAPLPSDPRVITYADFIKGASKPMAWPAIVPDDIALLQYTGGTTGLPKGAMLTHSNLTSAVAIYDVWGLVRANSGGIHRVICVLPLFHIYALTVILLRCLKQGDLISLHQRFDVAAVFRDIEEKRATVFPGVPTMWIALANDPSLEKRDLSSLTMAGSGGAPLPVEVARLFERKTNLKLKSGWGMTETCSPGTGHPPEGPDKPGSIGLMLPGIELDVVALDDPKRVLPPGEVGELRVRGPNVTKGYWNRPEESAHSFVGDRFLTGDIGYMDQDGYFFLVDRKKDMIISGGFNVYPQMIEQAIYEHPAVQEVIVIGVPDDYRGEAAKAFVKLREGAKPFSIDELRAFLTGKLGKHELPTAVEFLDELPRTTVGKLSRHELRSQQTTTKTQTK

SEQ ID NO: 14108 - DNA, 1830 bp, Corynebacterium diphtheriae
  CDS (1)..(1830)
atgcaagaagtaaccgcagaggctaaatacactatcggcccaaatgagacctgtttgaccgccatgttggacaccgctaaagcgcgtccttttggtgtgatgtttactcgtcccaaaaattatgagtggataaatgtcacatcccaagagttcgttgaagaggtctttgaggtggcaaaagggctgatccagtccggtgtggaacaaggagatcgcgtggcgttgctctcggagacacgctatgaatggtcgttgcttgattttgccatctgggcagccggcgcagtttccgtgccaatttatggatcttcctcgctacgccaagttgagtggattattgaagactccggtgcagtgtttgcaatcaccgagacacgagagcactccgagctaatgaagaacctcgtgcttggcgacgacggccacccgccgctcaagggatccccctcgcagctacgacgcatcgtagaaatcaactcctctgcaatttccacactgaaattcgaaggacgcgatgtgcctgattccgtcgtggaggaacgcattgccaacacgtcgtcaagcgatctggcttccttggtgtacacctcgggcacaacaggtcgccccaagggctgctgcctgacacactacaactggttatcgcaggtacgtgggcttctcacaaacgatattggagccattgcggtaccaggcaaccgtgtgctcaccttcctgccgcttgcacacgtgctggctcgagctgtgtcgctagccgttgcgatcggcggcgcaacgcaatctcactggtctgacttctcaaccatttcagtggaattccagcgtgcccgccccaacctgatcttgggtgtgccacgcgtatttgaaaaggtgcgcaatggtgcagccgcaaacgccatggcggctagccctattaaaggcaagctcttcctcgaagcagaaaaggtcgcacaagattactcgcgtgcacttgatacctccgaggggccaagccgtgcgctgcaacttaagcacaaggcattcgacaaactggtctaccgcaagattcgtgaggccatgggcaacgccgtgcgctattgcatctccggtggatcggcaatcagcccagaccttatgcacttcttccgcggactcggcgtacctgtctatgaaggctacggcttgactgaaaccacagcagcagcggctgtggactttagcaaccaagaaatcggcaccgtcggcccaccagtcggtggtacttcgattcgcattaacaacgacggcgagatcctggtcaaaggcaacatcgtcttcgacggttactggaagaacgaggaagccactgccgaaagcatgcatgacggctggttcaataccggcgacctaggtgaaattctcgagtcggggcacctagtgatcactggacgaaagaaagacctcatcgtgacagcaggcggaaagaatgtttcgcctgggccgctggaagattctttgcgttcgcacccactgatcagccaagcgatggtggttggcgacggcaaaccatttatcggattgctgatcacactcgatgaagacatgctcaagcgttggaagctcaaccgcaacattcctgaaggaaaaacagtgcgggatctgtcttctgacccagtacttcgagccgaaatccaagatgctattaatttggcgaattccactgtttcgcatgccgaagcgatcaagaaattctacattctggatcgcgatctgtcggaggaagcaaacgagctcactccaacgatgaaggtgaagcgcaacgttgtggcacgtcgatatgcagacgctatcgacgccctctacgggcactaa

SEQ ID NO: 14109 - protein, 609 aa, Corynebacterium diphtheriae
MQEVTAEAKYTIGPNETCLTAMLDTAKARPFGVMFTRPKNYEWINVTSQEFVEEVFEVAKGLIQSGVEQGDRVALLSETRYEWSLLDFAIWAAGAVSVPIYGSSSLRQVEWIIEDSGAVFAITETREHSELMKNLVLGDDGHPPLKGSPSQLRRIVEINSSAISTLKFEGRDVPDSVVEERIANTSSSDLASLVYTSGTTGRPKGCCLTHYNWLSQVRGLLTNDIGAIAVPGNRVLTFLPLAHVLARAVSLAVAIGGATQSHWSDFSTISVEFQRARPNLILGVPRVFEKVRNGAAANAMAASPIKGKLFLEAEKVAQDYSRALDTSEGPSRALQLKHKAFDKLVYRKIREAMGNAVRYCISGGSAISPDLMHFFRGLGVPVYEGYGLTETTAAAAVDFSNQEIGTVGPPVGGTSIRINNDGEILVKGNIVFDGYWKNEEATAESMHDGWFNTGDLGEILESGHLVITGRKKDLIVTAGGKNVSPGPLEDSLRSHPLISQAMVVGDGKPFIGLLITLDEDMLKRWKLNRNIPEGKTVRDLSSDPVLRAEIQDAINLANSTVSHAEAIKKFYILDRDLSEEANELTPTMKVKRNVVARRYADAIDALYGH

SEQ ID NO: 14110 - DNA, 4690 bp, Nocardia sp
  CDS (488)..(4012)
acggcgtaggcgatcacgtaaccggccacgatcagctgcaaggcagcgccggaggtgtgcagggaatcgcgaatcgacggaatcgcgacattgacgatggaggagtcgagcaccgccatgaactggccggtgaggatcaccgtgaggatggccagggtgcgccgcgcaccgtacgcggccggtggagctgccgggggcgcgacaaccggcgatgcggtggccgggtccggcgacaagatctgggtcatatgctgatcttgcgagctcgatgacaccggtaacaggagcccattaaaactggtaccggcaatacctggataagcggtcggatcctgggccgctgcggtggagtggccgccgttccggcccgatgtggccaagaccactcgagtcaccgccgcgtatcaccttcccggaagtatttacttaggctaacgtgttttacgggttgcagggcttttcctacttatgacaagggaggcttgccatggcagtggattcaccggatgagcggctacagcgccgcattgcacagttgtttgcagaagatgagcaggtcaaggccgcacgtccgctcgaagcggtgagcgcggcggtgagcgcgcccggtatgcggctggcgcagatcgccgccactgttatggcgggttacgccgaccgcccggccgccgggcagcgtgcgttcgaactgaacaccgacgacgcgacgggccgcacctcgctgcggttacttccccgattcgagaccatcacctatcgcgaactgtggcagcgagtcggcgaggttgccgcggcctggcatcatgatcccgagaaccccttgcgcgcaggtgatttcgtcgccctgctcggcttcaccagcatcgactacgccaccctcgacctggccgatatccacctcggcgcggttaccgtgccgttgcaggccagcgcggcggtgtcccagctgatcgctatcctcaccgagacttcgccgcggctgctcgcctcgaccccggagcacctcgatgcggcggtcgagtgcctactcgcgggcaccacaccggaacgactggtggtcttcgactaccaccccgaggacgacgaccagcgtgcggccttcgaatccgcccgccgccgccttgccgacgcgggcagcttggtgatcgtcgaaacgctcgatgccgtgcgtgcccggggccgcgacttaccggccgcgccactgttcgttcccgacaccgacgacgacccgctggccctgctgatctacacctccggcagcaccggaacgccgaagggcgcgatgtacaccaatcggttggccgccacgatgtggcaggggaactcgatgctgcaggggaactcgcaacgggtcgggatcaatctcaactacatgccgatgagccacatcgccggtcgcatatcgctgttcggcgtgctcgctcgcggtggcaccgcatacttcgcggccaagagcgacatgtcgacactgttcgaagacatcggcttggtacgtcccaccgagatcttcttcgtcccgcgcgtgtgcgacatggtcttccagcgctatcagagcgagctggaccggcgctcggtggcgggcgccgacctggacacgctcgatcgggaagtgaaagccgacctccggcagaactacctcggtgggcgcttcctggtggcggtcgtcggcagcgcgccgctggccgcggagatgaagacgttcatggagtccgtcctcgatctgccactgcacgacgggtacgggtcgaccgaggcgggcgcaagcgtgctgctcgacaaccagatccagcggccgccggtgctcgattacaagctcgtcgacgtgcccgaactgggttacttccgcaccgaccggccgcatccgcgcggtgagctgttgttgaaggcggagaccacgattccgggctactacaagcggcccgaggtcaccgcggagatcttcgacgaggacggcttctacaagaccggcgatatcgtggccgagctcgagcacgatcggctggtctatgtcgaccgtcgcaacaatgtgctcaaactgtcgcagggcgagttcgtgaccgtcgcccatctcgaggccgtgttcgccagcagcccgctgatccggcagatcttcatctacggcagcagcgaacgttcctatctgctcgcggtgatcgtccccaccgacgacgcgctgcgcggccgcgacaccgccaccttgaaatcggcactggccgaatcgattcagcgcatcgccaaggacgcgaacctgcagccctacgagattccgcgcgatttcctgatcgagaccgagccgttcaccatcgccaacggactgctctccggcatcgcgaagctgctgcgccccaatctgaaggaacgctacggcgctcagctggagcagatgtacaccgatctcgcgacaggccaggccgatgagctgctcgccctgcgccgcgaagccgccgacctgccggtgctcgaaaccgtcagccgggcagcgaaagcgatgctcggcgtcgcctccgccgatatgcgtcccgacgcgcacttcaccgacctgggcggcgattccctttccgcgctgtcgttctcgaacctgctgcacgagatcttcggggtcgaggtgccggtgggtgtcgtcgtcagcccggcgaacgagctgcgcgatctggcgaattacattgaggcggaacgcaactcgggcgcgaagcgtcccaccttcacctcggtgcacggcggcggttccgagatccgcgccgccgatctgaccctcgacaagttcatcgatgcccgcaccctggccgccgccgacagcattccgcacgcgccggtgccagcgcagacggtgctgctgaccggcgcgaacggctacctcggccggttcctgtgcctggaatggctggagcggctggacaagacgggtggcacgctgatctgcgtcgtgcgcggtagtgacgcggccgcggcccgtaaacggctggactcggcgttcgacagcggcgatcccggcctgctcgagcactaccagcaactggccgcacggaccctggaagtcctcgccggtgatatcggcgacccgaatctcggtctggacgacgcgacttggcagcggttggccgaaaccgtcgacctgatcgtccatcccgccgcgttggtcaaccacgtccttccctacacccagctgttcggccccaatgtcgtcggcaccgccgaaatcgtccggttggcgatcacggcgcggcgcaagccggtcacctacctgtcgaccgtcggagtggccgaccaggtcgacccggcggagtatcaggaggacagcgacgtccgcgagatgagcgcggtgcgcgtcgtgcgcgagagttacgccaacggctacggcaacagcaagtgggcgggggaggtcctgctgcgcgaagcacacgatctgtgtggcttgccggtcgcggtgttccgttcggacatgatcctggcgcacagccggtacgcgggtcagctcaacgtccaggacgtgttcacccggctgatcctcagcctggtcgccaccggcatcgcgccgtactcgttctaccgaaccgacgcggacggcaaccggcagcgggcccactatgacggcttgccggcggacttcacggcggcggcgatcaccgcgctcggcatccaagccaccgaaggcttccggacctacgacgtgctcaatccgtacgacgatggcatctccctcgatgaattcgtcgactggctcgtcgaatccggccacccgatccagcgcatcaccgactacagcgactggttccaccgtttcgagacggcgatccgcgcgctgccggaaaagcaacgccaggcctcggtgctgccgttgctggacgcctaccgcaacccctgcccggcggtccgcggcgcgatactcccggccaaggagttccaagcggcggtgcaaacagccaaaatcggtccggaacaggacatcccgcatttgtccgcgccactgatcgataagtacgtcagcgatctggaactgcttcagctgctctgacggatatcaggccgccgcgcgcacctcgtcggtgcgttcggcgccttcgcgccggaggcgaaacaggaataccgccgagccacccaggacagcggcgtagacgatgacgaagctgttgatcaggacctgggcgaccggccaccacggcgggaacaggaacagcccgacgacaacgtagtccgggctgtattcccacgtccacgcgccgatcgagacgaagagcgcggccgaggcaagccaccaccacggctgcgactgcgccctgtgcagtagatagacgaacaggggaacgaaccacacccagtggtggtcccaggagaacggcgagaccgcgcaggcggtgaggccggcgagggtgaccgcgaggagctgttcgccacgccgatacaggccgatggtgacggccagactcgccagcgcgacggagcccgcgatgagcagccacagccacaccggcgccgggtgatgggtcaggtgcgcgatggcgccgcggatggattgattggacgggtgcatatcgtccgcgatccgattggactggaagaacgtcgaggtccagtactgccgggaatcggcgggcagcacgatccaggcgaggacgatggacgcgatgaacaccgccacggcggtgcacgcggaccgccactgccgcaacgcgaggaattgcacgacgaagta

SEQ ID NO: 14111 - protein, 1174 aa, Nocardia sp
MAVDSPDERLQRRIAQLFAEDEQVKAARPLEAVSAAVSAPGMRLAQIAATVMAGYADRPAAGQRAFELNTDDATGRTSLRLLPRFETITYRELWQRVGEVAAAWHHDPENPLRAGDFVALLGFTSIDYATLDLADIHLGAVTVPLQASAAVSQLIAILTETSPRLLASTPEHLDAAVECLLAGTTPERLVVFDYHPEDDDQRAAFESARRRLADAGSLVIVETLDAVRARGRDLPAAPLFVPDTDDDPLALLIYTSGSTGTPKGAMYTNRLAATMWQGNSMLQGNSQRVGINLNYMPMSHIAGRISLFGVLARGGTAYFAAKSDMSTLFEDIGLVRPTEIFFVPRVCDMVFQRYQSELDRRSVAGADLDTLDREVKADLRQNYLGGRFLVAVVGSAPLAAEMKTFMESVLDLPLHDGYGSTEAGASVLLDNQIQRPPVLDYKLVDVPELGYFRTDRPHPRGELLLKAETTIPGYYKRPEVTAEIFDEDGFYKTGDIVAELEHDRLVYVDRRNNVLKLSQGEFVTVAHLEAVFASSPLIRQIFIYGSSERSYLLAVIVPTDDALRGRDTATLKSALAESIQRIAKDANLQPYEIPRDFLIETEPFTIANGLLSGIAKLLRPNLKERYGAQLEQMYTDLATGQADELLALRREAADLPVLETVSRAAKAMLGVASADMRPDAHFTDLGGDSLSALSFSNLLHEIFGVEVPVGVVVSPANELRDLANYIEAERNSGAKRPTFTSVHGGGSEIRAADLTLDKFIDARTLAAADSIPHAPVPAQTVLLTGANGYLGRFLCLEWLERLDKTGGTLICVVRGSDAAAARKRLDSAFDSGDPGLLEHYQQLAARTLEVLAGDIGDPNLGLDDATWQRLAETVDLIVHPAALVNHVLPYTQLFGPNVVGTAEIVRLAITARRKPVTYLSTVGVADQVDPAEYQEDSDVREMSAVRVVRESYANGYGNSKWAGEVLLREAHDLCGLPVAVFRSDMILAHSRYAGQLNVQDVFTRLILSLVATGIAPYSFYRTDADGNRQRAHYDGLPADFTAAAITALGIQATEGFRTYDVLNPYDDGISLDEFVDWLVESGHPIQRITDYSDWFHRFETAIRALPEKQRQASVLPLLDAYRNPCPAVRGAILPAKEFQAAVQTAKIGPEQDIPHLSAPLIDKYVSDLELLQLL

SEQ ID NO: 14112 - DNA, 1734 bp, uncultured bacterium 314
  CDS (1)..(1734)
atgcccaccacaaaacaaatgaatttaaaagaatttaatagtttaacagatttatttttttaccaagcggaaaaacaaaatcctaaaaggatttttttagaatggcttaatccaaaaaataaaaaaaaatttacttggtcagaaacatcttcaaatatttataaacttgctaaaattttaaaaaaaaatatcaatgatggagatagatgccttttagtttcagaaaatagaccggagtggctaattgctgatcttgcagtaatgctagcaaacggtattactgttcccgcctacaccacatataccgaaagggactataaatatttaatcgaagattgccagccttctgtaattatcatttctaatgatctgatgcacaataaacttaaaaatataattaaagaaaaaatttatataaaaaaagtaattactttagataaaattgaaggagttgatggggataaatatttagattttaattctattgtcaaaataaatttattagaaaatgaaaaaataaaaaatacaaatctaaaaagaacttcgcctgcctgcataatatatacttcaggaacaggaggaaatcccaaaggcgttattctcagtcacggaggaatattaaataatttagaaggagctagtaaaattttaaaaccattaatagataaaagaccaatttttttaacctggcttcctttatcacattcttatgaacatacggttcagtttgtacaaattttagttggggcaaaagttttttatgcagaaaaaatagaaaaacttttagataatatttcggaagctaaaccgacaattatgacggccgttcctcgtttttatcagaacctttacaacaaaataaatataaatatgaaaaaagcaaaaggacttaaagctaaattaattaaagcaacaatttttctgggaagaaaaaaacttttaaaacaaaaaatgagtttatccgaaaaatttttgaattttattgttaacgctttagttagaaaaaaggtgaaaaaacagtttggtggaaatttaagggcttttgtttcagggggtggagctctagacagagagataggtgaatttttaaacgccattggactaccaaccttacaaggatatggtttaacagaaacttctccagtagttagctgtaacccaatccacaaaattaaggtcgaaaccgtaggtcctccatttaaaggcaatcaagttaaaattgctgaagatggagagattttagttaagggagaaaatgtcatgttaggttattggaataacaaagaagatactgaaaaagttattaaagatggctggctatatacaggtgacattggagaaatagatcctgaagatggctatttaaaaattacagatagaaaaaaagatataattgttagcgcaggtggagataatatttctccagctaaaattgaaaatcaattatcaaactctccggaaatagatcagtgtatggtatggggagatggaaaaaattatttagtcgctttaattgttccaagcaaagaattcaaagaacaaaaagataaaataggcaaaataataaataaaattaacgaaaatttagctcaaattgaaaaaataaaaaattttcacttagttagtgaaaacttttcaattgaaaatggtatgctaactccgacaatgaaagtaaaaagaaacaaagtaattgcaaaatataaaaatatattagaaaatttttataaagaataa

SEQ ID NO: 14113 - protein, 577 aa, uncultured bacterium 314
MPTTKQMNLKEFNSLTDLFFYQAEKQNPKRIFLEWLNPKNKKKFTWSETSSNIYKLAKILKKNINDGDRCLLVSENRPEWLIADLAVMLANGITVPAYTTYTERDYKYLIEDCQPSVIIISNDLMHNKLKNIIKEKIYIKKVITLDKIEGVDGDKYLDFNSIVKINLLENEKIKNTNLKRTSPACIIYTSGTGGNPKGVILSHGGILNNLEGASKILKPLIDKRPIFLTWLPLSHSYEHTVQFVQILVGAKVFYAEKIEKLLDNISEAKPTIMTAVPRFYQNLYNKININMKKAKGLKAKLIKATIFLGRKKLLKQKMSLSEKFLNFIVNALVRKKVKKQFGGNLRAFVSGGGALDREIGEFLNAIGLPTLQGYGLTETSPVVSCNPIHKIKVETVGPPFKGNQVKIAEDGEILVKGENVMLGYWNNKEDTEKVIKDGWLYTGDIGEIDPEDGYLKITDRKKDIIVSAGGDNISPAKIENQLSNSPEIDQCMVWGDGKNYLVALIVPSKEFKEQKDKIGKIINKINENLAQIEKIKNFHLVSENFSIENGMLTPTMKVKRNKVIAKYKNILENFYKE

SEQ ID NO: 14114 - DNA, 3427 bp, Cryptosporidium parvum
  CDS (513)..(2813): n means a or g or c or t/u
tgaatcggtatccatttaatgggccggcttttttgcgcaataataaagtagtttaaggtctacggaaagcgaccagtatttaaataaatttaatataaccatagcgataaattaattataatgatttagtagcaaaataggaatcatgttatccttttaacaaaataattaaaataggcgtgtaaacaaatagtaatattttattagacaataataagttatttttatttcaactacaaagatatatnatttttgtgaaatagtaacaatttataagtggtaaaccagtttacacacttgaattgaaattaagggattaagaaaagttgtttaatgctttaaaagcatattttatagtctctaaatattaacttattattcttagttaggaaataaagccaaattaattgtaaaatttaattaagaagcagcgttttaactatttgtaaagccaattagagattatttaattacagtgatattaagagaacaaatatcaataaagaatagatatgaagattctaagattagcattgttagtatttgcgtttatgatgtcgataaacttaataggaagtatgaagagtaaatactaccttggaagatggaagaatgcaatccattccgtggcagttgaaggcactgatgatcatccattaatgagtgcaatttacagacatagagaacacaaggctgaattgatcgccaactttgaagaatcaataacaaatttgatagatttaataaaacgtggtatggtaacaagtatggatggatatatgtatggtagaagacaagtgaaaaagacattggactatgacccaatttcgaaattggcagagagtgatgatgcaaagatagcaaaaaaaaagaagaaaaagggaattcccttaatggaatggtttagatactcgtcggttttgaaattggctgctgaatttggttcagggttgttatcattaaaggattcagctccttttgtggaccattcaccagatattaagaaaccgataagaacagtatctattttgtctaagaacagactggaatggagtttgacagaaattgcttgttctacttacggaatggtattaagtccaatgtatgatgctttaggcccagacggagtagcacatagtattaatttggtaggctcttcaacagtggtagtttcaatggaagctttgagcactattttgaatgtacttccaaggctcccagggatcagatatattgttttactaaggccagaagatggaggcgatgtagaatatccgttagataaagtggaattatcaaaggataccctcaaagcttatggtgtccaggtttcactttcaaagtatgagattccgagtcacgtaaattttgtaacatttgaagcagtgatgaggcttggtgaattgaatttgaaggaaccaactccctcaggttatgatgatgttaattcaatttatttcacatcaggtacaacaggagttccaaagggtgcaattcatacaaacgggaattggattgcaggagcatctgcttctcttagatcatttttgaatagatcagactgcactcttggaccaaaagacaggtatctaagtttcttaccattagctcacatttttgaacgcgaggtgaaccatatattaatttattcaggaggcacaatttgtttctatggaggagatattttgaagattggagatgatatgaaggctgcaagaccaacggtctttatagctgtcccaagattgtttacacgaatctataaagggaaagtactacaagaagtaaggaagaagagtgatggcgtacagaagtttttcttcaagattttaagaagaaaggttcatagtaatcatccagtcaagcactggctatatgattctttatcatttaagaagattagcaacgttcttggagggaagattaagtttacattaagtggagcagctccattggatgagcatactcagagagatatgagggctttactgagaactcatgtagtacaggggtatggtacaacagaggctctagctgcgttttgtccagaattcacagacttgagcgtgaacaatgttggaggaccaattccatgcatagaatttagatttttgagtattccagaaatggactatgatgccaaaagctatccaataaggggtgagcttttgattagaggtactactatttttaaaggataccttaaacagccaaaggaaacagccgaggctattgacaaggatgggtggttacatactggagatattgccgaattgactgacagcggtgcaattagaattattgacagaagaaaacacttattcaagctttctcaaggtgagtatatctcaccagagactcttgaaaatatttatattgctcattctcaaatagttggacaaatgttcatcaccgctaaaactacagagtctgtgattgttgcagtaattgttccagattccgagttcgttaaagattggtcaaaaaaaaatggggtaattatttcctcagattggcaagctcaatttaaacagatatgtactgaagcaaacacaaaatactttgaagaaaacaccaatactcctctccgtgaagaaattattgcttctcttaaacatgtggaagaccagcaaggaataaagggattcaagaaggtcaatgatttttatcttgaatgtgatgggttcacagttgaaaatggcctattaaccccaacaaacaagcttatgagacacaaggcaaacaaggtatacttggacaaagtcgagaagctttatgtaataatcaacaacaaattaggaaataagctataaatgagagaattcttctctttaagcttaccccccttgaagttctttctgtgtgagatccctttgctttttttgatttattactagtaatatttcctccagttcatttccttttccagaaaaagctattctcaaatcaataacttttaacttttctatactcagttggtcaatccttggtcatctattccgaatgggtatcattcttttttcccctcccgcctatattgctggtgtaaagcactcgaaggagattacatgtggatgatgtgatttttgcatgcaattacgaagtgggggcggtaaatgcatttttgctatgaattagtaaatagacaaacaagtggtgtgcgagagtagagtaaaagttatactaggcttatttctactattcaaagtattgctttgagtagctcatccgaggttctcggttgtttggtttttttttggagattttaaaaacaaggaatgctaaatatgaattcagtattatgagtttttccgtgcattttatagtagaacgtttaaaatctggcgaattgtggtcaagagagaatgttctccttatgttcatatttaacagtagctcaaatgaacttttaagtgttagtatttgc

SEQ ID NO: 14115 - protein, 766 aa, Cryptosporidium parvum
MKILRLALLVFAFMMSINLIGSMKSKYYLGRWKNAIHSVAVEGTDDHPLMSAIYRHREHKAELIANFEESITNLIDLIKRGMVTSMDGYMYGRRQVKKTLDYDPISKLAESDDAKIAKKKKKKGIPLMEWFRYSSVLKLAAEFGSGLLSLKDSAPFVDHSPDIKKPIRTVSILSKNRLEWSLTEIACSTYGMVLSPMYDALGPDGVAHSINLVGSSTVVVSMEALSTILNVLPRLPGIRYIVLLRPEDGGDVEYPLDKVELSKDTLKAYGVQVSLSKYEIPSHVNFVTFEAVMRLGELNLKEPTPSGYDDVNSIYFTSGTTGVPKGAIHTNGNWIAGASASLRSFLNRSDCTLGPKDRYLSFLPLAHIFEREVNHILIYSGGTICFYGGDILKIGDDMKAARPTVFIAVPRLFTRIYKGKVLQEVRKKSDGVQKFFFKILRRKVHSNHPVKHWLYDSLSFKKISNVLGGKIKFTLSGAAPLDEHTQRDMRALLRTHVVQGYGTTEALAAFCPEFTDLSVNNVGGPIPCIEFRFLSIPEMDYDAKSYPIRGELLIRGTTIFKGYLKQPKETAEAIDKDGWLHTGDIAELTDSGAIRIIDRRKHLFKLSQGEYISPETLENIYIAHSQIVGQMFITAKTTESVIVAVIVPDSEFVKDWSKKNGVIISSDWQAQFKQICTEANTKYFEENTNTPLREEIIASLKHVEDQQGIKGFKKVNDFYLECDGFTVENGLLTPTNKLMRHKANKVYLDKVEKLYVIINNKLGNKL

SEQ ID NO: 14116 - DNA, 2058 bp, Cryptosporidium parvum
  CDS (1)..(2058)
atggaagagaaaatcgacaggaaagattttttctcagtagagcttgaaaatggacaagtagaacctgaatcatctccaatatatagaaatcctagttattctaaaggtgaattatcaaatttacaaggtttaaatgcaaacaatttatgggaactatttgtaaattctgtaaataaatataagaataaaaaatgtcttggaacaagaaaactaaatagagatggaacttatggagaatatgtatttaaaagctatgaagaattgaaagaagaggctttaaatattggtattaatattttaaagatggatttatgcccaataagaaaatatgaagataatgaatatcaaaaagaaattagtatgatgggtatattgagtagaaatagagaagaatggtatttaacagaacatgcatgtaatgcatttggaatttgtttagctcctttatatgatactttgggagaagataatttaaaatttatactggtgcaaacacaattaaaaagtctatgtatttcaaatgatagtttagaaaagattatatcaattattgaaagatctataattgattcaaccagagattcaatattaataaaaaatttgatatgctttgatcatccaacaacagaaattaatcagagagctaagaatttagatattaatttgattttattcaagaatttacaagaaaaagtcagtaagaaagataaagaaatatacaaacccaaaaaaattaaaccagatgatatgtgttcaatacattttacatcgggaactactggatatccaaaaggagcaatattaacacatcgttgttttttagcatgcgtaaaaagttcatatgaacatttattttcagagaaagaaatacaattagataatgaagatgcacatttatcttatcttccaatggcacatatatttgaaagattaattgtaatgaatgcttattatttgggaataccaattggtatatttagtggtagtgtaacaagattaatgagtgattcacaaaaattaaaaccaacaatattagtttgtgtaccacaagtcttaacaagaattattcaaacagttaatgataaaattagtcaatcaaactttttagtaagaacagtatttcataaagcattgaaacaaaaagaaagtattattaaaacaaaaggagatccaacacattggttatgggatagaattatttttagtaatacaagacagatattaggtggaaaattgaaagctataataagtggagcagcaccattaggtttagaagtaaatcataaaatacaagcaattttttgttgtaaattaattgaaggatttggtatgtcagaatgtattggtactttaggtacaagatattcatatgcacatttaggtactgttggtggtccatttagtgatgtagaagtcaaattaacatcagtattagaaatggggtatgattcaacaaaagaaccaagaagaggattattaaagataagaggtaacagtgtatgtaaaggttactttagggatataatcaatagtaaagaattgattgatagtaatggttggttagatactggtgatatagcagaaagacaacaagatggctcatttaagattattgatagaaagaaatcattatttaaattgtctcaaggtgaatatatttcaccagaaagaattgagggaatatatttatcatcatcatcattaattcaacatgtatatgtatatggtcaatcaactgatagatttttagtagctttaatattcccaaatgagcaagcattaagaaaatggtcggaagataaaggaatgaatactttatcattatctttggaagaattatgtgaatctcatgaattatttgatgaattgaatgattcttttcataaagctgaattaagttcaaatttatttggttttgagagaatacataaatttaaagtaattcctgaggttttaagtacttcaaatggattattaacaccaactatgaagattgtgagaaataaagtcaattcaaagtataaggaagttttgaatactttaagatcacaaatttga

SEQ ID NO: 14117 - protein, 685 aa, Cryptosporidium parvum
MEEKIDRKDFFSVELENGQVEPESSPIYRNPSYSKGELSNLQGLNANNLWELFVNSVNKYKNKKCLGTRKLNRDGTYGEYVFKSYEELKEEALNIGINILKMDLCPIRKYEDNEYQKEISMMGILSRNREEWYLTEHACNAFGICLAPLYDTLGEDNLKFILVQTQLKSLCISNDSLEKIISIIERSIIDSTRDSILIKNLICFDHPTTEINQRAKNLDINLILFKNLQEKVSKKDKEIYKPKKIKPDDMCSIHFTSGTTGYPKGAILTHRCFLACVKSSYEHLFSEKEIQLDNEDAHLSYLPMAHIFERLIVMNAYYLGIPIGIFSGSVTRLMSDSQKLKPTILVCVPQVLTRIIQTVNDKISQSNFLVRTVFHKALKQKESIIKTKGDPTHWLWDRIIFSNTRQILGGKLKAIISGAAPLGLEVNHKIQAIFCCKLIEGFGMSECIGTLGTRYSYAHLGTVGGPFSDVEVKLTSVLEMGYDSTKEPRRGLLKIRGNSVCKGYFRDIINSKELIDSNGWLDTGDIAERQQDGSFKIIDRKKSLFKLSQGEYISPERIEGIYLSSSSLIQHVYVYGQSTDRFLVALIFPNEQALRKWSEDKGMNTLSLSLEELCESHELFDELNDSFHKAELSSNLFGFERIHKFKVIPEVLSTSNGLLTPTMKIVRNKVNSKYKEVLNTLRSQI

SEQ ID NO: 14118 - DNA, 1641 bp, Bacillus amyloliquefaciens
  CDS (1)..(1641)
atggctgaacttatccatttaacagccggaaagctgcttgagcggaccgcggagctttttccggatcgtgaagcggttgtttaccctgagcgcggccttcgttatacgtatgccgagtttgaccggttatgccggcaaaccgcaaaagggctgatgaagctgggagttgaaaaaggagatcatgtggccatatgggcatccaacattccggaatggctcgcggcgcaatttgcaacagcgaaaatcggcgccgttctggtcaccattaataccaattttcaaatcgcagagctcgattacctgctggcacattcagacgtctcggccttgataatcatggattcctaccggcagacatcttatgttgaaatcgtgaataagctgattccggagctgaaaacttgtgagcgcggcaggctgcgttcgaaacgttatccatttttacggacggtgttatatatcggtgataaaagcccgcccgggatgcaccgttgggattcattgctggataatgccgaagctgtaacggatgcgacgcttgacggaaggatggacagcctgaaaaaggatgattgcattcatatgcaatatacatcaggtacgaccggatttccgaagggcgtcatgctctcacattttaatatcgtaaataacgcggccaatatcgcagaatgcatgaagcttacttcaagtgaccgtttatgtattcccgtgccgtttttccactgcttcgggtgtgtgctcggcgtgctggcatgtgtttccgcgggtgcggcgatgattccgatcgaacagttttctccgccggccgttctgaaaacggtggagcaagaagcctgtacggctctgcacggtgtaccgacgatgtttatcgccctcctaaatgacagccgtttttctgaatatgatctttcccacgtccgaaccgggattatggcaggctcgccatgcccggcggaagtcatgagagaagtgatcggcaaaatggggatgactgacattacaattgcctacggacagaccgaagcatcacctgttattacgcagacaagaacggatgattcatttgaaagaagagtggaaacagcggggcgcgcgcttccccatatcgaagtcagaatcgttcggcccggaacatccggagaagccgcccggggcgaacaaggagagctctgcacccgcggatatcatgtcatgaaaggctattataaaaatcaagaagcgaccgaagaagcgatagacaaagacggctggctgcataccggtgatttggcggtcatggacgaggacgggtactgcaaaatcacgggccgtctgaaagacatgctgatcaggggcggcgaaaatatctatccgcgcgagattgaggaaatgttatatcggcatcccgcggtagcagacgttcaggtcgtcggcgttcctgatccgaaatacggagaagaggccgcggcgtgggtcaggctcaaagacggacaaaccgcttccgcagaagacatcagaaccttttgcaaagaacatatcgcccgctataaagtccccaggtacgttttgtttacagatgaatatccaatgacagcctcaggaaaaattcagaaattcaagctgcgggaaaaaacgattgaagagctcaagttaacttaa

SEQ ID NO: 14119 - protein, 546 aa, Bacillus amyloliquefaciens
MAELIHLTAGKLLERTAELFPDREAVVYPERGLRYTYAEFDRLCRQTAKGLMKLGVEKGDHVAIWASNIPEWLAAQFATAKIGAVLVTINTNFQIAELDYLLAHSDVSALIIMDSYRQTSYVEIVNKLIPELKTCERGRLRSKRYPFLRTVLYIGDKSPPGMHRWDSLLDNAEAVTDATLDGRMDSLKKDDCIHMQYTSGTTGFPKGVMLSHFNIVNNAANIAECMKLTSSDRLCIPVPFFHCFGCVLGVLACVSAGAAMIPIEQFSPPAVLKTVEQEACTALHGVPTMFIALLNDSRFSEYDLSHVRTGIMAGSPCPAEVMREVIGKMGMTDITIAYGQTEASPVITQTRTDDSFERRVETAGRALPHIEVRIVRPGTSGEAARGEQGELCTRGYHVMKGYYKNQEATEEAIDKDGWLHTGDLAVMDEDGYCKITGRLKDMLIRGGENIYPREIEEMLYRHPAVADVQVVGVPDPKYGEEAAAWVRLKDGQTASAEDIRTFCKEHIARYKVPRYVLFTDEYPMTASGKIQKFKLREKTIEELKLT

SEQ ID NO: 14120 - DNA, 1695 bp, Desulfovibrio vulgaris
  CDS (1)..(1695)
atggaagaacttagcctctacacgttgcggcatgtgctcgaacgcagtgccgtcctgtatgccgaccagccctcgctctcacagcttggctgcgaaccgctgaccttccgcgacctgcacgaccacgcagaacacctcgccctgtggctgcgtgacaacggcgtcggcactggcgaccgggtggcgctccttgccgagaacagccccaactggggcatcgcctacttcgccatcaccggcatgggtgcgattgccgtgcccatccttcccgaattccacgccgacgcggtgcagcacatcctgcgccactctgaagccaaggcggtgttcgtatccgaacgcctcttccccaaactggaagagggtgagggcatcgccgacagcctcatgtgcatcagcatggagacgttccagtccatcgcacagggaaccacgcgcgacatgcttcgcgaactcaagtcaaaaggtctgcgtgaattccgcaagctgcgcgacaaggcgaagcgactcgccaacatggccgacgcagcccctgcggaggacgacgtcgcagccatcatctacacgtcaggcacgacgggccattccaagggggtcgtactgacccaccgcaacatcgtctgggacgccgatgccgtgaagagcatcgtgaaacttggccccggagacaggatgctctccatcctgcccctctcccacacgtacgaatgtacgctgggcctcgtgctgcccgtgctcaacggcgcgcacgtccactatatggacaagccgcccacggcgcgtgcccttctccccgccatggcgcaggtgcgccccacggccatgctctccgtaccgctggtcatcgaaaagatcttcaagaccgcgctgttgcccaaactcaccgggtcgtggctcaaacagcgcctttacgccattcccttcgtgcgtcgcaaactgcatgcgcttgcggggcgcaagttgctcgaatcgttcggcggggcactgcgcatcttctgcatcggcggtgcgggtatcgcccccgatgtggaacgcttcctgcgcgaggcgaacttcccctatgccatcggttacgggctcaccgagacggccccccttgtggcgggttccggcccggcgtccacacgtcttacgtccaccgggttcaccctcgacggtgtggacatcgccattgatgcgcccgaccccgccacgggggaaggagagatcatcgttcgcggccccaacgtcatgcgcgaatactacaaggcaccgcagataacggcctcggccttcacccccgaaggctggttccgcacgggcgacctcggcaagttcgacgccgatggctacctgtacatcaagggcaggctcaagaacgtcatcatcggccccagcggggagaacatctaccccgaagaggtcgaagccatcatccaccagtcgcctttcgtcctcgaatcgctggtcttccagcaggatggcagactggtggcacgcatccacctcgatgcagcccggctggacgagtcctttggtgacctgcccgccctcaagcagcgcgaaaagatagacgccctgctcgagaccctccgcaacgaggtcaacaccaaggtgtcgacgttcgcccggcttgccaaggtcatcgaacagaccgaacccttcgagaagacacccacgcacaagatcaaacgctacctgtacgtggagcaatag

SEQ ID NO: 14121 - protein, 564 aa, Desulfovibrio vulgaris
MEELSLYTLRHVLERSAVLYADQPSLSQLGCEPLTFRDLHDHAEHLALWLRDNGVGTGDRVALLAENSPNWGIAYFAITGMGAIAVPILPEFHADAVQHILRHSEAKAVFVSERLFPKLEEGEGIADSLMCISMETFQSIAQGTTRDMLRELKSKGLREFRKLRDKAKRLANMADAAPAEDDVAAIIYTSGTTGHSKGVVLTHRNIVWDADAVKSIVKLGPGDRMLSILPLSHTYECTLGLVLPVLNGAHVHYMDKPPTARALLPAMAQVRPTAMLSVPLVIEKIFKTALLPKLTGSWLKQRLYAIPFVRRKLHALAGRKLLESFGGALRIFCIGGAGIAPDVERFLREANFPYAIGYGLTETAPLVAGSGPASTRLTSTGFTLDGVDIAIDAPDPATGEGEIIVRGPNVMREYYKAPQITASAFTPEGWFRTGDLGKFDADGYLYIKGRLKNVIIGPSGENIYPEEVEAIIHQSPFVLESLVFQQDGRLVARIHLDAARLDESFGDLPALKQREKIDALLETLRNEVNTKVSTFARLAKVIEQTEPFEKTPTHKIKRYLYVEQ

SEQ ID NO: 14122 - DNA, 1629 bp, Thermus thermophilus
  CDS (1)..(1629)
atgatggagggggaaaggatgaacgggttcccgagcaccatgatggaggaggagctgaacctttgggacttcctggagcgggcggcggcgcttttcggcaggaaggaggtggtctcccgcctccacaccggggaggtccaccgcaccacctacgccgaggtctaccgaagggccaggaggctcatgggggggcttagggccctcggggtgggcgtgggggaccgggtggccaccctgggcttcaaccacttccgccacctcgaggcctacttcgccgtccccggcatggggtcggtcctccacaccgccaacccccgcctctcccccaaggagatcgcctacatcctgaaccacgccgaggacaaggtcctcctctttgaccccaacctcctgcccctggtggaggccatccggggcgagctgaagacggtgcggcacctcgtggtcatggacgagaaggccccggagggctacctggcctacgaggaggtcctgggggaggaggtggaccccgtgcgggtgccggagcgggccgcctgcggcatggcctacaccacggggaccacgggcctccccaagggggtggtctacagccaccgggccttggtcctccactccctggcggcgagcctcgttgacggcaccgccctctcggagaaggacgtggtcctgccggtggtgccgatgttccacgtcaacgcctggtgcctgccctacgccgccaccctggtgggggccaagcaggtcctgcccgggcccaggctggaccccgcctccctggtggagctctttgacggggagggggtgaccttcaccgccggggtgcccacggtctggctcgccctggcggaccacctggagagcacgggccaccgcctgaagaccctgaggcggctcgtggtggggggctcggccgcgcccaggagcctcattgagcgctttgagcggatgggcgtggaggtgcgccagggctacggcctcaccgagacctccccggtggtggtgcagaacttcatcaaaagccacctggaggccctccccgaggaggagaagctcaccctcaaggccaagacgggcctccccatccccctggtgcgcctaagggtggcggacgaggagggccgccccgtgcccaaggacgggaaggccctgggggaggtccagctcaaggggccctggatcaccgggggctactacaagaacgaggaggccacgcggagcgccctcaccccggacggcttcttccgcaccggggacatcgccgtctgggacgaggaggggtacattgagatcaaggaccggctcaaggacctgatcaagtcgggcggggagtggatctccagcgtggacctggagaacgccctcatgggccaccccaaggtgaaggaggcggcagtggtggccatcccccaccccaggtggcaggagaggcccctggcggtggtggtgcccaggggcgagaagcctgccccggaggagctgaacgcccacctcctaaaggccggcttcgccaagtggcagctccccgacgcctacgtcttcgtggaggagatcccgaggacatccgcgggcaagttcctcaagcgggccctaagggagcagtacaaggactactacggaggcgcctga

SEQ ID NO: 14123 - protein, 542 aa, Thermus thermophilus
MMEGERMNGFPSTMMEEELNLWDFLERAAALFGRKEVVSRLHTGEVHRTTYAEVYRRARRLMGGLRALGVGVGDRVATLGFNHFRHLEAYFAVPGMGSVLHTANPRLSPKEIAYILNHAEDKVLLFDPNLLPLVEAIRGELKTVRHLVVMDEKAPEGYLAYEEVLGEEVDPVRVPERAACGMAYTTGTTGLPKGVVYSHRALVLHSLAASLVDGTALSEKDVVLPVVPMFHVNAWCLPYAATLVGAKQVLPGPRLDPASLVELFDGEGVTFTAGVPTVWLALADHLESTGHRLKTLRRLVVGGSAAPRSLIERFERMGVEVRQGYGLTETSPVVVQNFIKSHLEALPEEEKLTLKAKTGLPIPLVRLRVADEEGRPVPKDGKALGEVQLKGPWITGGYYKNEEATRSALTPDGFFRTGDIAVWDEEGYIEIKDRLKDLIKSGGEWISSVDLENALMGHPKVKEAAVVAIPHPRWQERPLAVVVPRGEKPAPEELNAHLLKAGFAKWQLPDAYVFVEEIPRTSAGKFLKRALREQYKDYYGGA

SEQ ID NO: 14124 - DNA, 1935 bp, Thermus thermophilus
  CDS (1)..(1935)
atgaaggccttgaggccctcctacgagatgaagcgctacaccctgccccagctcctcaggctccgggcggagcacgagggggaccgggtggccctccgggagaaggactacggcatctggaacgagatcacctacgcccagtactacgagaacgtcctcctcttcgcccacggcctcctctccctgggctttgggccgggggagaggcttgccgtcatcgccgacaacattcccgagtggctctacgccgagctcggggcccaggcggtgcgggggatcagcgtgggggtctaccagagcagccttccccccgagatcgcctacatgctccagtacacgggggcgagcgtggtcctcgccgaggatcaggagcaggtggacaagctctacgagatccggagcgagatcccccacgtgcgctatgtgatctacgaggacgagaaggggatgcggggctacaaggacccctggctcctctccttcgccgaggtcctggagcgggggcgggagcaccggaggaagcacccggacgcggtggagaggctcctcctcgaggccagcccggaggaggtctgccacctttcctccacctcaggcaccacggggcgtcccaaggcggccatgctccgccaccgcaacctgatccacatgggggtggccctccaggaggtggaccccctcctgcccacggacgactacctttccttcctccccctcgcctggatcggggagcagatgatgtccgtggccatggccctcaccggggggttcgccgtcaacttccccgaggaggtggaaaccgccctgcaggacctcaaggagatcggcccccacgtgatgttcagccccccgagggtctgggaggggatccagagccaggtctgggtccgcatctcggaaagcccccggttcaaccgcttcgtctacgagcgcctcctcaaggtggggtaccgggcggcggagtaccggatgcggggtaggcccatgcccctggggcttcgcctcgcctactggcttgccgaccaggtcctcttcaagcccttgagggaccagctcggcttcctccgcctccgccgggcctacacggggggcgccgctttgggccccgacgtcttccgcttcttccacgccatcggggtcaacctcaagcaggtctacggccagacggagatcatcggcatcgccttcgtccaccgggacggggacgtgcgccacgacaccgtgggcctgcccatccccgggaccgaggtcaggatcagcgaggcgggggagatcctcctccgctccgacgcggtctgcgccgggtactgggaaaggcccgaggccacgcaggagaccttcggggacgggtggctgcacaccggggacgcggggtacctcacagaggacggccacctggtggtcattgaccgcctttccgacgtgatgcgcaccgagaaaggcacggtcttcagcccccagttcctggaaaacaagctgaagttttccccttacatcaaggaggccgtggtcttcggggaccggaagccctatctggccgccttcatcaacatagacccccagaccgtgggcaagtgggccgaggaccggggcctggcctacaccacctacctggacctctccctgaagcccgaggtggccgagctcatccgcaaggaggtggagaaggtgaacaaggagcttcccgaggagcttaggatccggcgcttcgtccttctctacaagctcctggacgccgacgacgaggagctcacccgaacgggcaaggtgcggcggggccacatcgccaaaaagtacgcccccctggtggaggccctctactccggggccaaggaggtggaggtggaggccgagtaccgttaccaggacggcaccctccagcgcctccgggcgcgggtgcccgtcctggggttcgccgaggaggtgcccgcgtga

SEQ ID NO: 14125 - protein, 644 aa, Thermus thermophilus
MKALRPSYEMKRYTLPQLLRLRAEHEGDRVALREKDYGIWNEITYAQYYENVLLFAHGLLSLGFGPGERLAVIADNIPEWLYAELGAQAVRGISVGVYQSSLPPEIAYMLQYTGASVVLAEDQEQVDKLYEIRSEIPHVRYVIYEDEKGMRGYKDPWLLSFAEVLERGREHRRKHPDAVERLLLEASPEEVCHLSSTSGTTGRPKAAMLRHRNLIHMGVALQEVDPLLPTDDYLSFLPLAWIGEQMMSVAMALTGGFAVNFPEEVETALQDLKEIGPHVMFSPPRVWEGIQSQVWVRISESPRFNRFVYERLLKVGYRAAEYRMRGRPMPLGLRLAYWLADQVLFKPLRDQLGFLRLRRAYTGGAALGPDVFRFFHAIGVNLKQVYGQTEIIGIAFVHRDGDVRHDTVGLPIPGTEVRISEAGEILLRSDAVCAGYWERPEATQETFGDGWLHTGDAGYLTEDGHLVVIDRLSDVMRTEKGTVFSPQFLENKLKFSPYIKEAVVFGDRKPYLAAFINIDPQTVGKWAEDRGLAYTTYLDLSLKPEVAELIRKEVEKVNKELPEELRIRRFVLLYKLLDADDEELTRTGKVRRGHIAKKYAPLVEALYSGAKEVEVEAEYRYQDGTLQRLRARVPVLGFAEEVPA

SEQ ID NO: 14126 - DNA, 1533 bp, Bacillus cereus
  CDS (1)..(1533)
atgaatctcgttcaatctttggctgaaacggcgaaaaagaagggggataaaccggcttatatatttatggatcagtcggtctcatatgaccaattaaacaaaatggtcacaaggttttctagcaatttagcagaaatgggcattggaaaaggggacaatgttgcattagttgttgggaattcaccacattttttggtcggtttatacggaacaatgaaagcgggagcaactgttattccagttaatccaatttatacagcagacgaaatgcattacattttacaaaatggagatgtaaaaacaatcatcgtactcgacgtccttctacctgttatacaatctcttacaacaagacttccttcattagaaaacatcatcatatgcgaaacctcatcagattttaaccatacagaaaccgaaaaaatgaaaacgtttactagaatgataggggctggagatttaacttacgaaggcccagagctagatgaagaagatgtagcggttattctatacacttcaggcacgactggaaaaccgaaaggcgctatgttaactcataaaaatttatatagtaatgcgagcgatgtggcgtcgtatttacaatatacggctgatgatcgcgtcgttgcggcactgccgatgttccacgtattttgtttaacggtggcggtaaatgcaccgattgtgaacggagcaacgattttaatgttaccgaaatttagcccgaaagaagtattccgtatttgtcgtacgtacgaaccgacgatttttgctggtgtaccgacgatgtacaattatttatatttattcgaagaagcgagcgcggaagatgtgaagacacttcgcctttgtatttcaggtggtgcttcaatgccagttgctcttctgcaaaactttgaaaaacgttttgacgttatcgtttcagaaggatacggtttatcagaagcatcaccagttacttgttttaatccgcttgatcgtccgcgtaaaccaggatcgatcggtacaaatatttggcatgtagaaaataaaattgtaaatgaacttggggaagaagtacctgttggagcagttggtgaattaattgttcgcggacctaacgttatgaagggatattataacgcgccagaagatacagctgcgacattaaaggacggctggttgtatacaggagacttagcgaagatggatgaagaaggttacttctatatcgttgatcgtaaaaaagatatcgtcctagttggcggttataacgtataccctcgtgaagtagaggaagtattgtatacacacgagtctgtagcagaagtggtcgtaatcggcgttcctgatgaaaacttaggagaagcagtgcgagcttacgtcgttctgaaacaaacgaacgtaacagaagaagaactgatgcattactgtgcgttacatttagcgaaatataaagtgccaaagagtattgaatttttaacagaattgccgaagaatacgacaggtaaattgctgagaagagctttgagagaaaaagcgatgcaagtttaa

SEQ ID NO: 14127 - protein, 510 aa, Bacillus cereus
MNLVQSLAETAKKKGDKPAYIFMDQSVSYDQLNKMVTRFSSNLAEMGIGKGDNVALVVGNSPHFLVGLYGTMKAGATVIPVNPIYTADEMHYILQNGDVKTIIVLDVLLPVIQSLTTRLPSLENIIICETSSDFNHTETEKMKTFTRMIGAGDLTYEGPELDEEDVAVILYTSGTTGKPKGAMLTHKNLYSNASDVASYLQYTADDRVVAALPMFHVFCLTVAVNAPIVNGATILMLPKFSPKEVFRICRTYEPTIFAGVPTMYNYLYLFEEASAEDVKTLRLCISGGASMPVALLQNFEKRFDVIVSEGYGLSEASPVTCFNPLDRPRKPGSIGTNIWHVENKIVNELGEEVPVGAVGELIVRGPNVMKGYYNAPEDTAATLKDGWLYTGDLAKMDEEGYFYIVDRKKDIVLVGGYNVYPREVEEVLYTHESVAEVVVIGVPDENLGEAVRAYVVLKQTNVTEEELMHYCALHLAKYKVPKSIEFLTELPKNTTGKLLRRALREKAMQV

SEQ ID NO: 14128 - DNA, 1656 bp, Treponema denticola
  CDS (1)..(1656)
atgcagacaatcaatgatctcggaaaatatacattttcagccttattaagaaattcggtcttaaaattttcaaatagaccggctctttcatatgtatctgaacaacccataagctacaaagaacttaacgaaaaggttgagtctataaaaaccttattacattcgctgggcataaagccgcttgataaggtagcaattttcagcacaagctcgccccagtgggcaatttcgtattttgcgatagtaacacttggagccattgccgtacctcttttacctgattttaatgaaagtgaagcttcttcttgtttaaagcattctggagcaagggccatatttgccggagaaaaacttttggcaaagttaaacaatacggatgaccttgatattataatcaatataaatgactttgctgtaaaaaagggagaaataaagacggataccccactgcctgtgcatgagtgcaaagaagaagatacagcttcaattatttatacatcgggtacaacgggccgttctaagggtgttgtccttacacataaaaaccttatctttacggccattgcaggtcagcactgtcaacgcataaaccaatacgaggcagccctttcaatattacccatgtcccatgtttatgagtttacaataggctttttaatgttcatgctgaacggagcctgtatctactaccttgaaggtccgcccattcctcgaaacctcctgccggctcttcaaaagataaggcctcattttatgttgagcgttccgattgtaatcgaaaaaatatataaacaaaaaattctgccggcctttaatgcaagtcctcttataaagaagatttacggaacaaaactcggaagaaaattattatgccgtaaggccggaaaaaagctaaaaaagaccttcggaggccgtcttaaatttttcggtataggaggatcaaaaaccgatcccgtcgttgagcaatttatggttgatgcaaaatttccctatgcaataggctacggtcttaccgaaacttctccattagttgcttattccgcagtgtacaaaaccgttcccggcgtaataggcggcaccattccgggtgtagaaataaaaataggggataaagaccctcaaacagggataggcgagctactggtaaaaggccccaatgtcatgcaaggttattataatgccccggacttaacaaaagaagcctttaccgaagacggctggttcaaaaccggcgacctatgcgtcatagataataagggaagaatcagcttaaagggaagatcaaagaatatgattttaggagccgccggcgaaaatatctatcccgaagatatagaatttgtcttaaaccagcatccccttgtatcggaatccttagttgttgaaggagaaaacacatccttagtcgcttatgtccgcttacaagatgccataggagatgccgtttcagaaatctctaatgccataatgcataagagagaagaagtgctaaacgaaataagattttttgtcaactcaaaggtcaacaagttttcgaagatagataaaattgaagttgtagaagagtttgaaaaaactgcaagccaaaagataaagcgctatctttattctctacgtcatagaaaactccaaacagaaggagtaaaagaaaaataa

SEQ ID NO: 14129 - protein, 551 aa, Treponema denticola
MQTINDLGKYTFSALLRNSVLKFSNRPALSYVSEQPISYKELNEKVESIKTLLHSLGIKPLDKVAIFSTSSPQWAISYFAIVTLGAIAVPLLPDFNESEASSCLKHSGARAIFAGEKLLAKLNNTDDLDIIININDFAVKKGEIKTDTPLPVHECKEEDTASIIYTSGTTGRSKGVVLTHKNLIFTAIAGQHCQRINQYEAALSILPMSHVYEFTIGFLMFMLNGACIYYLEGPPIPRNLLPALQKIRPHFMLSVPIVIEKIYKQKILPAFNASPLIKKIYGTKLGRKLLCRKAGKKLKKTFGGRLKFFGIGGSKTDPVVEQFMVDAKFPYAIGYGLTETSPLVAYSAVYKTVPGVIGGTIPGVEIKIGDKDPQTGIGELLVKGPNVMQGYYNAPDLTKEAFTEDGWFKTGDLCVIDNKGRISLKGRSKNMILGAAGENIYPEDIEFVLNQHPLVSESLVVEGENTSLVAYVRLQDAIGDAVSEISNAIMHKREEVLNEIRFFVNSKVNKFSKIDKIEVVEEFEKTASQKIKRYLYSLRHRKLQTEGVKEK

SEQ ID NO: 14130 - DNA, 1926 bp, Treponema denticola
  CDS (1)..(1926)
atgagaactctagacaaatcactaccgttattattaaaacggatttcggaaaaataccctagcataagagctcaaatgtttaagggagaagataaggaatttaaaagtctttcttacaaagagctttatgaaacggcgcttgattttgcggcaggcttgctttccataggggcaagacccaaagaccatataggtcttatagccgacaaccgcaaagaatggcttcatgcaagtttcggtattatgaatatcggggctgccgatgttccgcgcggctgcgatgctaccgagcaggaaattacccacattctttctttttcggagtgtaaatttgccgttttagaaaatgaagctcaaattcgaaaagtccttgtccatctggcagaaattcccctgctggagtctataatcagtattgataatgttgattttaaaaagcttgaagaagaattcaatctaaaagaaaggaaaatcgaattccatacatatgccgatattattgacttgggtaagtcggctaggattgaaggtaaatttaaacctgaagaatatgccgaaaatgtagataccgatgatttggcttcaataatttttacatcaggtactacgggcaatcctaagggtgttactatgacccatagaaactttatgactcagcttatggagcttccggataggattattcttaagcccggccaaaaagcaatttcggttcttccggtttggcattcctttgaaagggcttgcgaatatgttataatcatttcaggcggtactattgcttattcaaagccgataggaagcgttcttttagcagacatggtcaaaatcaatccgactctttttccctctgttccgcgaatttgggaggctgtttatgacggtatctttaaggctatgaaaaaaagagggcggcctctttactatcttttcttgttctttattgaagtcggaataaagacaatgcgtttaaagcgcagggtaaccggacaatgtcctcactttcagcgaaaaactaaggtaatctatccaatcttggccgtacttcctcttttgtgtatagctcctctttattacatcggagatcttcttatttaccgcgcgattcgtaaaaagttcggtaaatgttttagagcaggcgtttcaggaggaggggcattgcctcccaatgttgacgaatttttctgggctatccgtataaatgtaatggaaggttatggtattaccgagactgctcccgttatttcggttcgtccgatgcctaaacctgtgttcggaacactgggtaaaccgcttgcgtgttttgagtcaaaaatcatcgacaaaaacggaaaagaattgcctcataatcgaaaaggcttgctcctcgtgcgcggtgatgccgtaacaaagggttattataaggatccggaaagaactgcggaagttatcgataaggacggatggtttgatacgggtgaccttgcaataaagacagttgacggagaattaatccttaaaggccgcaaaaaaaatactatagttttaaggggcggcgaaaacatcgagcctgtaccgattgaggtaaaactgcaagagtctccattaatttcactagctgttgttttgggacaagaccaaaggtctttgggtgctttgatagttgttcataaagaaaacctccaatcatgggctgcaaataacggattacgaaatgtacctgttactgagcttatacatgactctaatgtacagaaaatgtatgaagctgaagttgcagagctggttaactcaaaaacaggatttaaactatttgaaaggataaataagattgttctgcttccggaagagtttcaggcaggaagggaattgtctgcaaaaggcgagatgatgcgtcataagataaatcagctttatcgcaacgaaatatacgagctctttaaataa

SEQ ID NO: 14131 - protein, 641 aa, Treponema denticola
MRTLDKSLPLLLKRISEKYPSIRAQMFKGEDKEFKSLSYKELYETALDFAAGLLSIGARPKDHIGLIADNRKEWLHASFGIMNIGAADVPRGCDATEQEITHILSFSECKFAVLENEAQIRKVLVHLAEIPLLESIISIDNVDFKKLEEEFNLKERKIEFHTYADIIDLGKSARIEGKFKPEEYAENVDTDDLASIIFTSGTTGNPKGVTMTHRNFMTQLMELPDRIILKPGQKAISVLPVWHSFERACEYVIIISGGTIAYSKPIGSVLLADMVKINPTLFPSVPRIWEAVYDGIFKAMKKRGRPLYYLFLFFIEVGIKTMRLKRRVTGQCPHFQRKTKVIYPILAVLPLLCIAPLYYIGDLLIYRAIRKKFGKCFRAGVSGGGALPPNVDEFFWAIRINVMEGYGITETAPVISVRPMPKPVFGTLGKPLACFESKIIDKNGKELPHNRKGLLLVRGDAVTKGYYKDPERTAEVIDKDGWFDTGDLAIKTVDGELILKGRKKNTIVLRGGENIEPVPIEVKLQESPLISLAVVLGQDQRSLGALIVVHKENLQSWAANNGLRNVPVTELIHDSNVQKMYEAEVAELVNSKTGFKLFERINKIVLLPEEFQAGRELSAKGEMMRHKINQLYRNEIYELFK

SEQ ID NO: 14132 - DNA, 1803 bp, Mycobacterium paratuberculosis
  CDS (1)..(1803)
atgcgtgagtacagcgtccccgcccgcttctccgtcggcgaaaacgagaacatcgcgacgatggtcttcgagcacgagcgcgacgatccgaacttcgtcatctaccaacgccaagtcgacggggagtggaccgacgtcacctgcgccgaagcggcggctcagatccgttcggccgcattgggtttgatttcactgggggtacaggccggcgaccgggtgtcgatcttctcggccacccgctacgaatgggcgatcctcgacctggcgatcttggcggtgggcgcggtcaccgtgccgatctacgagacgtcctcggccgagcaggtgcgctgggtgctgcaggactccgaggcggtgctggcgttcgccgagaccgacgagcacgcggcgatggtcaccgagctgaccgccgagctgcccgccctgcgccgggtgctgcacatcgacggctccggccccaaggccctcgacgtactggccgaggcgggcgcaggggtggagccggccgagctgaccgcgcgtctggacgggctgcgcgcccaggatccggccaccctgatctacacctcgggcaccaccgggcggcccaagggctgccagctgacccattccaacctgctctacgagacccgcggcgccaaggagagcctgccgacgctgctcgacgagggacagcggctgctgatctttttgccgctggcccacgtgctggcccgctcgctgaccctgtccgcgttcgccaacaaggtgaccgtgggattcaccagcgacatcaagaacctgctgccgatgttcgccgtgttcaagccgaccgtggtggtgtcggtgccgcgggtgttcgagaaggtttacaacaccgccgagcaaaacgccgccaacgacggcaagggccgcatcttcgcgatggccgtgcagaccgccgtcgactggagcgaggcggccgaccgcggccggcggggtccgctgctgcgggccaagcacgcgttgttcgaccggctggtgtaccacaagctgcgggcggcgctgggcggcgactgccacgcgtccgtgtcggggggcgcaccgctgggctcgcggctcgggcacttcttccgcggcgtgggcctgaccatccacgagggctacggcctgaccgagaccagctcggcgatcaccgtcaaccaggtcggcaacgtcaagatcggcaccgtgggaacgctgttgcccggcaacagcatgcgcatcgccgaggacggcgagctgttggtgcgcggcggcgtggtgttcaccggctactggcgcaacgaacaggccaccgccgacgccttcaccgacggctggttcaagaccggcgacctgggcgtcctcgacgaggacgggttcttgaagatcaccgggcgcaagaaggagctcatcgtcaccgcgggcggcaagaacgtcgcccccgccgtgctcgaggaccggctgcgggcgcacccgctgatcagtcaggcgatggtggtcggcgacaacaagccgttcatcggcgcgttgatcaccatcgaccccgaggctttcgacggctggaagcagcgcaaccacaagggcgccggggcgtcggtggccgatctgaccaccgaccccgatctggtcgccgaggtggacgccgccatcaaggacgccaatcaggctgtgtcgcatgccgaatcgatccgcaagttccgcatcctgccggtcgatttcaccgaggacaccggcgagctgaccccgacgatgaaggtcaagcgcaacgtggtggccgagaagttcgcctccgacctcgaggccatctacgccaaggactga

SEQ ID NO: 14133 - protein, 600 aa, Mycobacterium paratuberculosis
MREYSVPARFSVGENENIATMVFEHERDDPNFVIYQRQVDGEWTDVTCAEAAAQIRSAALGLISLGVQAGDRVSIFSATRYEWAILDLAILAVGAVTVPIYETSSAEQVRWVLQDSEAVLAFAETDEHAAMVTELTAELPALRRVLHIDGSGPKALDVLAEAGAGVEPAELTARLDGLRAQDPATLIYTSGTTGRPKGCQLTHSNLLYETRGAKESLPTLLDEGQRLLIFLPLAHVLARSLTLSAFANKVTVGFTSDIKNLLPMFAVFKPTVVVSVPRVFEKVYNTAEQNAANDGKGRIFAMAVQTAVDWSEAADRGRRGPLLRAKHALFDRLVYHKLRAALGGDCHASVSGGAPLGSRLGHFFRGVGLTIHEGYGLTETSSAITVNQVGNVKIGTVGTLLPGNSMRIAEDGELLVRGGVVFTGYWRNEQATADAFTDGWFKTGDLGVLDEDGFLKITGRKKELIVTAGGKNVAPAVLEDRLRAHPLISQAMVVGDNKPFIGALITIDPEAFDGWKQRNHKGAGASVADLTTDPDLVAEVDAAIKDANQAVSHAESIRKFRILPVDFTEDTGELTPTMKVKRNVVAEKFASDLEAIYAKD

SEQ ID NO: 14134 - DNA, 1821 bp, Mycobacterium paratuberculosis
  CDS (1)..(1821)
atgacccatgcaccggccagccggcccaccaccctgtgcgaagccttccaggcgaccgcagccaagcacccggacgcggtggcgctgcgcaccctcggcgatgccacgaccatcacctggcgtcagtaccgcgaccgggtgcgggcgatcgcggcggggctggccgggctcggcgtagggaacggcgacaccgttgcgctgatgatgagtaaccgccccgagttccatttgtgcgacaccgcggtcctgcacaccggtgccacaccgttttcggtgtacaacaccaatccacccgagctgctggcgtatcagttcgacaacgcagacaaccacgtggtgatctgcgaaggcactttcatgccgcaggttctcgccgcggcgcagcagggcggcactgtcgaacacgtcgtgtgcgtcgacggcgcggcgaacggtgccatcgggctcgatcaactcgaggcctcccccgcagccggtttcgacttcgagcggtcatggcgggcggtcgggccggacgacgtgctgaccatcgtctacacctcgggcaccaccggccctccgaaaggcgttgagctcacccacaccaacttcatcgagaacgcccggatcaccgaagaggtgggtgggatcacgcatgccgaccgggcggtgtcctatctgcccgatgcacacgccgccaaccgctggatcactcactatcaaaacctgctctacggcctgcagatcaccaccgtcggcgatttcaaggctgtgctgcccgcgttgaccgaggtgcggccgacgctcttccttggcgtgccgcgggtgtggatcaaggccaaggcgggtctggaagccgcggtagatgcggaacctgccggcaagcgagcgcttgccaaatgggcgttcggggtcggccgcgcgagggcccgggccgtgtcagatggccgcccggtcggacttgccgagaagcttcggtacgcgttcgccgaccggctggtgttgtcgaaggtgcgccggcggctgggcatggaccggctccggatcggcgtcaccggcgcggccccgatcccgcgggaggttcacgagttcgtcttgggcttgggcatcccggtatgcgaggggtacgggatgaccgaatgtacggccggtgcgaccgtgaatcgtccggaacggatcaagatcggaatggttggtaccccggttccggggaccgaggtaaccgttgcctccgacggggaggtgctggtgcggggcaagaacgtgatgcgcggctaccgcaaggcgcccgagaagaccgcggaggcaatcgattccgatgggtggctgcacaccggcgatatcggcgagatcgacgaagacggctacctgcgcatcgtcgaccgcaaaaaggaactcatcatcaacgccgccggcaagaacatgtcgccaaccaacatcgaaaacaccatcgccgccagctgcccgctggccggccccgtcgtggtgatcggcgatgctcgggcgtacaacaccgccctgatcaccctagatcccgactccgtcaccgaatatgcgcacgcgcacggtctttcgggttcgctccgcgaacttgtccgcaatccggcggtgcgcgccgaaatcgagaagggaatggcggccgccaatcgccggctgtcgcgggtcgaacagatcaagcgctacacggtgttggccgacgtctgggaacccggcagccaatacctcacaccgacggccaagctcaaacgtaaaccgatcgccaccggatacgccgcccagatcgacgcgatgtacaccgagcaaggcaagcgatccgcaggacattcagccgcatcggactga

SEQ ID NO: 14135 - protein, 606 aa, Mycobacterium paratuberculosis
MTHAPASRPTTLCEAFQATAAKHPDAVALRTLGDATTITWRQYRDRVRAIAAGLAGLGVGNGDTVALMMSNRPEFHLCDTAVLHTGATPFSVYNTNPPELLAYQFDNADNHVVICEGTFMPQVLAAAQQGGTVEHVVCVDGAANGAIGLDQLEASPAAGFDFERSWRAVGPDDVLTIVYTSGTTGPPKGVELTHTNFIENARITEEVGGITHADRAVSYLPDAHAANRWITHYQNLLYGLQITTVGDFKAVLPALTEVRPTLFLGVPRVWIKAKAGLEAAVDAEPAGKRALAKWAFGVGRARARAVSDGRPVGLAEKLRYAFADRLVLSKVRRRLGMDRLRIGVTGAAPIPREVHEFVLGLGIPVCEGYGMTECTAGATVNRPERIKIGMVGTPVPGTEVTVASDGEVLVRGKNVMRGYRKAPEKTAEAIDSDGWLHTGDIGEIDEDGYLRIVDRKKELIINAAGKNMSPTNIENTIAASCPLAGPVVVIGDARAYNTALITLDPDSVTEYAHAHGLSGSLRELVRNPAVRAEIEKGMAAANRRLSRVEQIKRYTVLADVWEPGSQYLTPTAKLKRKPIATGYAAQIDAMYTEQGKRSAGHSAASD

SEQ ID NO: 14136 - DNA, 1821 bp, Mycobacterium paratuberculosis
  CDS (1)..(1821)
atgacggcggaacgtccggccaccttgtgcgaggcattccagcgcaacgccgcgatcgacccggacgcggtcgtgctgcgcacccccggggctacccagacgttgacctggcgagagctcgccgagcaggtccgcaagttcgccgccgggctggcggggctgggcgtgcggcgcggcgacacggtgtcgctgatgatggccaaccggatcgagttctacccgctggagatcggcgcgcaacaccttggcgccacgtcgttttcggtgtacaacacgctgccggccgagcaactgacctacctgttcgacaacgccggcaccaaggtggcgatctgcgaacagcagtacgtcgaccgcatccgggccagcggcgcgcccgtcgaacacatcgtctgcatcgacggcgccccgccgggcaccatctccgtcgagcagctgtatgccgccgccccaagggatttcgacttcgagtcgacctggcggtcggtccggcccgacgacgtcgtcacgctcatctacacctcgggaaccaccggaaaccccaagggcgtggagatgacccacgccaacctgctgttcgagtgccacgcgctcaacgcggtgctgccgtcgaaattcggcgaccgggtcacgtcgtatctgccgtcggcgcacatcgccgaccgcgcgatggggctctacggcctggaggtgttcggcgcgcaggtgaccgtcgtcgacgacccgcgcgccatcgccgcggcgctgcccgacgtgcgacccacggtgtgggcggcggtgccgcggatatgggaaaagctcaaggccggaatcgaattcaccgtcgccaacgagcaggacgagtccacccgggcggcgctgcagtgggcgatgtcggtggccgcccaacgcgccgcggccttggtcgcgggcgagcagatacccgacgagctggccgccgaatgggcgcgggccgacgagttggtgctctcgaaactgcgtgaacggctgggcttcggcgaactgcgctgggcggtgtcgggggcggccccgattcccaaggagacgctggcgttcttcgccggcatcggcatcccgatcgccgaggtgtgggggatgtcggagctgagctgtgtggcggccgtcagccatccccgcgacgcgcgcctgggctcggtcggcaagttgctgcccgggctggagggcaagatcgccgacgacggcgagttcctggtgcgcggcccgctggtgatgaagggctaccgcaaggaaccggcgaagacggccgaggccatcgacgccgacggctggttgcacaccggcgacatcctggaggccgacgcgcagggctacctgcgggtggtggaccgcaagaaggagctgatcatcaacgcggccggaaagaacatgtcgccggccaacatcgagaacgccatcctggccgcctgcccgatgatcggcgtgatgatcaccatcggcgacgggcgtccgtacaacaccgcgctgctggttttcgacgccgactcggtgggcccgtacgccgcccggcacgggttgtccgacgcgtcgccggccgcgctggccgccgacccggacgtcatcgcccagatcgccgccggggtggcggcgggcaacgccaaactgtcgcgggtggaacagatcaaacggttccgcatcctgcccacgctgtgggagcccggcggcgacgagatcacgctgacgatgaagctcaagcgcaagccgatcatggcgaaatacgccgaggagatcgagcagctctacgccgatccacccccgcccgaggtgcacgagcccgccgccaccgcggtgcagcccgcatga

SEQ ID NO: 14137 - protein, 606 aa, Mycobacterium paratuberculosis
MTAERPATLCEAFQRNAAIDPDAVVLRTPGATQTLTWRELAEQVRKFAAGLAGLGVRRGDTVSLMMANRIEFYPLEIGAQHLGATSFSVYNTLPAEQLTYLFDNAGTKVAICEQQYVDRIRASGAPVEHIVCIDGAPPGTISVEQLYAAAPRDFDFESTWRSVRPDDVVTLIYTSGTTGNPKGVEMTHANLLFECHALNAVLPSKFGDRVTSYLPSAHIADRAMGLYGLEVFGAQVTVVDDPRAIAAALPDVRPTVWAAVPRIWEKLKAGIEFTVANEQDESTRAALQWAMSVAAQRAAALVAGEQIPDELAAEWARADELVLSKLRERLGFGELRWAVSGAAPIPKETLAFFAGIGIPIAEVWGMSELSCVAAVSHPRDARLGSVGKLLPGLEGKIADDGEFLVRGPLVMKGYRKEPAKTAEAIDADGWLHTGDILEADAQGYLRVVDRKKELIINAAGKNMSPANIENAILAACPMIGVMITIGDGRPYNTALLVFDADSVGPYAARHGLSDASPAALAADPDVIAQIAAGVAAGNAKLSRVEQIKRFRILPTLWEPGGDEITLTMKLKRKPIMAKYAEEIEQLYADPPPPEVHEPAATAVQPA

SEQ ID NO: 14138 - DNA, 3522 bp, Mycobacterium paratuberculosis
  CDS (1)..(3522)
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccatcacgtacagcgaagtagcgcagcgtgtttcggcgctgggccgcgccctgtccgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccagcaccggcgtggccgtccagacgctggccgagctgctggagcgcggcaaggacctgcccgccgtcgcggagccgcccgccgacgaggactcgctggccctgctgatctacacctccgggtccaccggcgcccccaagggcgcgatgtacccacagagcaacgtcggcaagatgtggcgccgcggcagcaagaactggttcggcgagagcgccgcgtcgatcaccctgaacttcatgccgatgagccacgtgatgggccgaagcatcctctacggcacgctgggcaacggcggcaccgcctacttcgccgcccgcagcgacctgtccaccctgcttgaggacctcgagctggtgcggcccaccgagctcaacttcgtcccgcggatctgggagacgctgtacggcgaattccagcgtcaggtcgagcggcggctctccgaggccggggacgccggcgaacgtcgcgccgtcgaggccgaggtgctggccgagcagcgccagtacctgctgggcgggcggttcaccttcgcgatgacgggctcggcgcccatctcgccggagctgcgcaactgggtcgagtcgctgctcgaaatgcacctgatggacggctacggctccaccgaggccggaatggtgttgttcgacggggagattcagcgcccgccggtgatcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccaacgagctggccgagctgcgccgcaacggtgcccaggcgccggtgttgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtaggcgtgatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgagacgctggccgccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaaactgctcgcgcactaccagcagctggccgccgatcacctggaggtcatcgccggcgacaagggcgaggccaatctgggcctgggccaagacgtttggcaacgactggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctatggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcgtcggtctggacgagtacgtcgattggctggtggacgccggctattcgatcgagcggatcgccgactactccgaatggctgcggcggttcgagacctcgctgcgggccctgccggaccggcagcgccagtactcgctgctgccgctgctgcacaactaccgcacgccggagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctga

SEQ ID NO: 14139 - protein, 1173 aa, Mycobacterium paratuberculosis
MSTATHDERLDRRVHELIATDPQFAAAQPDPAITAALEQPGLRLPQIIRTVLDGYADRPALGQRVVEFVTDAKTGRTSAQLLPRFETITYSEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGVGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 14140 - DNA, 1659 bp, Geobacter sulfurreducens
  CDS (1)..(1659)
atggcacaaccgcttgaatttacggtaggaggattgcttgaccacattgcggcccgctatcccgacaatgacgctctcgtctatgttgatcgcggcctccgttactcctatcgccagttcaacgaagtctgccgcgaggtggccaaggggctgctgcggctcggcgtcaagaagggcgatcatgtttccatctgggcctacaatgtccccgaatgggtgatccttcagttcgccacggccaaaatcggcgctgtgctcgtaacggtcaacaccaactacaaatcggcggagctggagtatatcctcaaccaatccgactcttcgacgctcttccttgtgaaatcgttcaaggataccgattatgtggccaccgtgaacgaggtcgtgcccgagctggccgggtcggaagccggcgccctttccagtccgaaactccctttcctcaggaatgtcgtcttcatcggcagcgagacgccggctggcatgctcaatttcgaggcaattgccgccatgggtcaggatgtctccgatgccgaactggcggctgttgaggcaaccctcgatcgccacgacgtcatcaatatgcagtacacctcgggcaccaccggctttcccaagggggtcatgctgacccacttcaacatcatcaacaacggcttcaacatcggtgaatgcatgaagttcaccgagaaggaccggctctgcatcccggtcccctttttccactgcttcggctgcgtgctcggcgtcatggcctgcgtcacccacggcacgaccatggtgccggtggagattttcgaccccctctcggtgctgcgcaccatcgaaaaggagcgctgcactgcggttcacggcgttcccaccatgtttatcgcggagctggagcacccggactttccgaagttcgatctcacgagtctccgcaccgggatcatggccggctccaactgccccatcgaggtaatgaaaaaggtcatcagccagatgaacgccagcgaaatcaccatcgcctacggccagaccgagtcgtcgcccgtgatcacccagacccgcaccgacgatgccatcgagctccgggtggccacggtcggccgggcgcttcccgacgtggaggtcaagatcgtcgatatcgaaaccggtgccgaactgccgccgggcaagcagggcgagctgtgcacccgcggatacctggtcatgaaggggtactataaaatgcccgaggagactgcgcgggcaatcgatgccgacggctggctccacacgggtgacctggccgtcatggatgagaacggctactgcaagatcaccggtcggatcaagaatatgatcattcgaggcggtgagaatatctatcctcgcgagatagaggagtttctctatacccacccgaaaatatcagatgttcagatctatggcgtccccgaccgcaagtacggggagcaggtcatggccgcggtcattctcaagaagggcgacaccatgaccgaagaggatgtgcgtgatttctgcaggggcaagatcgccaactacaagattcccaagtacgttaaattcgtcgattcctaccccatgaccgcctctggcaagatccagaagttcaagctgcgggaaatggccatcaaggagctcggcctcgaagggccgggggaaaccgcttga

SEQ ID NO: 14141 - protein, 552 aa, Geobacter sulfurreducens
MAQPLEFTVGGLLDHIAARYPDNDALVYVDRGLRYSYRQFNEVCREVAKGLLRLGVKKGDHVSIWAYNVPEWVILQFATAKIGAVLVTVNTNYKSAELEYILNQSDSSTLFLVKSFKDTDYVATVNEVVPELAGSEAGALSSPKLPFLRNVVFIGSETPAGMLNFEAIAAMGQDVSDAELAAVEATLDRHDVINMQYTSGTTGFPKGVMLTHFNIINNGFNIGECMKFTEKDRLCIPVPFFHCFGCVLGVMACVTHGTTMVPVEIFDPLSVLRTIEKERCTAVHGVPTMFIAELEHPDFPKFDLTSLRTGIMAGSNCPIEVMKKVISQMNASEITIAYGQTESSPVITQTRTDDAIELRVATVGRALPDVEVKIVDIETGAELPPGKQGELCTRGYLVMKGYYKMPEETARAIDADGWLHTGDLAVMDENGYCKITGRIKNMIIRGGENIYPREIEEFLYTHPKISDVQIYGVPDRKYGEQVMAAVILKKGDTMTEEDVRDFCRGKIANYKIPKYVKFVDSYPMTASGKIQKFKLREMAIKELGLEGPGETA

SEQ ID NO: 14142 - DNA, 2253 bp, Ashbya gossypii
  CDS (1)..(2253)
atgagcaacgagacagaagttaacaggtatcccgggatgggccccatctcactggtggaggtgatccggaccgacgcgaggtttgcggagttgtggaagcgactatcgctgttccagcagggcagcgtcgagttctacaaggagctgtacgacaacatgccgctgttcgctgggatggacggcatggcgctgtccgcgcctgtgccggggtccgggaagaagggctacagtcctgtgttccgcaatgtgcttgtgccggagggcaagctgctgtccgcaattgacgagggtgtggacacggggtatcacgtgttcaagctgtctgcgcgcatgtaccccgacaaccactgtctggggatgcgggcgtacgacgaggcaacgggcaaatggctggacgaataccgctgggagacttacagccaggtggagcgccgcgcggagaacctgggcgcggggctgttgtcggttgtgaatgtcaagcgcagcaagccactggacacaaatgacttcattgtggcgatgatgtctgcgaacagcaaggagtgggttctgaccgacctggcatgccagacgttctcgctggtcaacacggcgctgtacgagacgctggggcccaacacgtccgaatacattatgaacctgactgagtcacctgtagtcgtggtttcgaagcccaacctgctcaggatcttcgcgctggcctcgaagttgcgcgcgctcaacacgatcgtgataatggacgatatggacctccaggaggtggaccgtctcgcctcgttgcttcccgtcaccaagaacgcgaagggcgaaacgatttccgtactgactttgcggcaggtggagaaaattggcgagttgaacaacattgcgccgatcccgcccagcccagattccttccacactatctcgtttacctctggtacaacctctttgccgaagggtgttcagctaacgcaccgcgcttactgtgctgcgcttgcctttgcctgctcacatgtgcgttgtgagcccaacaagcagaggtacgctttatgtctcttgccattgactcatatttaccagcgccaaatgactggactcaatctcatgcacgctttcgggattgggtttttgcataaacctaaccctgatctctttatagaggccatgtgtgtgcttcggcccgcgatggtttccttagttcctagagtgttgactaaattggaggcagggattaagaactctatccagggtgcggacgtctcgacgtttaagcgtaagcttgctaagacggtcatagacgccaaggacaaacgcttcagtgccgttagcggccccgacgactcttacatgaacaggtttatctaccgtaagatatttgtggacaagattcgtgataagctgggcttcaccaacgtacctctggtcaccaccgggtctgcgcctatatcaccggagaccttgaggtttattcaatgtgccatggacataggtattctgcaaggttatggattaaccgagacattcggcggtaacttcctcagtgtcccatacgagactgactgtggttcatgcggtccgccagcgatgaccactgaagtcagattgcgcgatgtgccaggtatgtcgtacaacgccgagaaggaccacatgggcgaggtcgttgtcagaagtcagcaacaatttgagaggtactacaaaatgccagagaagacggccgaagttctcgataaagatggctggttttccacaggtgatgtcggttacattgacaagaagggtagactcttcatcacagatagagtgaagaacattttcaaattatcgcagggtgaatacattgctccagagaaggtagaaaactgctacttatcttcctgtccattcatcacccagatatttgtacacggaaactccctcaacaactacttggttggggtcgtgggtatcgacgtggttccttttaaggccatcctcgacagtcgtacttcaaagtggtccaagctgcctcttgaggaggtaatccctaccatcaacaaggatccggctttgaagcagttgacactgaaaattattaacagctttgttactgctgagctacaaggatttgagaagattggaaacctctacgccgatgttgagccgctctccgtagatggtgaaaccctgacgccaacctttaaggtcaaacgtgaagtttgcaccaaggtcttcaaggatatcctttccagcttgtacgatgaaggacatatcttgaaggcagggaagctctga

SEQ ID NO: 14143 - protein, 750 aa, Ashbya gossypii
MSNETEVNRYPGMGPISLVEVIRTDARFAELWKRLSLFQQGSVEFYKELYDNMPLFAGMDGMALSAPVPGSGKKGYSPVFRNVLVPEGKLLSAIDEGVDTGYHVFKLSARMYPDNHCLGMRAYDEATGKWLDEYRWETYSQVERRAENLGAGLLSVVNVKRSKPLDTNDFIVAMMSANSKEWVLTDLACQTFSLVNTALYETLGPNTSEYIMNLTESPVVVVSKPNLLRIFALASKLRALNTIVIMDDMDLQEVDRLASLLPVTKNAKGETISVLTLRQVEKIGELNNIAPIPPSPDSFHTISFTSGTTSLPKGVQLTHRAYCAALAFACSHVRCEPNKQRYALCLLPLTHIYQRQMTGLNLMHAFGIGFLHKPNPDLFIEAMCVLRPAMVSLVPRVLTKLEAGIKNSIQGADVSTFKRKLAKTVIDAKDKRFSAVSGPDDSYMNRFIYRKIFVDKIRDKLGFTNVPLVTTGSAPISPETLRFIQCAMDIGILQGYGLTETFGGNFLSVPYETDCGSCGPPAMTTEVRLRDVPGMSYNAEKDHMGEVVVRSQQQFERYYKMPEKTAEVLDKDGWFSTGDVGYIDKKGRLFITDRVKNIFKLSQGEYIAPEKVENCYLSSCPFITQIFVHGNSLNNYLVGVVGIDVVPFKAILDSRTSKWSKLPLEEVIPTINKDPALKQLTLKIINSFVTAELQGFEKIGNLYADVEPLSVDGETLTPTFKVKREVCTKVFKDILSSLYDEGHILKAGKL

SEQ ID NO: 14144 - DNA, 2094 bp, Ashbya gossypii
  CDS (1)..(2094)
atgaagtcggccagtgttatagtaggagagcccgcagggcctcacgagacggcgccacggcgcaactccaagtgcccggatgcggtcgtggagcggccgctggggttcagctgcaacacggtatatgagtttgcgttggaggcgatggagcgcggcgggcggcagcgcgcgatggggtggcgggagacggtggagatccacgaggaccgcaagatggtgacgaaggtggtggacggcaaggagacggaggtggagaagacgtggttgtactacgagatgggcccgtaccagtacgtgacgtacgaccagctgcacgtggagatgcacgactacgggcgggggatggtgaagatggggctccagccgggcggcgaggaccgcttgcacattttcggcgcgacgtcgcaccggtggatgcggacgttcttggcagcgcagtcgcaggccatcacggtggtgacggcatacgacacgttgggcgagagcggcttgatctactcgctccagcagacggggtcgaaggcgatcttcgtggacaacaacctcttggagaagttggtgaagccggtgcaggagatcccggacttgaagtacgtgatccacgcggacccgctcgacccggaggacaagcgctacggcggccggatgtactctgacgcgcagaaggcgatcgaccgcatgaaggaggttcggccggacatcgaggtttacagcatggacgaggtcgtggagctcggatcgctctgccgggactcgatttttgtgcaccggccacgcaagaaggaccttgcgtgcatcatgtacacctcgggctcgacaggtgacccgaagggtgtgtcgttgacccacgctaacatcgtggcgggcattggcggtgtttccgttgtgatcaaccgcgcgattgtgaagcctgacgatcgtgtcatcgcgttcttgccgcttgcgcatatttttgagcttgtgttcgagttgacctgtctctactggggcgccttaattggctacggctccgtcaagacgttgagcgaggcttcggtccgcaactgtaagggcgacatgaaggagttccggccgtccgtcatggtcggtgtcgcagctgtctgggagggtgtcaggaaggctattgttgcgcaggtcactaagttgcctccgttcaagcaaaagatattctgggcggcctaccacaccaagctacgcatgaagaagtgccacattccaggcggcgatctaataggaagcatgatctttaagaaggtgcgtgagaccactggtggcaaccttcgctacatcttgaatggtggctctccattgtcgcgggatacgcaagtttttatttccaacttgatttgccccgtgttgattggttacggcttaacggagactgtggcgaatggctgtatagtgcctccacaccacttcaagtacggggttgtgggagacattcttggttctctaacggtcaaattggtcgatgtcgaggagctcggctatcttgccaagaacaaccagggtgagctctgggtcaagggccccgccgtgtttaaagactacttgcagaacgaggccgagaccgctgccgctttggaagacgggtggttcaagactggtgacattgccgaatggacgaagaagggtcaattgcgtttgatcgaccgtaagaagaaccttgtcaagacgttgaatggtgaatacatcgctttggagaagttggagtgcatctacagatccaacaagtatgtggccaacatctgtgtctatgctgaccagaccaaggtcaagccaattgcgattgtggttccaaacgtcaatgctgtcaccgatttggccatctcattggggttgatcaaggacggttgcgaggtacgtgatgtttatgatagcaaaaagttgaagaaggtgatcttggacgacatgcataaaactgccaagggccagggattgggtggtattgagttgattcttgggttcgtgatcttcgatgatgagtggaccccacagaatggctatgtcacctctgcgcagaagctacagagaagaaagatcttgtctgcagtgcagtcagaagttgacgcactatatgccgcgaactcttaa

SEQ ID NO: 14145 - protein, 697 aa, Ashbya gossypii
MKSASVIVGEPAGPHETAPRRNSKCPDAVVERPLGFSCNTVYEFALEAMERGGRQRAMGWRETVEIHEDRKMVTKVVDGKETEVEKTWLYYEMGPYQYVTYDQLHVEMHDYGRGMVKMGLQPGGEDRLHIFGATSHRWMRTFLAAQSQAITVVTAYDTLGESGLIYSLQQTGSKAIFVDNNLLEKLVKPVQEIPDLKYVIHADPLDPEDKRYGGRMYSDAQKAIDRMKEVRPDIEVYSMDEVVELGSLCRDSIFVHRPRKKDLACIMYTSGSTGDPKGVSLTHANIVAGIGGVSVVINRAIVKPDDRVIAFLPLAHIFELVFELTCLYWGALIGYGSVKTLSEASVRNCKGDMKEFRPSVMVGVAAVWEGVRKAIVAQVTKLPPFKQKIFWAAYHTKLRMKKCHIPGGDLIGSMIFKKVRETTGGNLRYILNGGSPLSRDTQVFISNLICPVLIGYGLTETVANGCIVPPHHFKYGVVGDILGSLTVKLVDVEELGYLAKNNQGELWVKGPAVFKDYLQNEAETAAALEDGWFKTGDIAEWTKKGQLRLIDRKKNLVKTLNGEYIALEKLECIYRSNKYVANICVYADQTKVKPIAIVVPNVNAVTDLAISLGLIKDGCEVRDVYDSKKLKKVILDDMHKTAKGQGLGGIELILGFVIFDDEWTPQNGYVTSAQKLQRRKILSAVQSEVDALYAANS

SEQ ID NO: 14146 - DNA, 2714 bp, Oryza sativa
  CDS (189)..(2441)
aggcccgagaccagacaacccacctcacctcacctctccacccatctcggcgtcgtcgtcgtcatctccgccgctccaccaatcccccttccgctagtgtgctacacatcactgctgctcccctccaccccaaccccaccacgtcagtggagacccccccgatcgccgccacctcgccgcgcccggcgatgctcgcctcctccgcctccggccaaatggcggcgctctgctccccctcgccgacgctccccaccgcctccctcctcctcctgcgtcgccgccgcctccgcctcctccacccaccgccttccgccgccgcgctgctgctcctcctccccgcccgccgccggggccgccaccaccaccgccgaggtggggtcctccggtgcgacgccgccgcggcgtccccctccgcgggttccacgctagaaaacccagttcgcagaaagtgctcaccattacttgagagtgctctattacctggtggaaatggtttgactacgcatgattggatggctgttccagacatttggaggacagcagcagaaaaatatgctgaccgtgtagctttggtagatccttaccatgaacctccttcagaattgacttataagcagcttgaacaagaaatattggatttttctcaaggtctaagggccattggagttgctccagatgaaaagatagccctttttgctgataactcatgccgatggctagttgcagatcaaggaatcatggctactggtgctataaatgttgttagaggaacaagatcttctgatgaagaattatttcaaatttacactcattcagaaagcattgcacttgttgtggacagtcctcaattctttaaccggcttgcagaatcttttatttcgaggattaacgcaagatttattgtgctactttggggtgagaaatcgtgcctaaacagtgaagttgtgaatggaataccactttatgacttcaaggatatcactcaactcggacgagaaagccgtaatacattgcgtcactctcatgaacaaggtcagcaggtcgtctttgaaactattactccagatgatgttgctacactaatatataccagtggaacgagtggaacaccaaaaggagtgatgcttacccaccgaaacctcttgcatcagattaaaaatttgtgggattttgtaccagcagtacctggtgataggttcctaagcatgcttccaccatggcatgcatatgagcgtgctagcgagtacttcatcttcacttatggaattcaacaagtttacacgactgtcaagtacctgaaggaagatttgcaacgataccaacctcaatacatagtatcagttccactggtctatgagattctctacagctcaattcagagacagatatcttccagttcaactgctcggaaatttgttgctcttgcacttattaagataagtttgctatatatggaggcaaagaggatatacgagggaacagtcctatcgaacaatcccgtcaaaccatcctttattgtgtatatggtcaattggctatctgcaagaattgttgctgcacttctgtggcctttgcataatctggcaaagacgttagtctacaagaaaatccattctgcaattgggatttcaaaggctggcattagtggtggtggaagtctcccgatgcatgttgacaaattttttgaggccatcggtgtcaaagtgcaaaatggctatggtctaacagagacatcccctgttgtagctgctagacggccattctgtaacgttcttggcacagttggccacccagtaaagcacacggaaatcaaggttgtggatatggagactggtgaggttcttccagatggttcaaagggggttgtgaaagtcagaggaccccaagtgatgaagggatattacaagaatccgtcagctacaaataaagttttggatcaagaaggttggtttgacacaggggatattggttggattgcacctcactgtccaacagggccaagtcggaagtgtggagggatgcttgttcttgaagggcgtgcaaaagatacaatagttctcacaacaggtgaaaatgttgaacctgctgagattgaggaagcagccagcaggagtgacttgattaatcagatagttgttgttggccaggacaagcggcgaattggtgctcttatcgttcccaactatgatgaagttctagcaacagctaaaaggaagtccattcttgatgggaataacgaactagccaaagataaggttttgaacttgctatatgatgagctgagaacttggatggtggattgttccttccaaattggcccgattctaattgtcgatgaaccatttacggtggataatggtttgctaacacccactttgaaattacggagggacaaagtgactgccaaatatcatagagagattgatgcgttgtacaagtgatgtggagtgagcatgagtacatacagacagtagtttgcattttctttgccttggaagacatctcttgagtagacagtagctagaacatacaataatgcaaccattttaaaatttttttggagtgaaatggaataaggttgctgattcagtatgtataagcattatttctcctccatatcgatgtgatctcaccacaatatatgcatcgggagggacaatttgtggacgatgcactgtgttactgtgactgaatttcgtagaaccgaatttact

SEQ ID NO: 14147 - protein, 750 aa, Oryza sativa
MLASSASGQMAALCSPSPTLPTASLLLLRRRRLRLLHPPPSAAALLLLLPARRRGRHHHRRGGVLRCDAAAASPSAGSTLENPVRRKCSPLLESALLPGGNGLTTHDWMAVPDIWRTAAEKYADRVALVDPYHEPPSELTYKQLEQEILDFSQGLRAIGVAPDEKIALFADNSCRWLVADQGIMATGAINVVRGTRSSDEELFQIYTHSESIALVVDSPQFFNRLAESFISRINARFIVLLWGEKSCLNSEVVNGIPLYDFKDITQLGRESRNTLRHSHEQGQQVVFETITPDDVATLIYTSGTSGTPKGVMLTHRNLLHQIKNLWDFVPAVPGDRFLSMLPPWHAYERASEYFIFTYGIQQVYTTVKYLKEDLQRYQPQYIVSVPLVYEILYSSIQRQISSSSTARKFVALALIKISLLYMEAKRIYEGTVLSNNPVKPSFIVYMVNWLSARIVAALLWPLHNLAKTLVYKKIHSAIGISKAGISGGGSLPMHVDKFFEAIGVKVQNGYGLTETSPVVAARRPFCNVLGTVGHPVKHTEIKVVDMETGEVLPDGSKGVVKVRGPQVMKGYYKNPSATNKVLDQEGWFDTGDIGWIAPHCPTGPSRKCGGMLVLEGRAKDTIVLTTGENVEPAEIEEAASRSDLINQIVVVGQDKRRIGALIVPNYDEVLATAKRKSILDGNNELAKDKVLNLLYDELRTWMVDCSFQIGPILIVDEPFTVDNGLLTPTLKLRRDKVTAKYHREIDALYK

SEQ ID NO: 14148 - DNA, 1674 bp, Porphyromonas gingivalis W83
  CDS (1)..(1674)
atgatcgaacagaatttcatccgactttatcaagatagctttcgggagcattgggcactcccggcactcactaactacgacacgaaagagagctacacctacggagagatggctgccgatattgctcgccgacatttgctcttcgagcgcatcggacttaagccgggagacaaggtggcactgctcggcaaagactctgccgaatggtgtatggctttcatgtccgtcatcacgtatggagccatcatcgttcctgtcttacccgatttcaatgcagccgatgcagcaagtatagtgacgcattccgatgccaagtatctcttcgtatcggacaaaatatgggagacgatggatccgtctcagctccttctcctgtgcggagccgtctctatccgtgattatacggtcttcctggatcgtacggagggtggcttgctcagccaggaagtagaaggattgagtcgctctttctccgaacactacccttccggcttcacggcagaggatattcgctatgccgaggtgtcgaacgacgatctcatcctgctgaactatacctccggtacgaccggattcagtaagggggttatgcttcgtgccaacaatctggccggcaatgtaacctacgttaaggatagagacattatgttccgaggcgagacgatcctttgcttccttccattggcccatacttatagctgtgcgttcaacttccttacgccattgactataggtgtgcatgtgtatatcttgggcaaaatcccctctcctctcactctgatcaaagcctttgcagatgtacgcccctcatttgtcatcatggtgcctctcatcatagagaaattgtatcacaaggcaatagctccgaaaatcaagacaccgttaatcaaattcctgctaagacttcctgtgctgaaaaaggtgatacacaaatcgatccggagcaagctgatcgaatccttcggaggtaatttccgacaaatcatcattggaggagctgctctcaacgatgaagtagctcatttcctctatcggataggatttccgctgaccgtcggttacggcatgacggagtgcggccccctcattagctatgaggatcacagcctgtggctacccggcagctgtggcaaatcgctctctattatggaggtacgaatcgatcattcgggacaggaaaggcatagcgacagcggcgatgtgggagagattcaggttcgtggggagaacgtctgtctcggctattataagaatgccgaactgacagccgagctttttactcccgatgggtggatgcgtacaggtgatcttggcaccatagatagcttgggaaatatctttatcaaagggcggtccaagaccatgctcctcggatcaaacggacagaatatctatcccgaagaaatagaatcgaagatcaacaatctatcctatgtcctcgaaagtatcgtcacagagcgagacggacgcttgatcgcactaatcgtgccggacagacaggcgatagagcataaagggatctctccggatcaggcatgggcttatatcgaaaggagccgagccgaactgaacgggcaagtgggtgcatacgagaaaataacggcctttgtccgccatgacgaagagttcgagaagacacccaaacacagcatcaaacgtttcctctatacttga

SEQ ID NO: 14149 - protein, 557 aa, Porphyromonas gingivalis W83
MIEQNFIRLYQDSFREHWALPALTNYDTKESYTYGEMAADIARRHLLFERIGLKPGDKVALLGKDSAEWCMAFMSVITYGAIIVPVLPDFNAADAASIVTHSDAKYLFVSDKIWETMDPSQLLLLCGAVSIRDYTVFLDRTEGGLLSQEVEGLSRSFSEHYPSGFTAEDIRYAEVSNDDLILLNYTSGTTGFSKGVMLRANNLAGNVTYVKDRDIMFRGETILCFLPLAHTYSCAFNFLTPLTIGVHVYILGKIPSPLTLIKAFADVRPSFVIMVPLIIEKLYHKAIAPKIKTPLIKFLLRLPVLKKVIHKSIRSKLIESFGGNFRQIIIGGAALNDEVAHFLYRIGFPLTVGYGMTECGPLISYEDHSLWLPGSCGKSLSIMEVRIDHSGQERHSDSGDVGEIQVRGENVCLGYYKNAELTAELFTPDGWMRTGDLGTIDSLGNIFIKGRSKTMLLGSNGQNIYPEEIESKINNLSYVLESIVTERDGRLIALIVPDRQAIEHKGISPDQAWAYIERSRAELNGQVGAYEKITAFVRHDEEFEKTPKHSIKRFLYT

SEQ ID NO: 14150 - DNA, 1803 bp, Photorhabdus luminescens subsp
  CDS (1)..(1803)
atgataactaaaaatttacatccttatcacttgataaaccggttgcaacaacaaataaaacaacacccagagaaaattgcttttcgccaatggtctccggctgaacaactcgaactaaactggcatgatattggcaaaaagaccgacgctattagccgggcgttgttggagattggtgttgatgtgcaagaaaaaattggcctctttgcacataacagcatggcgtggtcattggcagatatcgctgtattacaacttcgggcggtcactgtccctctgtatgcaaccagtagtcaggaacaggctggtttcatacttaatgatgctggtgtgcgtattttgtttgttggtgggcaggcgcagtatgatgttgctattacgttgacagaatgttgccctcagttaagtcacattattgtcttagatgaatcagtcgatttgcgggattgttcattagctcagcatttatctgatttcatggtcgataatgaattaccctgtcagtccgagttggaaactcgtattgctaaccacaatctggatgatctttttacacttatttatacgtctggtaccacgggtgagcctaaaggcgtcatgcttgattaccgcaatttagcctatcagttgtattcacatgatcatatcctggcattaactgatcaggacatttctttgagttttctgccgttatcccatgtctttgagcgtgcatggagtttctatgtcatgcatgtaggggcacaaaatgtttatctgactgacactaattttgttcgtcaagctatggcggatgtctgcccgacagtgatgtgtgcagtgccgagattttacgaaaaaatttatagtgcggtttttgaaaaggtttctaaggctccttggcatcgaagaaaactttttaattgggcgattaaatgtggtgagcgtcagtttttacgtaagttgcagagtaaaaaaagctgcccttggtcaacagcaatgcatcgactggctgataaattggtgttgagcaaattacggaatgtgttggggggcagagttcggtttttacctgctgctggtgcacgtctggacgaaacgattatcctgttctttctcgctgttgggataaatatcaaatatggctatggcatgacagagacttgtgccacggtttcctgttgggaagagcaaggttatgtacttggttctattggtaaaccatcgcctggcattgacgtccgtatcggtgaagaagatgagatacaagtgcgtggcccaattgtgatgaaaggctatttcaataatcagcaagaaaccaccaaggcatttactcaagacggttggttgcgtacaggtgatgccggtaagttggatgaaaatggtaatttgttcattactgaacgcctgaaagatttgatgaaaacatcgaatggcaaatatattgcccctcaaatgattgaaggcattttgggacaagatcgttttattgaacatgttgctattattgctgatgctcgtaaatttgtatcggctcttatcgtgccttgtcatgaagcattggaagagtatgcaaggtcaattaatctcaaatatcatgaccgggttgaattactgcgtcatagtcagattatcaatatgtttgagcaacgcttgaaagaaatgcagaaaaactttgctcacttcgatcaggtaaagcgtttcatattactgccaaaaccattttcaatggaaacgggtgaattaactccaacactgaaattgaggaggaaaattattatgcagcgttactatgaagaaattgaatctatgtatcaggattga

SEQ ID NO: 14151 - protein, 600 aa, Photorhabdus luminescens subsp
MITKNLHPYHLINRLQQQIKQHPEKIAFRQWSPAEQLELNWHDIGKKTDAISRALLEIGVDVQEKIGLFAHNSMAWSLADIAVLQLRAVTVPLYATSSQEQAGFILNDAGVRILFVGGQAQYDVAITLTECCPQLSHIIVLDESVDLRDCSLAQHLSDFMVDNELPCQSELETRIANHNLDDLFTLIYTSGTTGEPKGVMLDYRNLAYQLYSHDHILALTDQDISLSFLPLSHVFERAWSFYVMHVGAQNVYLTDTNFVRQAMADVCPTVMCAVPRFYEKIYSAVFEKVSKAPWHRRKLFNWAIKCGERQFLRKLQSKKSCPWSTAMHRLADKLVLSKLRNVLGGRVRFLPAAGARLDETIILFFLAVGINIKYGYGMTETCATVSCWEEQGYVLGSIGKPSPGIDVRIGEEDEIQVRGPIVMKGYFNNQQETTKAFTQDGWLRTGDAGKLDENGNLFITERLKDLMKTSNGKYIAPQMIEGILGQDRFIEHVAIIADARKFVSALIVPCHEALEEYARSINLKYHDRVELLRHSQIINMFEQRLKEMQKNFAHFDQVKRFILLPKPFSMETGELTPTLKLRRKIIMQRYYEEIESMYQD

SEQ ID NO: 14152 - DNA, 1683 bp, Photorhabdus luminescens subsp
  CDS (1)..(1683)
atggagaaagtctggctaaaacattatccggcggatgttcctgcggagattgacccggatcgttatgcatcattggttgagatgtttgaaaatgccgtagcgcactatgcagatcaacctgcatttatcaatatgggtgagattatgaccttccgtaagttggaagagcgtagtcgggcgtttgcagcatatttgcaaaatggtttgggattaagtaaaggagatcgcgttgcgctgatgatgccaaacctgctgcaatatcccgttgcactgtttggtgttctacgtgcaggtatgattgtcgtaaatgtaaatccgctatatacgccacgggagcttgaacatcagcttaatgacagcggcacttccgctattgtgatcgtctccaattttgcccatacattggaaaagatcgtttttaatactaaagttaagcatgttattttgacgcgtatgggtgaccaactatctcgtcctaaaggtacgctggttgattttgcggtgaaatatatcaaacggctggtaccgaagtataatctgcctgatgctatttcatttcgttgtgcgatacagaaaggttatcgcatgcaatatgtaaaaccagagattaacggtaatgatttggcttttctgcaatatactggtggcaccactggcgtagctaagggcgctatgctgactcaccgtaatattttggcaaatcttgaacaggcaaaagcggtttattctccattattacgtgtaggccaagagctgattgttacggcgttgcctctctatcacatatttgcgttaatggtgaattgcttgttacttatttacttgggtgggtgcaatcttctgattactaacccgcgtgatattacgggtacagctaaagaattaggtcgttatccgtttacttctgtcaccggggtaaatacattgtttaacgcctggttgaataatgaagaatttaagaagcttgatttttctacgctgcgtctggttgttggtggtggtatgccggtacagaaagcggttgctgagaaatgggcaaaagtgacaggcaccaatttgcttgaaggttatggtctgacagaatgttcacctttggtttcctgtaatccttataattcgaaacattacactggcagtattggtttcccggtctcttcaacagaaatcaaacttgtggatgatgatggtaatgaggtagagatgggccagcagggagaattgtggatacggggcccacaggtgatggccggttattggaatcgtcctgatgcaacagaagaagtgttgaaagatggttgggtagcaacgggtgatattgcgaatgttaatgaacagggttccattcatatcgtagatcgtaaaaaagatatgattttggtttctggtttcaatgtgtatcctaatgaagttgaagatgttgtatcagctcaccctaaagtgctagagtcagcagcaataggggtatcaagcgaaagttccggtgaaactgtcaaagtatttgtggttcggatagatcctggtttgaccgaggatgaacttaaaacccattgtcgtcgttatctaacagggtataaagtaccaaagatcattgagttccgggatgaattacctaagtctaatgtaggtaaaattcttcgtagggaactgcgtgatgaagaggaaaaggtcaggaatgtagcatag

SEQ ID NO: 14153 - protein, 560 aa, Photorhabdus luminescens subsp
MEKVWLKHYPADVPAEIDPDRYASLVEMFENAVAHYADQPAFINMGEIMTFRKLEERSRAFAAYLQNGLGLSKGDRVALMMPNLLQYPVALFGVLRAGMIVVNVNPLYTPRELEHQLNDSGTSAIVIVSNFAHTLEKIVFNTKVKHVILTRMGDQLSRPKGTLVDFAVKYIKRLVPKYNLPDAISFRCAIQKGYRMQYVKPEINGNDLAFLQYTGGTTGVAKGAMLTHRNILANLEQAKAVYSPLLRVGQELIVTALPLYHIFALMVNCLLLIYLGGCNLLITNPRDITGTAKELGRYPFTSVTGVNTLFNAWLNNEEFKKLDFSTLRLVVGGGMPVQKAVAEKWAKVTGTNLLEGYGLTECSPLVSCNPYNSKHYTGSIGFPVSSTEIKLVDDDGNEVEMGQQGELWIRGPQVMAGYWNRPDATEEVLKDGWVATGDIANVNEQGSIHIVDRKKDMILVSGFNVYPNEVEDVVSAHPKVLESAAIGVSSESSGETVKVFVVRIDPGLTEDELKTHCRRYLTGYKVPKIIEFRDELPKSNVGKILRRELRDEEEKVRNVA

SEQ ID NO: 14154 - DNA, 1764 bp, Chromobacterium violaceum ATCC 12472
  CDS (1)..(1764)
atgaagctagaacgcgtttttgacatcctgtcccaccagctggccaaccatccgcgcccggactgcctgtcggcgaaatccggcaaggcctggcggcaattgtcgacggccgaggtccgggacaccgtcaaccgcgtcagcctgggcctgatggaaatgggcatccagcgcggcgacaaggtggccatcgccgccgacaacagcatcgaatgggtgctggcggatatcgcgctgcaacaaatcggcgcggtcagcgtgccgctgtaccccaccatcaccctcgatgatgcacgctatatcctggcgcatgccgaggtcaagctcgctttcgccggcagtgctgcattgcaacgaaaactgcacgaggcattgggcaggctgtcctgcccgatctacggcctggccgacatcgacggcgcgccgtcctggcgcgagatcgccgagcgcgcgcggccggaacggatggccgagctggacgcgctgcgcgacgcggtgcgcgccgacgacgtctataccatcatttacacctccggcaccaccggccgctccaagggcgtgatgctgagccaccgcaacgtgctgagcaccgtggtggccaccgccgccttcaccggcctgccgcagggccgctgccgcgcgctgagcttcctgccgctgtcgcacatcttcgagcgcgccggcgtgttctactacctgtacagcggcaccggcatctacttcgccagcgtggaatgcctgtcgtcggcgctggccgacgtgaagccgcataccttcagctccgtgccgcgcgtgctggagaaggtgcacgagaagctggtgggcaaggcgcgcgacctgaccggcgccaagcgccgcatctatcaatgggcgctggcccgcgccgaaaacttcgaccccaaccgccgccgctctccgctggacgcgatccagcacgcgctggccgacaagctggtgtacagcaaatggcgcgcggcgatgggcggcgagctgatctccatcaatgtcggctccgccgcgctgcagccgcggctggcgcgcatgttctgggccgccggcatcgccgtggccgagggctacggcatgaccgagagctcgccggtgatctcagccaatccgttcaccgcccgcggcgtgcgcatcggcagcgtcggcctgcccctgcccggcgtggaagtgcgcctggccgacgatggcgagatcctggtgcgcggcgacaacgtgatgtccggctactacaaggagccggaacagacctcggacgcgctgcgcgacggctggctgcacaccggcgacatcggcgtgctggaggacggctacctgcgcatcaccgaccgcaagaaggaaatgttcaagaccagcaacggcaagtacatcgcgccgcaggcgctggagaacaagctgaaggaatcggccttcatcgaccagatcatggtggtgggcgacggccagaagtacgcggccgcgctgatcgtgccgctgttcgagaagctgaaggaatggtgcgccgagcacggcatctcctacaccaccgactgcgaaatgagccgccatcccaaggtggtggagctgatcgaccgcgaggtgaagcgcttcaaccgctatttcggcagctgggagcacatcaagaagttctcgctgctggacaagccgtggtgcgtggacgccggcgagctggcgcccaccttgaagctgcgccgcaaggtgatcaccgagcgctgccgcgccttgatagacggcatgtacggcatgccggagccggcgtaa

SEQ ID NO: 14155 - protein, 587 aa, Chromobacterium violaceum ATCC 12472
MKLERVFDILSHQLANHPRPDCLSAKSGKAWRQLSTAEVRDTVNRVSLGLMEMGIQRGDKVAIAADNSIEWVLADIALQQIGAVSVPLYPTITLDDARYILAHAEVKLAFAGSAALQRKLHEALGRLSCPIYGLADIDGAPSWREIAERARPERMAELDALRDAVRADDVYTIIYTSGTTGRSKGVMLSHRNVLSTVVATAAFTGLPQGRCRALSFLPLSHIFERAGVFYYLYSGTGIYFASVECLSSALADVKPHTFSSVPRVLEKVHEKLVGKARDLTGAKRRIYQWALARAENFDPNRRRSPLDAIQHALADKLVYSKWRAAMGGELISINVGSAALQPRLARMFWAAGIAVAEGYGMTESSPVISANPFTARGVRIGSVGLPLPGVEVRLADDGEILVRGDNVMSGYYKEPEQTSDALRDGWLHTGDIGVLEDGYLRITDRKKEMFKTSNGKYIAPQALENKLKESAFIDQIMVVGDGQKYAAALIVPLFEKLKEWCAEHGISYTTDCEMSRHPKVVELIDREVKRFNRYFGSWEHIKKFSLLDKPWCVDAGELAPTLKLRRKVITERCRALIDGMYGMPEPA

SEQ ID NO: 14156 - DNA, 2082 bp, Giardia lamblia ATCC 50803
  CDS (1)..(2082)
atgatctttccatttctaaaaccaaaaatgacgcctcacccgacgatctatctgaacccctacaagtcgaggacaggcctcggcgacgaccctgtaactgcaccggcagacgaggaaaccctctatgctatttgggagaagtactctctgcttcgacttgacgagctcgtttatttccattcacctcttcgcttcaacgcgcagacccagacaatcgagcgcctggcttatgaaggtatcacctacaggaccatgcgttctaatatagagcgttttgcgacagcatttgtgaccaagttcggtctgaagcccggatcgatggtcatgctctggtcctgcaacagcccagagtggattatcaccgaacaggcctgtaacagacagtctatggtgcttgttcccatttatgattcgctgtctgcacacggcatgtcgtactgtatcgacgcaaccaggcctgacatcctggtgataagccgtgataagattgggcggttggttaaaacgcttgcgcaagcagtggtcgacctttcattcctcaaggccgtaatactcactaccgacctcgagtttgagcgtgccatccctggaaaccaggtggaggagctcgagcagcttctagcgcgctctggcatggcaaacccccgtctcacagatattcttgggtacgtaacggccgcagtccatgtagtaccgccggtgcctcccacgcccagtaccatttctagtttaatttatacatctggaacatcttctacgccaaagggcgttatcatctcgcacggcgcgctcacctctgcctgttacggctatcttctgactcctcttgattttgtgcgcagcgggagaggacttcactacctttcctatttgcccatggcacacatctatgagcgcgtaattcaggcaactggtataatcattggtggtaaggtttatttctggcgaggagacttcaaatcacttttacgtgacatgcaagacgttaaaccggatatcctgtgtggcgtgcctaaagtctacacgactctctaccaggcaatccgcagcaagctggaggcctccccactcactcgtgggtggttccactacgggctcaagggagacagcatgctacaaaggtttgccaggcggtgtctctatgggcttgtgaagcgcaagataggcgtcaacttcaagctgatgatatctggaggtgcgtcccttcctcccaaggtgcacctttttgttcaggacttctttcaatgtaacctcatccagggctacggacagacagagacgtgtgcctgtgtcaccgtgcagtgcgagtcggactattctgttggaaactgtggggttgtgtgtccaaatatggagctgagaatagacccatccgagaacgaggttctgcttcgtggcagctccatgtttagccggtactacgtgcccggagagaccttttatgaaaatattcataactttccgccgtcaactgaatggtatagatctggtgattgtggactgatgaatgaggacaacaagctgatcctcaaagatagaattaataccaatttcaagctgcagaacggtgaatttgtctgtccagagacaattgagcttatgtacctgcaaagcgcgctgatcagtgccatctacattccacagacacccaactcgaaccacctctatgcttttgttgtaccaagcgaaagcctgcttgctaagctgaatgtggccaactatttctcgcctgaccaacctctgtcgctgacggggctccatgacaagctcgtagatgatacagcaaccgactctgttcacaccaatgagcaggttgaggccctgggctccttctccgttctagaggggaagcatgtggaaaatcacataatgggtctccttaagcagaaaatcgtaaaagacctcacgaaagtgcactcggaggcggggatgaagccgtttatgcaccttaaggacatacacttgctgagacgtgaattcacgatagaaaatggatgtctcacagcgacacagaagctctgcagaaagaagctctacaatcagctccagccagagatagaagccatggttgataaggagtga

SEQ ID NO: 14157 - protein, 693 aa, Giardia lamblia ATCC 50803
MIFPFLKPKMTPHPTIYLNPYKSRTGLGDDPVTAPADEETLYAIWEKYSLLRLDELVYFHSPLRFNAQTQTIERLAYEGITYRTMRSNIERFATAFVTKFGLKPGSMVMLWSCNSPEWIITEQACNRQSMVLVPIYDSLSAHGMSYCIDATRPDILVISRDKIGRLVKTLAQAVVDLSFLKAVILTTDLEFERAIPGNQVEELEQLLARSGMANPRLTDILGYVTAAVHVVPPVPPTPSTISSLIYTSGTSSTPKGVIISHGALTSACYGYLLTPLDFVRSGRGLHYLSYLPMAHIYERVIQATGIIIGGKVYFWRGDFKSLLRDMQDVKPDILCGVPKVYTTLYQAIRSKLEASPLTRGWFHYGLKGDSMLQRFARRCLYGLVKRKIGVNFKLMISGGASLPPKVHLFVQDFFQCNLIQGYGQTETCACVTVQCESDYSVGNCGVVCPNMELRIDPSENEVLLRGSSMFSRYYVPGETFYENIHNFPPSTEWYRSGDCGLMNEDNKLILKDRINTNFKLQNGEFVCPETIELMYLQSALISAIYIPQTPNSNHLYAFVVPSESLLAKLNVANYFSPDQPLSLTGLHDKLVDDTATDSVHTNEQVEALGSFSVLEGKHVENHIMGLLKQKIVKDLTKVHSEAGMKPFMHLKDIHLLRREFTIENGCLTATQKLCRKKLYNQLQPEIEAMVDKE

SEQ ID NO: 14158 - DNA, 2025 bp, Plasmodium yoelii yoelii
  CDS (1)..(2025)
atgtttactacaacgggtaagcttatttacgctgttgagcatagtccgtccacaagtaaggactctactgcagtttatagaaatccccaatttaatgataagttgttagataattttgaggatgatccattaaataatgtgtgggatatgtttaataaatcagctgagaaatataaaaataggcattgttttggtacaagagttcgtaaaaatgataaattaggtgaatataaatggaaaacatttaaagaagtacaagaattaataatattaattggttctggattaataaatatgaatatatgtccagtaattgaatgtaatgataccataattccaaaagcacgatttttaggtttatatctacctaattgtgaagaatggaatatttgtgattttagctgtaatgcatttaatatcattacagtaccattatatgattcattaggtatagaatcgagtaaatttatattagatcagacaatgatgcaaacaattatgtgtaatagagcatgtggtttaaaattaataaaatctttagataattttgatcatatatatataaaaacattaatattagtagaaaaagaaatagatccagaaataaaaaaaacctgtaataaattaaatataaaaatagtaacatgggatgatttaatagaagcaggaaaaaaaaaaaaattagatccaaaacctggaaaattaagtgatgtttgttcattatgttatacatctggtactactggatatcctaagggagttataatgactaaccaaaattttattgcacaaattgcttcatcttgtttaggaccaataaaatttccttctgttgctataaatgaaaaggatacacatttatcttatcttccattagcacatgtttatgaaagaattatgatgtgtatatttttacatgtaggagtaagaattggatattattcaggaaatatattggccttaactgatgatgttcaagaattaaagccaagtttatttcttagtgtacctagattatataatagaatacatgaaagaatatgtaattcattaaaaaaaaaatcatctgttattcaatcattatttcataaagggcttgatcagaaacttaaaaaattaaatagtacaggtaatccttggagtcttttttgggatacattattatttaataaagcaaaaaaagttttaggtggaaatttaaaagggatgttaaatggttctgctccacttggtgtagaagtagcaaaaaaattaaaatgtatattttgtgtaccattaatggaaggttttggtatgaccgaagggttgggttgtttatttattaccaatcctatagatccagatgtaggacatataggtgggccattaccagctgttgaatataaattagtttctgtacctgaaatgaattatttagttacagataatccaccaaggggtgaattattattaagaggaccaactatatgtagtttaggatattttaaattagaaaaagaaacaagtgaattattggatagtgatggatggttaagaacaggagatattgcatcttttagtcagaaccaatcattaacaattattgatagaaaaaaaaatatatttaaattatcacaaggtgaatatgtagctgtagaaaaaatcgaatctgtttataagcaatcattatttattggacaaatatttgtttttggatattcttatgaatcatttttagtttgtattatttttccatcagttgataccatgagtatatgggcaaaggaaaataaaataaatctaccaaatgaagaaattatcaaattagaaaaattcaaaaatgatgttatgcaagatctaattacaataggtaaaactgatggcttaaatgggtatgaacaaattaaagatattcattttattatggagggatttactattgaaaatgatttgatgactccgactggaaaattaaaaagacacgctgtacagaaaaaatacaagcaagagattgaccaaatgtacgagaatgtaaaaaaggcatga

SEQ ID NO: 14159 - protein, 674 aa, Plasmodium yoelii yoelii
MFTTTGKLIYAVEHSPSTSKDSTAVYRNPQFNDKLLDNFEDDPLNNVWDMFNKSAEKYKNRHCFGTRVRKNDKLGEYKWKTFKEVQELIILIGSGLINMNICPVIECNDTIIPKARFLGLYLPNCEEWNICDFSCNAFNIITVPLYDSLGIESSKFILDQTMMQTIMCNRACGLKLIKSLDNFDHIYIKTLILVEKEIDPEIKKTCNKLNIKIVTWDDLIEAGKKKKLDPKPGKLSDVCSLCYTSGTTGYPKGVIMTNQNFIAQIASSCLGPIKFPSVAINEKDTHLSYLPLAHVYERIMMCIFLHVGVRIGYYSGNILALTDDVQELKPSLFLSVPRLYNRIHERICNSLKKKSSVIQSLFHKGLDQKLKKLNSTGNPWSLFWDTLLFNKAKKVLGGNLKGMLNGSAPLGVEVAKKLKCIFCVPLMEGFGMTEGLGCLFITNPIDPDVGHIGGPLPAVEYKLVSVPEMNYLVTDNPPRGELLLRGPTICSLGYFKLEKETSELLDSDGWLRTGDIASFSQNQSLTIIDRKKNIFKLSQGEYVAVEKIESVYKQSLFIGQIFVFGYSYESFLVCIIFPSVDTMSIWAKENKINLPNEEIIKLEKFKNDVMQDLITIGKTDGLNGYEQIKDIHFIMEGFTIENDLMTPTGKLKRHAVQKKYKQEIDQMYENVKKA

SEQ ID NO: 14160 - DNA, 2079 bp, Neurospora crassa
  CDS (1)..(2079)
atggcgccctcacaagataccgcggcttatatcaagtcgattgcggaaccgccacctcctgggactccttacgccctgcctgttcctggaacacagcgaccgaaccgtacggcagtttatcgtcattggaagttcgtcaacagccctctcctcgagacgctcgacccggctcaccagacggttcacgatctctttgaagcctcagttgagaaggtgcccaacaagaagtgcctgggatggcgcccatggaacgctgccaccaagacctacgagcccaagtatgtttggatcacttacaaggaggttgctgagcggaggaagaactttggcgccggcattgtcgccatccacaagtccatcggcttcaccgaggagaagtatggcgttgagcttgcgctcctctcccagtccctgttccccatctctctttacgagactcttggtcccgagaccaccgagtacatcatcaaccacagtggtcttactgccattgcatgctctgtgccccatatcccgaccctcctcaaggtcgcgccgcgttgcccaaccttgaagctcattatctccctggatcctctggatgctggtgagcctgctggccacactaagcgcgagctgctcaatgccgccgcttccaacgtgggcatcaagatcttctccatcgacgaggttgaggcgctgggtgtcaagtcgggcctctccatgaagcctcccaagcgtgaggatgttctgaccatcaactatacctcgggcaccactggcgacccgaagggtgtcctgatcacccatgctcagggtgtggccggtattactgctgcccgctcgatgcagagcatcctctcctccgatatccacatctcctaccttcccctggcgcacatttacggtcgcatggccgaccagaccgctttggccgagggcgctagcatcggttacttccatggcgacatcgccggcctggtcgaggacatgaagatcctgcgcccgaccggcctcatgtccgtcccgcgtctgtacaaccgcatcagcggcgctgtgcaggccgccaccatcgacgccgacggcttcaagggcaccctgtcccgctacgttgtggaggccaagaagcagagcatggccctgcccaccggcaaggccaccaacaagcacttcctgtatgaccgcatctggaccaagaaggttctcaagggcgtgggcctcgaccgcgcccgcaccatggtcagcggttccgcccagctcgaccctgaagtgcaccagttcctccgcgccgccttcggcaacgatttcatccaaggcttcggcatgaccgagtcgtacgccacgggcaccgcccaggttcccggcgacttctccaccggcaatattggccccccttgcccctgtgtcgagctctgcatcgagtccgtgccagactacgactacactgtcgacgacaagccgaacccccgcggcgagctgctgatgcgcggtcccatcatgtttaaggagtattacaagaacccggaagaaaccgccaaggtggttgaagcggacggctggttccacacgggcgacatcgtcgaggttgacagcatgggccggttcaagattatcgaccgcaagaagaacgtgctcaagctgtcgcagggcgagtacatctcgcccgagcgtatcgagaacgtatacatggccagcaccaacctgatcgccatggcatttgtgcacggcgatcccaaggagtccagcctggtggccatctttgggatcgaccccgtcaccttcgcgccctatgccagcaggatactcaagaagaatattgcccctgaaaaccttgaagagctgaagcagtccgccaacgacccccgtgtcaagacggctttcctcaaactgctggatggcattggcaagaaccacaagttcaacagctacgagaaggtcaagaatgtttatttggatattgagccgtttacgattgagaatgagcttttgacgccaactctcaaactcaagcgtccccaggccgccaggaagttcagggccgaaatcgaccgcatgtacgaggagatcaacgctgctgcccagaccaaggccaagctatag

SEQ ID NO: 14161 - protein, 692 aa, Neurospora crassa
MAPSQDTAAYIKSIAEPPPPGTPYALPVPGTQRPNRTAVYRHWKFVNSPLLETLDPAHQTVHDLFEASVEKVPNKKCLGWRPWNAATKTYEPKYVWITYKEVAERRKNFGAGIVAIHKSIGFTEEKYGVELALLSQSLFPISLYETLGPETTEYIINHSGLTAIACSVPHIPTLLKVAPRCPTLKLIISLDPLDAGEPAGHTKRELLNAAASNVGIKIFSIDEVEALGVKSGLSMKPPKREDVLTINYTSGTTGDPKGVLITHAQGVAGITAARSMQSILSSDIHISYLPLAHIYGRMADQTALAEGASIGYFHGDIAGLVEDMKILRPTGLMSVPRLYNRISGAVQAATIDADGFKGTLSRYVVEAKKQSMALPTGKATNKHFLYDRIWTKKVLKGVGLDRARTMVSGSAQLDPEVHQFLRAAFGNDFIQGFGMTESYATGTAQVPGDFSTGNIGPPCPCVELCIESVPDYDYTVDDKPNPRGELLMRGPIMFKEYYKNPEETAKVVEADGWFHTGDIVEVDSMGRFKIIDRKKNVLKLSQGEYISPERIENVYMASTNLIAMAFVHGDPKESSLVAIFGIDPVTFAPYASRILKKNIAPENLEELKQSANDPRVKTAFLKLLDGIGKNHKFNSYEKVKNVYLDIEPFTIENELLTPTLKLKRPQAARKFRAEIDRMYEEINAAAQTKAKL

SEQ ID NO: 14162 - DNA, 2121 bp, Neurospora crassa
  CDS (1)..(2121)
atggtcatcccaacgttgacgccagttcccaagctggtcgctaagcccccctatactctcgatgtcccgggccagacgcccgtcgagggcgagactcctgttcgtcgcattcccctcgccatcgacggtctgcatgccatacccccaaacaggcgatggggcgagaatgaggccatcggcgaggaaatcgataccgtctacaaactcgtcaagtgggctgccctcgcacatggcgagtcccagtgcatgggctcccgcaagctcgtaaacacccatgttgagactaagaaggtcaagaagatggtggatggtgaggagcgcgaggtggacaagaactggacctacttcgagctcggccactacgagttcattaccttcaaggactacgagcagcttacgctcgacgttggcgctggtctgcgcgccatcggtctcaacaagggcgaccgtgtccacatctttgccgcgacaagccagaactggctcgccatgtctcatggttccgcgacccagtccatgcccattgtaactgcctacgacacactcggcgccgaaggtctcaagtactccatggtcgctaccaatgccaaggccatcttcctcgacccccatcttctccctaccctcaacggcgttcttgagcatgccaagggcatcacacacgtcatctggaacaaccagaacaaggtcaaggaggcccacattgaggccctcaggaacgagcgcggtgttactgtcttgagcttcgacgagcttgtccagctcggcaagcagaaccccgtcgcgcccgtcgcgcccgcccctgaggatctctgctgcatcatgtacacctccggttctaccggtacccccaagggtgtccccctgaagcacagcaacgtcgtcgctgccgtcgctggtgtctgccccgtagtccagcccttcgttggccccggtgaccgcctcctgacctaccttcccctcgctcacattctcgaatttgttttcgagaacgcctccctctactggggttcaaccatgggttatggtaaccccaagaccctctccgacacctccgtccgcaactgcctcggcgatatccgcgagtttcaacccagcgttttggttggtgtgcccgccgtctgggaaaccgtcaaaaagggcattctcgccaaggtcaacgctggcagccctctcctccgcaaccttttctggggcgcacttgctctcaaggagaagcttatgggccttggtcttcctggaagcggtcttttggacgccattgtgttcaagaagatcaaggatgccactggcggtcgcatgaagctttgcttgaacggtggtggccctgtcgccaaggatacccaaaagttcatctccatggccatctgccccatgattatcggctatggtcttaccgagacgaccgctatgggtaccctccagaaccccaacgagtggactgctgagtcaattggcgccatgcccgcctcgatcgaggccaagctcgtcgatttcgccgacgccggttacttcgccactaacaagcccaacccccagggtgaaatctggctccgtggcccctctgtgctctccgaatactatgagaaccccgaggagaccgctgccgctgtgaccgcggacggctggttcaagaccggcgacattggcgagtgggaccagaacggccatctcaagatcattgaccgcaagaagaacctcgtcaagactctcaacggcgagtacattgctcttgagaagcttgagtccatctaccgctccgccgccgtcgtcgccaatatttgcgtctatgccgaccaggatcgttccaagcccatcgccatcatcgttcccgcggaacccgcccttaagaagctcgcctcctcgagtggtgtgaagggtgacagcttggaggagctcgtacacaacaagaagctccaggctgccgttctcaaggagctccagaacgccggtcgtgccggcggcctttctggcattgagattatcgagggtgtcgttatgtcggatgaggagtggaccccccagaacggtcttgtaacggccgcccagaagctcaaccgcaagggcatcctcaacaagtacaagaaggaggttgatgaggcttatggccccaagcagtag

SEQ ID NO: 14163 - protein, 706 aa, Neurospora crassa
MVIPTLTPVPKLVAKPPYTLDVPGQTPVEGETPVRRIPLAIDGLHAIPPNRRWGENEAIGEEIDTVYKLVKWAALAHGESQCMGSRKLVNTHVETKKVKKMVDGEEREVDKNWTYFELGHYEFITFKDYEQLTLDVGAGLRAIGLNKGDRVHIFAATSQNWLAMSHGSATQSMPIVTAYDTLGAEGLKYSMVATNAKAIFLDPHLLPTLNGVLEHAKGITHVIWNNQNKVKEAHIEALRNERGVTVLSFDELVQLGKQNPVAPVAPAPEDLCCIMYTSGSTGTPKGVPLKHSNVVAAVAGVCPVVQPFVGPGDRLLTYLPLAHILEFVFENASLYWGSTMGYGNPKTLSDTSVRNCLGDIREFQPSVLVGVPAVWETVKKGILAKVNAGSPLLRNLFWGALALKEKLMGLGLPGSGLLDAIVFKKIKDATGGRMKLCLNGGGPVAKDTQKFISMAICPMIIGYGLTETTAMGTLQNPNEWTAESIGAMPASIEAKLVDFADAGYFATNKPNPQGEIWLRGPSVLSEYYENPEETAAAVTADGWFKTGDIGEWDQNGHLKIIDRKKNLVKTLNGEYIALEKLESIYRSAAVVANICVYADQDRSKPIAIIVPAEPALKKLASSSGVKGDSLEELVHNKKLQAAVLKELQNAGRAGGLSGIEIIEGVVMSDEEWTPQNGLVTAAQKLNRKGILNKYKKEVDEAYGPKQ

SEQ ID NO: 14164 - DNA, 1944 bp, Mycobacterium bovis
  CDS (1)..(1944)
atgggccgccacgggtctcggtggtcgcggcccccgtgcttccgcgtccttcgattgtggacgtacgctcaccgatgtgacctgggccatactgatccgctgtcaaggagaacggaaatgaccacaacagagcgcccgacaaccatgtgcgaggcgttccagcgcaccgccgtcatggacccggacgccgttgcgctacggacccccggcggtaaccagacaatgacatggcgagactacgcggcgcaggtgcggcgggtcgctgccggcctggcaggtttgggagttcggcgcggcgacacggtctcgctgatgatggcgaaccggatcgagttctacccgctcgacgtcggtgctcagcacgtcggcgccacctcgttttcggtgtacaacaccctgcccgccgagcagctgacctacgtgttcgacaacgcggggaccaaggtggtcatctgcgagcaacagtacgtcgatcgcgttcgcgccagcggtgtgcccatcgaacacatcgtctgcgtcgatggcgcgccccccggcacgctctcgctgacggatttgtacgcggccgcctccggcgacttcttcgacttcgagtcgacgtggcgtgccgtacaacccgaggacattgtcaccctcatctacacgtccggcacaacgggaaaccccaagggtgtggagatgacccacgccaacctgctgttcgagggatatgccatcgacgaggtgctcggaatccggtttggcgatcgggtgacgtccttcctgccatcggcgcacatcgccgatcggatgaccgggctgtacctgcaggagatgttcggcacccaggtcaccgcggtggccgacgcgcgcacgatcgcagccgcgctccccgacgtgcggccaaccgtgtggggggccgttccccgggtttgggaaaagcttaaggccggaatcgaattcaccgtcgctcgtgagaccgacgagatgaagcggcaggcgttggcgtgggcgatgtcggtggctggcaaacgcgccaacgccctgctcgcaggtgaatctatgtcggatcagctggtcgccgaatgggccaaagccgacgagtcggtgttgtccaagttgcgcgagcggctgggcttcggcgagctgcggtgggccctgtccggagcggcgccgatccccaaggagacgctcgcgttcttcgcaggtatcggcatcccaatcgccgagatttggggaatgtcggagctgagctgcgttgccaccgccagccatccccgcgacgggcggctgggcaccgtcggaaaactacttcccgggctgcagggcaagatcgccgaagacggtgagtacctggtccgcggtccgctggtgatgaagggttatcgcaaagaaccggccaagaccgcggaggcgatcgactccgacggctggctacacaccggagatgtcttcgatatcgactccgacggctatctgcgggtggtggaccgcaagaaggagctgatcatcaatgcggccggaaaaaacatgtcgccggccaacatcgagaacaccatcctggccgcgtgccccatggtcggggtgatgatggcaatcggtgacgggcgaacgtataacaccgcgctgttggtcttcgacgccgactctctcggtccgtatgcggcccagcgtggcctcgatgcctcgcccgcggctctggcggctgacccggaggtgatcgcgcgcatcgccgccggcgtggccgagggcaacgccaaattatcgcgggtcgaacagatcaagcggttccgcatattgcccaccctgtgggagcccggcggggacgagataaccctgacgatgaaactcaagcgccgtcgaatcgccgcgaaatattccgcggagatcgaggagctctacgccagcgagctgagaccgcaggtttacgagcccgctgccgtgccatcgacacaaccggcatga

SEQ ID NO: 14165 - protein, 647 aa, Mycobacterium bovis
MGRHGSRWSRPPCFRVLRLWTYAHRCDLGHTDPLSRRTEMTTTERPTTMCEAFQRTAVMDPDAVALRTPGGNQTMTWRDYAAQVRRVAAGLAGLGVRRGDTVSLMMANRIEFYPLDVGAQHVGATSFSVYNTLPAEQLTYVFDNAGTKVVICEQQYVDRVRASGVPIEHIVCVDGAPPGTLSLTDLYAAASGDFFDFESTWRAVQPEDIVTLIYTSGTTGNPKGVEMTHANLLFEGYAIDEVLGIRFGDRVTSFLPSAHIADRMTGLYLQEMFGTQVTAVADARTIAAALPDVRPTVWGAVPRVWEKLKAGIEFTVARETDEMKRQALAWAMSVAGKRANALLAGESMSDQLVAEWAKADESVLSKLRERLGFGELRWALSGAAPIPKETLAFFAGIGIPIAEIWGMSELSCVATASHPRDGRLGTVGKLLPGLQGKIAEDGEYLVRGPLVMKGYRKEPAKTAEAIDSDGWLHTGDVFDIDSDGYLRVVDRKKELIINAAGKNMSPANIENTILAACPMVGVMMAIGDGRTYNTALLVFDADSLGPYAAQRGLDASPAALAADPEVIARIAAGVAEGNAKLSRVEQIKRFRILPTLWEPGGDEITLTMKLKRRRIAAKYSAEIEELYASELRPQVYEPAAVPSTQPA

SEQ ID NO: 14166 - DNA, 1674 bp, Bordetella bronchiseptica
  CDS (1)..(1674)
atggaaaaaatctggctggccagctatccggcgggcgtggcgcccgagatcgacagcggcgcgcatgcctcgctggccgaggtgatcgaagacagctgccggacctttgccggcaagaccgcctatatcagcctgggccgcacgctgagctacgccggactggaccgccgctcgcgcgccttcgccgcctggctgcaggcgcgcggcctgggcaggggcgagcgggtcgcgctgatgatgcccaacctgctgcaataccccatctgcctgttcggcgcctggcgcgccggctgcacggtggtcagctgcaatccgctctacacgccgcgcgaactggcgcaccagctggccgactccggcgcgcgcgccatcgtggtggccgacaacttcgccgccacgctgcaacaggcgctgccgcagaccgccctcgaacacgtggtcgtgacctccatcggcgaacagctgggctggccgcgcggccctgtggtcgacttcgtggtgcgccgggtcaagcgcatggtgccggcctggtcgctgccgggcgcgcggcgcctgcgcgacgtgctggccgaaggcgagcgcctgccccacgcggcgccggcgctgggccacgccgacctcgcctgcctgcaatacaccggcggcaccaccggcgtggccaagggcgccatgctcacccacggcaacctgatcgccaatctgtgccaggcgcacgcctgggtcaggccgctggtcaaggaaggccgggaatgcgtggtgacggccctgccgctctaccatatcttcgccctgacggcgaactgtctgaccttcctgaagatcggcgcgagcaacctgctgatcgtcaatccgcgcgatatcccggccttcgtgcgcgagctgcgcaagacgccatttagctgcatcaccggcgtcaacaccctgttcaacgccctgctcgaccaccccggtttcgcccggctcgacttctcgcgcctgcggctgaccctgggcggcggcatggcggtgcagcgctcggtcgccgaacgctggcgcgccgtcaccggcaagccgctggcgcaggcctatggcctgaccgagacctcgccggcggtcaccatcaatccgctcgacgccccggatttcaccggctccatcgggctgcccgtgccctcgaccgagctgtcgatccgcgacgaacacggcgaggagctgcccctgggcgcgacgggcgaaatctgcgtgcgcggtccgcaggtcacgccgggctattggcagcggcccgacgaaaccgcgctcagcttccatgccgacggtttcctgcgcaccggcgacatgggctacgtcgacccgcggggttatgtcttcctggtcgaccgcaagaaggacatgatcctggtctcggggttcaacgtctatccgaacgaaatcgaggacgtggtggcgctgcaccccggggtgcgcgaggtggccgccgtgggcgtgcccgacgcgcgctcgggcgaggcggtcaagctgttcgtgatccgcaaggacccggacctggacgccgccgcgctgatcgcctactgccgcgccaacctgaccggctacaaggtgccgcgttcggtggaattccgcaccgagctgccgcgcaccaacgtgggcaagatcctgcgccgccagttgcgcgacgaggccggacggcccgcctag

SEQ ID NO: 14167 - protein, 557 aa, Bordetella bronchiseptica
MEKIWLASYPAGVAPEIDSGAHASLAEVIEDSCRTFAGKTAYISLGRTLSYAGLDRRSRAFAAWLQARGLGRGERVALMMPNLLQYPICLFGAWRAGCTVVSCNPLYTPRELAHQLADSGARAIVVADNFAATLQQALPQTALEHVVVTSIGEQLGWPRGPVVDFVVRRVKRMVPAWSLPGARRLRDVLAEGERLPHAAPALGHADLACLQYTGGTTGVAKGAMLTHGNLIANLCQAHAWVRPLVKEGRECVVTALPLYHIFALTANCLTFLKIGASNLLIVNPRDIPAFVRELRKTPFSCITGVNTLFNALLDHPGFARLDFSRLRLTLGGGMAVQRSVAERWRAVTGKPLAQAYGLTETSPAVTINPLDAPDFTGSIGLPVPSTELSIRDEHGEELPLGATGEICVRGPQVTPGYWQRPDETALSFHADGFLRTGDMGYVDPRGYVFLVDRKKDMILVSGFNVYPNEIEDVVALHPGVREVAAVGVPDARSGEAVKLFVIRKDPDLDAAALIAYCRANLTGYKVPRSVEFRTELPRTNVGKILRRQLRDEAGRPA

SEQ ID NO: 14168 - DNA, 2520 bp, Homo sapiens
  CDS (101)..(2050)
cagatgtcccagctccagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagatggtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtccaaaaaaaaaa

SEQ ID NO: 14169 - protein, 649 aa, Homo sapiens
MNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEACQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEMVKQQDPLVYKAIQQGINAVNQEAMNNAQRIEKWVILEKDFSIYGGELGPMMKLKRHFVAQKYKKQIDHMYH

SEQ ID NO: 14170 - DNA, 1797 bp, Streptomyces avermitilis
  CDS (1)..(1797)
atgcgcgagttcagccttccggctttgtacgaggtccctgcggacggcaatctgaccgacatcgtccgcagaaacgccgcgcagcatcctgacgtcgccgtcatcgcccgcaaggtcggcggcagctggcaggacgtcaccgccaccgccttcctcgccgaggtgcgcgccgcggcgaaggggctcatcgcctcgggcgtccagccgggcgaccgggtcggcctgatgtcccgtacccgctacgagtggacgctgctcgacttcgcgatctggagcgcgggcgcgatcaccgtgccggtgtacgagaccagctcccccgagcaggtgcagtggatcctcggcgactcgggcgcgaccgcctgcgtcgtcgagctggacacgcacgcggcctcggtggagtcggtgcgcgaccggctgcccgccctcaagcacgtctggcagatcgacaccggcggcgtggaggagctggggcgcctcggcagggacgtcagcgacgccaccgtcgaggagcgcagctcgctcgccaaggccgacgacccggcgaccatcgtctacacgagcggcacgaccggccgtcccaagggctgcgtcctcacccaccgcgccttcttcgcggagtgcggcaacatcgtggagcggctgcgcccgctcttccgcacgggcgagtgttccgtcctgctcttcctgccgctcgcgcatgtcttcggacggctcgtgcaggtcgcgccgatgatggcgccgatcaagctgggctgcgtcccggacatcaagaacctgaccgacgaactggccgcgttccggccgacgctgatcctcggtgtgccgcgcgtcttcgagaaggtctacaactcggcgcgcgccaaggcgcaggcggacggcaagggcaagatcttcgacaaggcggcggacacggcgatcgcgtacagccgcgccctggacaccccgtccggcccgtccctcgggctgaagatcaaatacaagacgttcgacaagctcgtctacagcaagctgcgggccgttctcggcggcaagggcgagtacgccatctccggcggcgccccgctgggcgagcgcctgggccacttcttccgcggcatcggcttcacggtcctcgagggctacggcctgaccgagtcctgcgcggccaccgccttcaacccctgggaccgcacgaagatcggcacggtcggccagccgctgccgggctccgtgatccggatcgcggacgacggcgaggtgctgctgcacggcgagcacctgttcaaggagtactggaacaacgagggcgcgaccgccgaggcgcttgccgacggctggttccacaccggtgacatcggcaccctcgacgaggacgggtatctgcggatcaccggccgcaagaaggagatcatcgtcaccgcgggcggcaagaacgtcgccccggccgtgatcgaggaccgtatccgcgcgcacgcgctggtcgcggagtgcatggtggtcggcgacggacgcccgttcgtgggcgcgctcgtcaccatcgacgacgagttcctgggccgttgggccgccgagcacggcaagccggccggctccaccgcggcgtcgctgcggcaggatccggatctcctcgcggcggtccagagcgctgtcgacgacggcaacgccgcggtgtcgaaggcggaatcggtgcggaagttccgcattctgtcctcccagttcaccgaggagtcgggccacctcacgccgtccctgaagctcaagcgtcatgtggtggcgaaggactacgcggacgagatcgaggcgatctaccagaagtag

SEQ ID NO: 14171 - protein, 598 aa, Streptomyces avermitilis
MREFSLPALYEVPADGNLTDIVRRNAAQHPDVAVIARKVGGSWQDVTATAFLAEVRAAAKGLIASGVQPGDRVGLMSRTRYEWTLLDFAIWSAGAITVPVYETSSPEQVQWILGDSGATACVVELDTHAASVESVRDRLPALKHVWQIDTGGVEELGRLGRDVSDATVEERSSLAKADDPATIVYTSGTTGRPKGCVLTHRAFFAECGNIVERLRPLFRTGECSVLLFLPLAHVFGRLVQVAPMMAPIKLGCVPDIKNLTDELAAFRPTLILGVPRVFEKVYNSARAKAQADGKGKIFDKAADTAIAYSRALDTPSGPSLGLKIKYKTFDKLVYSKLRAVLGGKGEYAISGGAPLGERLGHFFRGIGFTVLEGYGLTESCAATAFNPWDRTKIGTVGQPLPGSVIRIADDGEVLLHGEHLFKEYWNNEGATAEALADGWFHTGDIGTLDEDGYLRITGRKKEIIVTAGGKNVAPAVIEDRIRAHALVAECMVVGDGRPFVGALVTIDDEFLGRWAAEHGKPAGSTAASLRQDPDLLAAVQSAVDDGNAAVSKAESVRKFRILSSQFTEESGHLTPSLKLKRHVVAKDYADEIEAIYQK

SEQ ID NO: 14172 - DNA, 1911 bp, Streptomyces avermitilis
  CDS (1)..(1911)
atgagcgacacacagaccctgatcgagaaccgtccgccgtccgtggcggccctcttcctggagcgcgtggcggccacgccggacgccgaggcctaccgctacccggtaccgtcccccaagctctcggcttcgcccgagcagggaggcgcccccgcgggccagggcccggacgactggaagtcgctgagctgggcgcaggccgccgaacgggtcttcgcggtggcggccggcctcatcgagctgggtgtgcagccggagcagcgagtggccctcgcctcctcgacgcgggtcgagtggatcctggccgacctgggcatcatgtgcgccggcgcggccacgaccacgatctacccgcagaccaacgccgacgagtccgcgttcatcctcgccgactccgagagcaaggtgctgatcgcggaggacgcggcgcagctcgcgaaggcggtggagaagcgcgccgagcttcccgcgctgacccatgtcgtggtgatcgaccccacgggcgtggagagcagtgactgggttctcacccttgccgagctggaggcccgcggcgccgcccacctggagaagaaccccgacctgatcaaggagaaggtcggcgcgatcacctccgaccagctcgccaccctcatctacacctccggcaccacgggccgccccaagggtgtccggctcccgcacgacaactggtcgtacatggcgaaggccaccgccgggaccggtctgatcagcgcggacgacgtgcagtacctgtggctgccgctcgcgcacgtcttcggcaaggtgctcacgtccgggcagatcgaggtcgggcatgtcaccgccgtcgacggccgcgtcgacaagatcatcgagaatctgccggtggtgcagccgacgtacatggctgccgtaccgcgcatcttcgagaaggtctacaacggggtcgctgccaaggcgcgggcgggtggcggcgccaagtacaagatcttccagtgggcggccgaggtcgcccgcgagtacgccaaggtcagccaggacaacttccgccgtaccggcgcggcctccgtgccgttcgggctcggcgccaagtacaaggtcgcggacgcgctcgtcttcgccaagatccgcgaggccttcggcggcaacctgcgcgcgtgcgtctcgggcagtgccgcgctcgcgcccgagatcggctacttcttcgccggcgccggcatccacatcctggaggggtacggcctcacggagtcctccgcggcctccttcgtgaaccccggcgaggcgtaccgcaccggcacggtcggcaagccgctgcccggcaccgaggtgcggatcgcggacgacggcgagatcctgctgcgcggccccggcatcatggaggggtaccacgggctgccggagaagaccgccgaggtgctggagccggacggctggttccacaccggcgacatcggcgagctgtcccccgacggctatctgcgcatcacggaccgcaagaaggacctcatcaagacctcgggcggcaagtacatcgcgcccgccgaggtcgagggccagttcaagggtgtgtgcccgtacgtctccaacatcctggtgcacggcgccgaccggaacttctgcacggccctcatcgccctcgacgagccgtccatcctggagtgggccaaggagaacggcctggccggcaagtcgtacgccgacgtggtcgccgcgcccgcgacggtcgccctggtcgagggctacgtcacggaactgaacggtggcctccagcgctggcagaccatcaagaagttccgcctcctgccgcgcgacctcgacatcgaacacggcgagatcaccccgagcctcaagctgaagcgcccggtcgtcgaacgcgagtacaagcatctgatcgacgagatgtacgcggggtcgcgggaggcttag

SEQ ID NO: 14173 - protein, 636 aa, Streptomyces avermitilis
MSDTQTLIENRPPSVAALFLERVAATPDAEAYRYPVPSPKLSASPEQGGAPAGQGPDDWKSLSWAQAAERVFAVAAGLIELGVQPEQRVALASSTRVEWILADLGIMCAGAATTTIYPQTNADESAFILADSESKVLIAEDAAQLAKAVEKRAELPALTHVVVIDPTGVESSDWVLTLAELEARGAAHLEKNPDLIKEKVGAITSDQLATLIYTSGTTGRPKGVRLPHDNWSYMAKATAGTGLISADDVQYLWLPLAHVFGKVLTSGQIEVGHVTAVDGRVDKIIENLPVVQPTYMAAVPRIFEKVYNGVAAKARAGGGAKYKIFQWAAEVAREYAKVSQDNFRRTGAASVPFGLGAKYKVADALVFAKIREAFGGNLRACVSGSAALAPEIGYFFAGAGIHILEGYGLTESSAASFVNPGEAYRTGTVGKPLPGTEVRIADDGEILLRGPGIMEGYHGLPEKTAEVLEPDGWFHTGDIGELSPDGYLRITDRKKDLIKTSGGKYIAPAEVEGQFKGVCPYVSNILVHGADRNFCTALIALDEPSILEWAKENGLAGKSYADVVAAPATVALVEGYVTELNGGLQRWQTIKKFRLLPRDLDIEHGEITPSLKLKRPVVEREYKHLIDEMYAGSREA

SEQ ID NO: 14174 - DNA, 1917 bp, Streptomyces avermitilis
  CDS (1)..(1917)
atgtccaccccgtacccgacctcgtcgtcgttcgaccccgccgcgcccgcctccgtcgagcccgagatccggcggctggacggggtggtgcgcgaggtggccgtgccgccgctcgtcgggcaggtgacgcacggttcgctcgcggacatcccgttcgacaacgcggacgtggcgcccgaagacgtggtcctcagccggaagacgccggacggcggctggaccgatgtgacggcggccgagttcgccggccaggtgctggccgtggccaaggggctgatcgccgaggggctgatgccgggcgaccgcctcgcgatcatggcgcgtacgacgtacgagtggacgctcctcgacttcgccgcgtgggcggcgggcctggtgaccgtccccgtctaccccacctcctccgtcttccagacccgctggatcctccaggactcgggagccgtcgcgctcgccacggagtccgcgggccaggcggccgccctcggcccggagctctcccgcctgcccgatctgcggcacgtgtgggtcttcgacaagggacatgtggagcgtctggcggaactggggcgcgatgtccaggaccaggaagtcgccgtacgacgcggggtgctgggccccgacaccctggccaccctcgtctacacctcgggcacgacggggacccccaagggctgcgccctcacgcacggcaacttcttcgcggagatcgacaacgcggtcgaactcctctaccccatcttcaagtcgaagacgaaggaggaggcgtcgacgctcctcttcctgcccctgtcgcacgtcttcggccggatggtcgcggtcgcctgcgtccgcgcacgggtgcgcctgggccatgcgccgagcctcacgacggaggatctgctcgcggacctcgcgagcttccggccgacctgtctgctggccatcccgtacatgctggagaaggtcttcaacggggcccgggcgacggccgagaagggcggccgggcgtcttccttcgaccgggcggtctccgtggcccgcaagtacggcgaggcgatggagacccggcagcagggcaccggctccggccccagccggggcctgaaggcgggccgcgccctctacgaccccctggtctaccgccgcatccgcaacgcgctgggcggcagggtgcggtatgtgatctgcggcggctccccgctgggccgcccgctggccgcgttctacgccggtgcgggcatcgagatctacgagggctacggactgacggagacgacgggcgcggccacggtcacgcctccgcacaaaacccgcctgggcacggtgggctggccgctgcccggcacccgggtccggatcgcggccgacggggagatcctgctcagcggcggccaggtgttccgcggctactgggatccgcacgcgggcggggtggtcccggcgacgccggacggctggttcgcgacgggcgacataggccggctggacgacgagggccatctgacgatcacgggccgcaagaaggagatcctgatcaccgcgggcggcaagaacgtggccccggcgccgctggagaactggctccgctcgcatccgctgatctcgcaggccttggtggtgggtgacggccgcccctatgtcacggccctgctcaccctcgatcccgagggcatcacgcactggcgccagatgaacggcaagcacggcgtcccgccggaactcctcatggacgacgaggagttgttctcggtactgcaacgcgcggtggacgaggcgaacaagctcgtctcccgcccggagtcgatccgccgcttcgccgtcctgccggtggacttcacggaggaggcggggcatctgacgccgtcgatgaagctgaggcgggaggcgatcgcccgggacttcgggcgggagatcgaggggatgtacgcgcaatag

SEQ ID NO: 14175 - protein, 638 aa, Streptomyces avermitilis
MSTPYPTSSSFDPAAPASVEPEIRRLDGVVREVAVPPLVGQVTHGSLADIPFDNADVAPEDVVLSRKTPDGGWTDVTAAEFAGQVLAVAKGLIAEGLMPGDRLAIMARTTYEWTLLDFAAWAAGLVTVPVYPTSSVFQTRWILQDSGAVALATESAGQAAALGPELSRLPDLRHVWVFDKGHVERLAELGRDVQDQEVAVRRGVLGPDTLATLVYTSGTTGTPKGCALTHGNFFAEIDNAVELLYPIFKSKTKEEASTLLFLPLSHVFGRMVAVACVRARVRLGHAPSLTTEDLLADLASFRPTCLLAIPYMLEKVFNGARATAEKGGRASSFDRAVSVARKYGEAMETRQQGTGSGPSRGLKAGRALYDPLVYRRIRNALGGRVRYVICGGSPLGRPLAAFYAGAGIEIYEGYGLTETTGAATVTPPHKTRLGTVGWPLPGTRVRIAADGEILLSGGQVFRGYWDPHAGGVVPATPDGWFATGDIGRLDDEGHLTITGRKKEILITAGGKNVAPAPLENWLRSHPLISQALVVGDGRPYVTALLTLDPEGITHWRQMNGKHGVPPELLMDDEELFSVLQRAVDEANKLVSRPESIRRFAVLPVDFTEEAGHLTPSMKLRREAIARDFGREIEGMYAQ

SEQ ID NO: 14176 - DNA, 1926 bp, Streptomyces avermitilis
  CDS (1)..(1926)
atgcacaacttcgggctccctccgtcggccacgccggtcatgacgggagggctcgccgacagcgtcttcgagacggcgctcggcaatcccggactgccgcagatcgcccggcgctcccacgactccccgggcacctggacccaggtgagcgcggcccagttgcgcgacgaggtcgtcgacctggccaggggactcatcgcgtccgggatccgcccgggcaaccgagtggccatcatgtcgcgcacccgttacgagtggaccgtgctcagctgcgcgctgtggtcactgggcgccgagatcgtgcccctctatccgaactcgtcgcacgaacaggtcgcctggatcctcaaggacgccgactgcgtcggggtgctcgtcgaggacgaacagggcgtcatgacggtcgggtcggtgtgcgcggggctgccccggctgcgacacgtctggcagctggactccggctccctggacgaactggtcgagcggggccggccggtgccggccgcgacggtcgactcgctgcgccggatcgtgctgcccgactccaccgccgtcatcgcctacacctccggtacgagcggacaccccagggggtgcgcgctgagccatcgcagtctggccagcacctgcgacacgctgctggacggatggcggcacaccgcggcctcgcccggcgagcagccggccgtcctcgccttcctccccttctcccatgtgtacggcctcatggtccagggcctgtgcctgcggggcggcctgctgatggggcacgagcccgatctgcgcgcggagtccctggccgccgcgttccggtccttccgccccacctatctgtacgccgtgccctccgtcttcgagaagatctacaagagcttcctcacggcggccgagcgcacgggccggggcacgttgttcgagcgggccgcgcggacggcccaggactacgccgaagccgccgaacagcagcggctggggacggggccggggccgggcttcgacctgaagctccaacacgccttgtacgaaagggctgtgtaccgcaaactccgcgactcgctgggcggcaggatctgcggagccgtctcgggcggctcacccctcaaccgcgaactcaccctcttctacgcgggaatcgggatcatggtccacgacggctacggcctgaccgagaccagcgggggcatcaccgcccagcccgtgggccgggagaagttcggaaccgtggggcggcctctgcccggcacggacatccaggtcgccgaggacggcgagatcctggtccgcgggccatcggtgttccagggctacgtcaacgacatcccgggcacccgggcgtccctgcgcgacggctggctcgcgaccggcgacctcggccgcctcgactccgagggctatctgtcgatcacgggccgtaagaaggacaccatcgtcacgagcagcggcaagagcgtcgcgccgtcggtcctcgaagagcgacttcgggtgcatccgctgatccaccaggccgtgatcgtcggcgagaaccggccctgtgtgggcgccttgatcaccctggaccccgactatctgccgcactggcgcacgatggtggccgcccaggccgacgcgccgagccgggaggcacgcgagcagaacgcggtgctgcaggaggtcacgcgggccgtcgccgcggccaacagcttcgtctcgcgctccgaatccatccgcgtcttccgcatcctcccggagcccttcgacccagccaacggattgctcacgccctccatgaagctgcgcagggacgtgatcgtgcgccggtacgccaccgagatcgacgccatgtaccagtcgtcggcgcggacgagagtgaagtccctctcggacgaacccgtgagctgggaagagcacgaagagaacgaggacgacgtgttccggcgggtccggtag

SEQ ID NO: 14177 - protein, 641 aa, Streptomyces avermitilis
MHNFGLPPSATPVMTGGLADSVFETALGNPGLPQIARRSHDSPGTWTQVSAAQLRDEVVDLARGLIASGIRPGNRVAIMSRTRYEWTVLSCALWSLGAEIVPLYPNSSHEQVAWILKDADCVGVLVEDEQGVMTVGSVCAGLPRLRHVWQLDSGSLDELVERGRPVPAATVDSLRRIVLPDSTAVIAYTSGTSGHPRGCALSHRSLASTCDTLLDGWRHTAASPGEQPAVLAFLPFSHVYGLMVQGLCLRGGLLMGHEPDLRAESLAAAFRSFRPTYLYAVPSVFEKIYKSFLTAAERTGRGTLFERAARTAQDYAEAAEQQRLGTGPGPGFDLKLQHALYERAVYRKLRDSLGGRICGAVSGGSPLNRELTLFYAGIGIMVHDGYGLTETSGGITAQPVGREKFGTVGRPLPGTDIQVAEDGEILVRGPSVFQGYVNDIPGTRASLRDGWLATGDLGRLDSEGYLSITGRKKDTIVTSSGKSVAPSVLEERLRVHPLIHQAVIVGENRPCVGALITLDPDYLPHWRTMVAAQADAPSREAREQNAVLQEVTRAVAAANSFVSRSESIRVFRILPEPFDPANGLLTPSMKLRRDVIVRRYATEIDAMYQSSARTRVKSLSDEPVSWEEHEENEDDVFRRVR

SEQ ID NO: 14178 - DNA, 1848 bp, Nitrosomonas europaea ATCC 19718
  CDS (1)..(1848)
atgataggtaaggctggaatcgggacgatacttgatctgctgagagtacgtagtgcagctacacctgctgcaactgcatttcaggttttggttcagaataaaagttggcagccgaccaattgggagcagtttgtacaggccgcagggcgggttggtgcaaggttaacagattttggggtcaggaaaggtgatcatgttggtatcatggctgcaacatcacttgactgggaatatgcccaaatgggggcattgtttgcaggagccgttgttgctggaattgaccctgagtatccggcggaccagttaaatcatgtgatcgagaatcttgggttgtcagtcctgtttgttcagaatcgttcagtcttcgcaaaaattccattagaacttcgtcagcagatcagtgtatttattttctttgagggtgaatctcagcagaaaaatgaattcagcatgatcaatttactggtagagcaagaaactgatacttctatttgtttgccggatgtgttgccacaggatgaggcagtgatcgtattttcttctggtacaaccgggatgcccaaagcaattatctttacccatgaacaggttattatggcggttgaggccattatgcgggtatttaatgatttgagtagccagacgatacttttgtgctggttgccgttatcgaacctttttcagcgtattgtcaatttttgtgcaataaaaattggtgcatcgagttacatattgagtgatccgcgtgatttgatgcggtacgtcaaacaggtgaatccagatgttctgatcggtgtgccaaaggtacttgagcgagtgcattcgggggttgtcgaccatattgaaggtcgggtttggccattgcgtatgctggcgcgatgggcaattaggataggttacaagcgggctgcggcaaggagtgatcgaggtgattcttttggtctgatgaataaactgctatggaaacaggccgagaatatgtttttacgccgcctgcgaatggttttcggttcgcgggttcgttatctcgtcagtggatctgctgcgatgccggtttggctattgagatggtttgacgcaattggattaccggtatatgaagtttatggtattagtgagaatgttatccctgtcgcggtaaattcatctggcagccgtaaattgggggctgtgggtaaaccattattgccaaatgagataaagctcactatggatggtgagatccttgttcgaggcccaggagtgttcaagggttatcaggatagaaaggaagagagtaatttgcgtttttcaccagatggttattggcacactggtgatctgggagagctagatacagcaggatttctttctattgtcgggagaaagagcgatgttttcaaaacatctgcaggaaaatggattgctcctgtgagaattgaagaacgactgggacgtattgcttatgttgagcaaagtgtcgtatttcaatatgaatcaggcaaaattgttgctgtcattgtcgttgatttggagaaatgtgcacagaaaaccagtgcagtgcgctattctgaagtttcattacatatggaaaatatggctaagaataagcttcatcaaattctggagacagatatcaatgcagaattggaagatctgcctctttatcagcgaccggtttatgttgctgtgactgataagttttttacggtaagcggaggggagctaactgtcaatatgaaggtgcgtcgcagtattgttgcacagcggttttcagcgtacttcgaaaatactgtatgtaaatctgatcagggtcgggctgaaaacggtcatgtagttatgagtgggccaaccattttttttatatga

SEQ ID NO: 14179 - protein, 615 aa, Nitrosomonas europaea ATCC 19718
MIGKAGIGTILDLLRVRSAATPAATAFQVLVQNKSWQPTNWEQFVQAAGRVGARLTDFGVRKGDHVGIMAATSLDWEYAQMGALFAGAVVAGIDPEYPADQLNHVIENLGLSVLFVQNRSVFAKIPLELRQQISVFIFFEGESQQKNEFSMINLLVEQETDTSICLPDVLPQDEAVIVFSSGTTGMPKAIIFTHEQVIMAVEAIMRVFNDLSSQTILLCWLPLSNLFQRIVNFCAIKIGASSYILSDPRDLMRYVKQVNPDVLIGVPKVLERVHSGVVDHIEGRVWPLRMLARWAIRIGYKRAAARSDRGDSFGLMNKLLWKQAENMFLRRLRMVFGSRVRYLVSGSAAMPVWLLRWFDAIGLPVYEVYGISENVIPVAVNSSGSRKLGAVGKPLLPNEIKLTMDGEILVRGPGVFKGYQDRKEESNLRFSPDGYWHTGDLGELDTAGFLSIVGRKSDVFKTSAGKWIAPVRIEERLGRIAYVEQSVVFQYESGKIVAVIVVDLEKCAQKTSAVRYSEVSLHMENMAKNKLHQILETDINAELEDLPLYQRPVYVAVTDKFFTVSGGELTVNMKVRRSIVAQRFSAYFENTVCKSDQGRAENGHVVMSGPTIFFI

SEQ ID NO: 14180 - DNA, 1839 bp, Nitrosomonas europaea ATCC 19718
  CDS (1)..(1839)
atgaacccgacgacccacaccctgcccactcacaacctggacatgatttcggtcgaaacggcccgaacactcgacggcctgttcagagaacgtgtcagacgttctccccatgctacagcctaccgcgactacgatgtcagcgaggaaatctggcgggattacacgtgggacgacatggcgaatgccgtcaaacgctggcaaatggcactttcacaggaaaatctctctcctggtgaccgggtagcagtcatggcgcgcaactgcccgcagtgggtgatgtttgaacaggctgcactgggattggggctggtggtcgtcccgctttataccgaagatcgggcagaaaatgcggcctggtgtctggataatgcaggcaccgcgctactgctgctggaaaacatgacgcgatgggaagccatgaacgaggccatgaccggacttcagcaactgaagcgtatcgtcattctggatgcttccccggaagatgtacgccagacaggtgacaagcgcgccatcgccctgcaggactggctgccggaaacaccgggcgatatcccttccgtgcaaaacgaccctcatgtactggccaccatcatttacacgtcagggacgaccggccgcccgaaaggggtcatgctgagccacaacaatattctgtccaacgcatacagcagtgcacaggttgtcactgtcagaccggatgatgtactgctgtctttcctgccgctatcccatacgttcgaacgcacggcgggctattacgtacccatgctgtgcggtgccacggtagcgtatgcccggtccatccgccaattgcaggatgatctgctgatcatccggccgaccatcctgatttcggttcccagaatttatgaaagaatctatgcaggaatacaggccaaactggcggaagggcctgcaatttccagactgctgttcaaactggcggtcgatataggatacagccggtttgaacgacaacagaaacgagtcggctggcggatttcacacttgctgtggccgctgctcgataaactggttgcgcgcaaggtcatggaaaaactgggaggccgtttgtggcaggtcatgagtggcggtgcggcattatcaccggagatctcacgtgtcttcatcggcctgggattacctatcctgcaaggatacggcctgactgaaacgagcccggtcgtctgtgccaatcggttggacgataatctcccgtcaagcgtcggccgccctgctcccggtgtggaagtcaggctgggagaacagaatgccctgctgattcgcggacccaatgtcatgctcggctactggaacaatccggaagccactcatgccattctatccgcagacggatggctcaattccggagataccgccagtatcgatgcacaaagcagagtcaccatcaccggccggctgaaagacatcatcgttacctccaccggtgaaaaaatcccgccggccgatatggaggcagccattctgcgtgacccgatctttgaacaggtcatgatcgtcggtgaaggccgctcctatctgagcgcgctgacggtgctgagcaagcgcgggtgggaagttgtcgccacccactgcaatgcaaaaaatgatccccatgcactggcgtgcgacgagtatgcggaagaaatcattctggagaaaattgcgcgccagatcagcggatttcccggctatgccaaggttcaccgtgcattactgatttccgaaccctggacagtagagaatgaaatgctcactccaaccctcaagctgaagcggaaaaagatttatgagcactaccaaggtgaaatcgaccagctttatgccagccgttag

SEQ ID NO: 14181 - protein, 612 aa, Nitrosomonas europaea ATCC 19718
MNPTTHTLPTHNLDMISVETARTLDGLFRERVRRSPHATAYRDYDVSEEIWRDYTWDDMANAVKRWQMALSQENLSPGDRVAVMARNCPQWVMFEQAALGLGLVVVPLYTEDRAENAAWCLDNAGTALLLLENMTRWEAMNEAMTGLQQLKRIVILDASPEDVRQTGDKRAIALQDWLPETPGDIPSVQNDPHVLATIIYTSGTTGRPKGVMLSHNNILSNAYSSAQVVTVRPDDVLLSFLPLSHTFERTAGYYVPMLCGATVAYARSIRQLQDDLLIIRPTILISVPRIYERIYAGIQAKLAEGPAISRLLFKLAVDIGYSRFERQQKRVGWRISHLLWPLLDKLVARKVMEKLGGRLWQVMSGGAALSPEISRVFIGLGLPILQGYGLTETSPVVCANRLDDNLPSSVGRPAPGVEVRLGEQNALLIRGPNVMLGYWNNPEATHAILSADGWLNSGDTASIDAQSRVTITGRLKDIIVTSTGEKIPPADMEAAILRDPIFEQVMIVGEGRSYLSALTVLSKRGWEVVATHCNAKNDPHALACDEYAEEIILEKIARQISGFPGYAKVHRALLISEPWTVENEMLTPTLKLKRKKIYEHYQGEIDQLYASR

SEQ ID NO: 14182 - DNA, 2070 bp, Dictyostelium discoideum
  CDS (34)..(2037)
atttttatttttcattgtaatataattttataaatgtcaagcctttcaacaaaaacagatttacttggtgacccagattttatccgtcttcaaagtgttgaagtagacggtagtgaagttataccaggcgaaactagaccaagaagaaacactaaattcccaaaattaacaaattcaccagacggtaaaacctttaccttgtatgatgtttatagaataaataaagattcagattcaaactttttaggtattcgtgaattattagcagatggcaaaagaggtgattacaaatggatttcttataaacaagcatgcattagagcaaataacattggttcagctttagttcaattaggtttaaataagggtgatagaattggtattttttcaattaatagaccagaatgggttttatcagatatggcagcaatgaatcattcacttgtaccagttgcattatatgcaacattaggtgccaatgcaattgaatatgttgttaatcattcagagatttcagtacttttatgtgaaggtaaaaatgttgaaaagattctttcaatgccaggtacaaccattaaaacaattgtcagttatgatccattaccacaagcaacattagataaattcacggataatgaaaacgttaaactttacctcttatcagattttgaaaaattgggtgaacaaaatccagcccaacatgaagtcccatcaccagaagatttatgtacattactttacacctctggttcaactggtaatccaaagggtgtaatgttaactcatacaaatatggtcagtgaagttgcaggtgccaacttttcaccagcaggtgtaattccagaggatgttcatatgtcatacctcccattggctcactcatttgaacgtgccgtcgtttcattgatgtgttatgttggtggtcaaattggtttcttctctggtttaattccagagttattcaacgatatccaagttttacgtccaacctttttatgtggtgccccaagagtatggcaacgtcttcacgacaaactttggttcactgtcaacaatgatagttggttaaagaaattcctcttcaattggggtctcaactctaaacaatctgcattaagacttggttcaaccactccaatttgggataaattggttttctcaaaaacaaaggatagacttggtggtcgtgttaaattcatcctttccggttccgctccattggatccaaaattagccgaattcttacgtgcttgtttctgttgtccagtcgtctctggttatggtctctctgaaaatgtaggtggtgcctctgttgcctatccagaagataacaatgtaggtcatgttggtccaccactcagtgcctgtgaaatgaaattaatcgacgttccagagatgaactatttctctactgataaaccatgtccaagaggtgaggtttgtattcgtggtttcaacgttttcaaaggttactttaaggatccagaaaagaccaaagaagatctcaaagaagatggttggttccatactggtgatattggtcgttggaatgaaaatggtaccctctcaatcattgatcgtaagaaaaatatcttcaaattatctcaaggtgaatacgttgccgccgaatatttggaatctgttttcgttcgttcaccatttgcctctcaagtatttgtctatggtgattcattaaatagtttcttggttggtgttgtcgtaccagattttgaagttgtccaaaaattattcgcttccaaatatccagaacttgatgtttcaaaccatgcaaccctcgcaaaatcaaaagaactctacaaagaaattttatcaagtttcgatgcttgcgctgccgaagccaaattacatggttttgaaaaattaaaacatatctacgtagaacatgaaccattcactgaggaaaacaatttattaactccatcattcaaaccaaagagaccacaactcaaagaaagatatcaaaccattattgataccctttatgctgaatacaaacgtgatcatccagacgtataaatcttcttgtatttttttaaatctctattaatc

SEQ ID NO: 14183 - protein, 667 aa, Dictyostelium discoideum
MSSLSTKTDLLGDPDFIRLQSVEVDGSEVIPGETRPRRNTKFPKLTNSPDGKTFTLYDVYRINKDSDSNFLGIRELLADGKRGDYKWISYKQACIRANNIGSALVQLGLNKGDRIGIFSINRPEWVLSDMAAMNHSLVPVALYATLGANAIEYVVNHSEISVLLCEGKNVEKILSMPGTTIKTIVSYDPLPQATLDKFTDNENVKLYLLSDFEKLGEQNPAQHEVPSPEDLCTLLYTSGSTGNPKGVMLTHTNMVSEVAGANFSPAGVIPEDVHMSYLPLAHSFERAVVSLMCYVGGQIGFFSGLIPELFNDIQVLRPTFLCGAPRVWQRLHDKLWFTVNNDSWLKKFLFNWGLNSKQSALRLGSTTPIWDKLVFSKTKDRLGGRVKFILSGSAPLDPKLAEFLRACFCCPVVSGYGLSENVGGASVAYPEDNNVGHVGPPLSACEMKLIDVPEMNYFSTDKPCPRGEVCIRGFNVFKGYFKDPEKTKEDLKEDGWFHTGDIGRWNENGTLSIIDRKKNIFKLSQGEYVAAEYLESVFVRSPFASQVFVYGDSLNSFLVGVVVPDFEVVQKLFASKYPELDVSNHATLAKSKELYKEILSSFDACAAEAKLHGFEKLKHIYVEHEPFTEENNLLTPSFKPKRPQLKERYQTIIDTLYAEYKRDHPDV

SEQ ID NO: 14184 - DNA, 2313 bp, Homo sapiens
  CDS (94)..(1962)
agtgggctggttcgctctgcggccgggcccctcccccgcccgggagcttggcggttccgataccgcgagtttgtcctctcacttctggagaagatgcagacacaggagatcctgaggatactgcgactgcctgaactaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagcgaatcaccaggctcctgtgcccccgcagcctgatgacctctccattgtgtgtttcacaagcggcacgacagggaacccaaagggtgcgatgctcacccatgggaacgtggtggctgatttctcaggctttctgaaagtgacagagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagagaaaaaaaaaaaaaaaa

SEQ ID NO: 14185 - protein, 622 aa, Homo sapiens
MQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQANHQAPVPPQPDDLSIVCFTSGTTGNPKGAMLTHGNVVADFSGFLKVTEGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 14186 - DNA, 1710 bp, Xylella fastidiosa
  CDS (1)..(1710)
atgagtcaaacacgtccttggctgcaacactatccatcgggaatctcaatagagattgatactaacgctttccgtactatcgctgatgtcttcaatacatcagtcatcaaatatcgtcattgtcccgcctataccaatttcgggaaaacacttacctacggcgaagtcgatctattaacaaaacaattcgccagctatctgctcaatgtgttgaaactcaaaaagggcgaccgaatcgcactgatgatgctcaactgtttgcaatatccagtagcgaccttcggcgcactatgcgccgggttaactgttgtcaatgtcaaccccctctacacagcgcgcgaactcaagcaccaactggttgacgcagggagcactgtattggtggtcatggacaacttctgtacaactgtgcagcagatcattgctgacaccccaatcaaacaggtgattacgactgaattaggcgacctgctcgatttccccaaaagatcactgatcaattttgccgtcaagcacatcaaaaaattagtgccggaataccaactgcctcgctcaatccgcttccgtgaagcactcgcgctgggaagcaagcattccatgcctccaatccacatcgcaagcgacgatttagcttttctacaatacaccggcggcacaacggggacacccaaaggcgcaatgctgacccacagaaatatggtcgcgaatatgcagcaggtgtcgcagtggctccaaacaaacaacagtctcaaagaaggctgtgaaacagtgctcactgctctaccgctgtatcacatttttgtgttaaccgcgaacagcttagtctttatgaaaatcggtggttgcaaccatctgattagcaatccacgcaacatgcgaacattcgtcaaagagttgcaacgcgtccgcttcactgtcatcactggagtcaacacactgttcaataaactccttaacaccccgggcttcgacaaacttgatttctcttctctgaagattgccctgggtggcggcatggtgatccagcgctccgtcgccgaacagtggaagcaagttactcgtgttccgctgattgaagcttacggacttaccgaggcatcaccagcggcatgcatcaatccgctgaatctgcaagaacataacggttcgatcggtatgccgatccctagtactgatgtctgtattaaagatgacaccaacaccgtattacctataggcgaaatgggcgaactgtgtattaaaggtccgcaagtgatgaaaggctactggcaacgcccagaagaaacttcagaagtgttagatgcagacggttggctgcatactggggacattgtcaaaatggacaaacaagggtttctgtacatcatcgaccgtaagaaagaaatcattcttgtctctggcttcaacgtctatccgaaggaaatcgaagaagtcattgcaatgatcccaggcgtggctgaagtcgctgcggtcggagtcccggacgagcagtccggcgaagtcgttaaggtagtgattgtcaaaaaggatcccatgctgaccgctgaggaagtaaaggcgcatgctgcgaccaacctgaccagatacaagctaccacgcatcattgagttccgtgcgacactccctaaaaccgatgttggcaagattttgcggcgcgaattgcgagacgcagcaccggcatcaaacacattcacagctcagcccaagtag

SEQ ID NO: 14187 - protein, 569 aa, Xylella fastidiosa
MSQTRPWLQHYPSGISIEIDTNAFRTIADVFNTSVIKYRHCPAYTNFGKTLTYGEVDLLTKQFASYLLNVLKLKKGDRIALMMLNCLQYPVATFGALCAGLTVVNVNPLYTARELKHQLVDAGSTVLVVMDNFCTTVQQIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTNNSLKEGCETVLTALPLYHIFVLTANSLVFMKIGGCNHLISNPRNMRTFVKELQRVRFTVITGVNTLFNKLLNTPGFDKLDFSSLKIALGGGMVIQRSVAEQWKQVTRVPLIEAYGLTEASPAACINPLNLQEHNGSIGMPIPSTDVCIKDDTNTVLPIGEMGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPASNTFTAQPK

SEQ ID NO: 14188 - DNA, 1542 bp, Vibrio parahaemolyticus
  CDS (1)..(1542)
atgatgaaccttgctgctgccttgcagagaaatgctgtaagtaaaccgaataaaacggccttgatatgtggtgataaaaaattcacatacgcagaatttgacgcgattgcaggtaagatcgcgacttcgatgattaaagcgggcgtcaaaccgggagaccgagtggcgttatcgtgcccgaatttgcctttctttcctttcgtttattttgcggttcagaaggcgggtgccgttaccgttccgctgaacgtgttgctcaaatctagagaaatcaaataccacctagaagattcgaaagcgaagttttacttttgttttgaaggaacgcccgaactgccaatggcgaaagaaggcatgaaagcgtttaaagaggtggatgcgtgtgaaacgatgatcgtaatgacgcaagatcaaacgcaaaaagagtaccaaggtttaccgacactgacgtcttttatagaagatatcgaacctttggcggattacgttgctcgcgatgcggatgacacttgtgtgattttgtatacatcaggcacaacgggactgcccaaaggagcagagctcacgcagcaaaacatcgtaatgaatgcgcttgtggctcagaacatcatggcgagtcaggctgatgatgttcatctagtaacgctgccactgtttcatacattcggtcaaaccgtgcatctcaatgctagcgtgcaaagcggtgcaactttggttttagtacctcgatttgatccgaaacatgtgttggagctgatcgaaaagcatcgagtgacactctttgccggtgtccctacgatgtacattggtttgctgcatgttgaacataattgcgatatttcgtcgctacgggtagccgttagtggaggctcgtcactaccgacagaagtatttaagacctttgaagcacgattcaatgtaccaattctagaaggttacggcttgtccgaaaccagtccgatagcgtgttttaatcaccttgatcaagagcgagtaccgggctctgtcgggcaaccgattcaaggtgttgaggtgaaagtcgttgatcttgacggtcatactctccctgtcggtgaggaaggagaaattattgtgcgcgggcacaacgtaatgaaaggttatcttgatcgcccagaagtgacggaatcggtgttgcaaagtggttggttccataccggtgacgtcgggcgatttgatgagtcgggtaatctgtttattgtcgacaggatgaaagacctgatcattcgaggtggcttcaatgtgtatcctcgtgagattgaagaagtattcatgacgcatcctgcggtagcgatggtggccgtgataggtattccgcatcaagaatatggcgaagagatcaaagcctacgtggtactaaaaccaaatcaatttgtcgaagccgatgagctgcaattatgggggcgagagcagttagccaatttcaaatacccaaggtttgtcgaaattcgtgaacagttaccgatgagtgctacgggtaagatcttaaagagagagctaaaatcggaactcgaagtcgcataa

SEQ ID NO: 14189 - protein, 513 aa, Vibrio parahaemolyticus
MMNLAAALQRNAVSKPNKTALICGDKKFTYAEFDAIAGKIATSMIKAGVKPGDRVALSCPNLPFFPFVYFAVQKAGAVTVPLNVLLKSREIKYHLEDSKAKFYFCFEGTPELPMAKEGMKAFKEVDACETMIVMTQDQTQKEYQGLPTLTSFIEDIEPLADYVARDADDTCVILYTSGTTGLPKGAELTQQNIVMNALVAQNIMASQADDVHLVTLPLFHTFGQTVHLNASVQSGATLVLVPRFDPKHVLELIEKHRVTLFAGVPTMYIGLLHVEHNCDISSLRVAVSGGSSLPTEVFKTFEARFNVPILEGYGLSETSPIACFNHLDQERVPGSVGQPIQGVEVKVVDLDGHTLPVGEEGEIIVRGHNVMKGYLDRPEVTESVLQSGWFHTGDVGRFDESGNLFIVDRMKDLIIRGGFNVYPREIEEVFMTHPAVAMVAVIGIPHQEYGEEIKAYVVLKPNQFVEADELQLWGREQLANFKYPRFVEIREQLPMSATGKILKRELKSELEVA

SEQ ID NO: 14190 - DNA, 1689 bp, Pseudomonas syringae pv
  CDS (1)..(1689)
atgcaagctgatttctgggatgacaagcgtccggcgggtgtcgattccaacgtggatctacaggcctatcaatcggtcatcgacgtgtttgaacgctgctgcaagaagttcgcggaccgacctgcgttcagcaacatgggcgtgaccctgacttatgccgagcttgatcgtcattcagccgcgttcaccgcttatctgcaacagcacacgcaactgatgccgggtgaccgtatcgccgtgcagatgcccaacctgctgcaataccccattgctgtattcggtgccatgcgtgccggtctgatcgtggtcaacaccaacccgttgtacaccgcgcgcgagatgcgccatcagttcaaggactcgggtgccaaggcactggtctacctcaatatgttcggcaagctggtgcaggaagtgctcccggacaccgccatcgaacatttgattgaagtgaagatgggcgacatgcagtcggcggccaaggggtggctggtcaacatcattgttgacaaggtcaagaagctggtcccgccattccggttgccccaggctgtcggcttcaagcgggcactgcaactggggcgtgacagccgggtgcaggccgtggcgcaaaccctcgacgacgtcgccgtgctgcaatacaccggtggcaccacggggctggccaagggtgcgatgctgacgcatggcaatctggtcgccaacatgcagcaagtctatgcctgcatgcgccaggaccgtcccgagggtggtccagtgtttgaggagggctcggaggtgatgattgcgccgctgccgctttatcatatctatgcattcacggcgaactgcatgtgcatgatgatcagcggcaaccacaacatcctgattaccaacccgcgtgacatcgccggcttcatcaaagaactgggcaagtggaagttcaccgccatgatcggtctcaatacgctgttcgtggcgctgatgaaccatcccgagttcaaaaagctggatttctcggcgctgaaaagcacaaactcaggcggcactgcgctggtcaaggccacggccgagcgctgggcgcagatcaccggctgcacgattgtcgagggctacggcctgactgaaacgtcgcctgtggccagcgccaacccttatggaacgcaggcgcgtctgggtacggtcggtattccggtgcccggcactgccatgaaagtcatcgatgacgagggcgtggagcttgcgttcggcgagcgcggcgaattgtgcatcaaggggccgcaggtcatgaaaggctactggaatcgtccggatgccacggccgaagcactcgacgccgaaggctggttcaagactggcgacattgccgtgatagctgccgacgggttcgtcagtatcgtggatcgcaaaaaggacctgatcatcgtttcaggtttcaacgtctaccccaacgaaatcgaagacgtgatcatgactcattccaaggtggccaactgcgcctgcatcggcgtgccggacgagcgctccggcgaggcggtgaagctgtttgtcgtgccgcgggacccaagcgtgagcgttgaagaactcaaggcgttctgcaaagagaatttcaccgcttacaaggtgcccaagcttattgttctgcgcgattcgttgcccatgacaccggtgggcaagattttgcgcagggagcttcgcgacccggcctga

SEQ ID NO: 14191 - protein, 562 aa, Pseudomonas syringae pv
MQADFWDDKRPAGVDSNVDLQAYQSVIDVFERCCKKFADRPAFSNMGVTLTYAELDRHSAAFTAYLQQHTQLMPGDRIAVQMPNLLQYPIAVFGAMRAGLIVVNTNPLYTAREMRHQFKDSGAKALVYLNMFGKLVQEVLPDTAIEHLIEVKMGDMQSAAKGWLVNIIVDKVKKLVPPFRLPQAVGFKRALQLGRDSRVQAVAQTLDDVAVLQYTGGTTGLAKGAMLTHGNLVANMQQVYACMRQDRPEGGPVFEEGSEVMIAPLPLYHIYAFTANCMCMMISGNHNILITNPRDIAGFIKELGKWKFTAMIGLNTLFVALMNHPEFKKLDFSALKSTNSGGTALVKATAERWAQITGCTIVEGYGLTETSPVASANPYGTQARLGTVGIPVPGTAMKVIDDEGVELAFGERGELCIKGPQVMKGYWNRPDATAEALDAEGWFKTGDIAVIAADGFVSIVDRKKDLIIVSGFNVYPNEIEDVIMTHSKVANCACIGVPDERSGEAVKLFVVPRDPSVSVEELKAFCKENFTAYKVPKLIVLRDSLPMTPVGKILRRELRDPA

SEQ ID NO: 14192 - DNA, 1932 bp, Bradyrhizobium japonicum USDA 110
  CDS (1)..(1932)
atgatggattatgcaggccgcgtcgcgcaggccgatacctatcccaaaatgctccggctcaacgccagggagcatggccacgagattgcgctgcgcgaaaaggatctcgggctgtggcgtgtcttcacctggaacgactaccagacgcgcgtgcgcgatttcgcgctcggcctcgtcgagctcggccttggccacaacgacgtcatcggcatcatcggcgacaaccggccggactgggtcgccgcggaaatcgccacccacgcgatcggcggcctgagcctcgggctctaccgcgacgtgctggacgaagaggcctcctatctcctcaattacggcgaggcgcagctggtcttcgccgaggatgaggagcaggtcgacaagttgctcaccctcgccgaccgcgtgccgcggctgaagcacatcatctattccgacccgcgcggcatgcggaaatatgacgaccccaggctgctgtcggcggagaaattcgccgagctcggccgcgcccgcgctgcgcgcgagcctgggctttacgacaagctcgtcgacgcgaccaagggcgaggatgtcgcgatcctctgcaccacgtcaggcaccacctcgcatccaaaactcgcaatgctcgccgccggccgcgtgctcggccattgcgcgacctatctggccttcgatccgaagggacccgacgacgaatacgtctcggtgctgccgctgccgtggatcatggagcaggtctatgtgctcggcaaaggcctcttgtgccggatgaagatcaacttcgtcgaagagcccgacacgatgatgaacgatctgcgcgagatcgccccgaccttcgtgctgttcgccccgcgcgtctgggaatcgatcgccgccgacgttcgcgccaaggtgatggacgccacgcccttcaagcagcgcctgttcgatatcgggatgaagtcgggcctggccgcgcttgcagacggcaagcgctcgggttttgccgacgccatcctgtttcgcgcgctgcgcgaccggctcggcttcacccgcctgcgctcggctgcgaccggcggtgcggcgctcgggcccgataccttcaagttcttccaggcgatgggcgtgccgctgcgcacgctctacggccagaccgagctgttgggagcctacacgctgcatcccgagggcaaggtcgatcctgacaccacgggcgtgccgatggccgacagcgtcgagatccgcatcgacaatgccgacgtccacggcgtcggcgagatcgtggtgcggcatcccaacatgttcctcggctattacaagaacccggaggcaagcgttgccgacgtcaaggacggctggatgctgtcgggcgatgccggctatttcaacgccaaccggcagctcgtcgtcatcgaccgcatcaaggatctcgccgagacctcgcgcggcgagcgcttctcgccgcaattcatcgagaacaagctgaaattctcgccctatatcgccgaagccgtggtgctcggcgcgggccgcgacgcgctcgcggcgatgatctgcatccgctactccatcatctcgaaatgggcggagaagaaccgcctctccttcacgacctacagcgacctcgcctcgcggcccgaggtttacacgctgctccagaaggaggtcgagaccgtcaacgccacgctgccgccggcgcagcgcatctcgcgcttcctgctgctctacaaggagctcgatgccgacgacggcgagctcacccgcacgcgaaaggttcgccgcagcgtcatcaacgagaaatacgccggcatcatcgacgcgatctaccgcggcgatgccgacatccccgtcgacgccgtgatccgcttccaggacggcaccacgcagagggtgcgcaccacgctgcgggtggtggatctgggccgacccgggcaattggcggaggcggcggagtga

SEQ ID NO: 14193 - protein, 643 aa, Bradyrhizobium japonicum USDA 110
MMDYAGRVAQADTYPKMLRLNAREHGHEIALREKDLGLWRVFTWNDYQTRVRDFALGLVELGLGHNDVIGIIGDNRPDWVAAEIATHAIGGLSLGLYRDVLDEEASYLLNYGEAQLVFAEDEEQVDKLLTLADRVPRLKHIIYSDPRGMRKYDDPRLLSAEKFAELGRARAAREPGLYDKLVDATKGEDVAILCTTSGTTSHPKLAMLAAGRVLGHCATYLAFDPKGPDDEYVSVLPLPWIMEQVYVLGKGLLCRMKINFVEEPDTMMNDLREIAPTFVLFAPRVWESIAADVRAKVMDATPFKQRLFDIGMKSGLAALADGKRSGFADAILFRALRDRLGFTRLRSAATGGAALGPDTFKFFQAMGVPLRTLYGQTELLGAYTLHPEGKVDPDTTGVPMADSVEIRIDNADVHGVGEIVVRHPNMFLGYYKNPEASVADVKDGWMLSGDAGYFNANRQLVVIDRIKDLAETSRGERFSPQFIENKLKFSPYIAEAVVLGAGRDALAAMICIRYSIISKWAEKNRLSFTTYSDLASRPEVYTLLQKEVETVNATLPPAQRISRFLLLYKELDADDGELTRTRKVRRSVINEKYAGIIDAIYRGDADIPVDAVIRFQDGTTQRVRTTLRVVDLGRPGQLAEAAE

SEQ ID NO: 14194 - DNA, 1686 bp, Bradyrhizobium japonicum USDA 110
  CDS (1)..(1686)
atggagcgcatctggcttaagcaatatccgcccggcgtgcccgccgatatcgagccgacgcaatacgcatcgctggtcgaccttctggaggagagcttcgccaagttcgccgaccgcaaggcgttcatctgcatggacaagtcgatcagctaccgcgacctcgaccagatgtcggttgcgctggccgcctatctgcaaggccgcggactccagcgcggcgctcgcgtcgccatcatgatgccgaacgtgctgcaatacccgatcgccaccgccgcggtgctgcgggccggctttgcggtggtcaacgtcaatccgctctacacgccgcgcgagctcgagcatcagctcaaggattccggcgccgaagccatcatcgtgctggagaactttgcccacaccgtcgagcaggtgatcactaagacatcggtaaagcacgtcatcgtcgccagcatgggcgacctgctcggcttcaagggcgtgatcgtcaacctcgtcgtccgccgcgtcaagaaaatggtaccggcctggtcgctgccgggcgcggtgtccttcaacgacgcgctgtcggccggccgcggcttgacattcaacaagccgaaactgtcgccgggcgacgtcgccttcctgcaatataccggcggcaccaccggcgtctccaagggcgcgaccctgctccaccgcaacatcgtcgccaacgtcttgcagaacgatgcctggctccagccggcgctcgccgcgcctccgcatgtcgaccagttgatgatcgtctgcgcgctgccgctctatcacatcttcgcgctgacggcctgctacctgctcgcggtgcgcgccggcggctgcaatctcctgatccccaacccgcgcgacatcgcgggcttcgtcaaggagctggcgaagtaccaggtcaacagcttcccggccgtcaacacactgtacaacggcctgatgcaccatccggacttcaagaagctcgacttctccaagctgaagatctccaatggcggcggcatggccgtgcagcgccccgtcgccgagcagtggaaggcggtgaccggctgcttcatcgccgaaggctatggtctgtcggagacctcaccgacgctgacctgcaatccggcaaccacgaacgatttctccggctcgatcggcatccccgtgccctcgacctatatttccatccgcgacgacgacggcaatgaagtgccgctcggccaggcgggcgagatctgcgccaagggcccgcaggtgatgtcgggttactggaacaggccggaagagaccgccaaggtgatgaccgcggacggctatttccgcaccggcgacatcggcgtgatggacgagaagggctacaccaagatcgtggaccgcaagaaggacatgatcctggtctccggcttcaacgtctatccgaacgagatcgaggaagtgatcgcgagccatccgggcgtgctcgaatgcgccgtgatcggcatccccgattccaaatcgggcgaagcggtgaaggccttcgtggtgaagaaggaccaaaacctcaccgccgaagccgtgatcaagttctgtcacgagcagctcaccggctacaaggtgcccaagcacatcgaattccgcaccgacctgccgaagaccaacgtcggcaagatcctgcgccggcagctccgcgacgagaagaaggcggaggcggcgtaa

SEQ ID NO: 14195 - protein, 561 aa, Bradyrhizobium japonicum USDA 110
MERIWLKQYPPGVPADIEPTQYASLVDLLEESFAKFADRKAFICMDKSISYRDLDQMSVALAAYLQGRGLQRGARVAIMMPNVLQYPIATAAVLRAGFAVVNVNPLYTPRELEHQLKDSGAEAIIVLENFAHTVEQVITKTSVKHVIVASMGDLLGFKGVIVNLVVRRVKKMVPAWSLPGAVSFNDALSAGRGLTFNKPKLSPGDVAFLQYTGGTTGVSKGATLLHRNIVANVLQNDAWLQPALAAPPHVDQLMIVCALPLYHIFALTACYLLAVRAGGCNLLIPNPRDIAGFVKELAKYQVNSFPAVNTLYNGLMHHPDFKKLDFSKLKISNGGGMAVQRPVAEQWKAVTGCFIAEGYGLSETSPTLTCNPATTNDFSGSIGIPVPSTYISIRDDDGNEVPLGQAGEICAKGPQVMSGYWNRPEETAKVMTADGYFRTGDIGVMDEKGYTKIVDRKKDMILVSGFNVYPNEIEEVIASHPGVLECAVIGIPDSKSGEAVKAFVVKKDQNLTAEAVIKFCHEQLTGYKVPKHIEFRTDLPKTNVGKILRRQLRDEKKAEAA

SEQ ID NO: 14196 - DNA, 1806 bp, Bacteroides thetaiotaomicron VPI
  CDS (1)..(1806)
atgacttatcatcatttatctgtcttggtccaccgtcaggctgaaaagtatggcgacagggtagcattgagataccgcgactatgagacagcacaatggattccgattacctggaatcaattctccggaactgtacgacaggctgctaatgctttcgttgcgctaggagtggaggaacaagagaatatcggtattttttcacagaataaacctgaatggttctatgtcgatttcggcgcatttgccaatcgtggggttactattccgttctatgcaacgagttcacccgcacaggcacaatacattatcaacgatgcgcaaatccgttatctttttgtaggcgaacagtatcagtatgattctgcattcagcatcttcggcttttgttcctcgttacaacaactgattattttcgatcgttcggtagtaaaagacccgcgtgatgtctcttccatctattttgatgagtttatggcaatgggcgaaggattgccgcataatgaggtggtggaagaacgtaccgcacgtgcttcttacgatgatctggctaacatcctttatacttccggtacgacgggagagccgaagggagtaatgttgcatcattcgtgctatctggagcagttccatacgcatgacgagcgtctgacgacaatgaccgacaaggacgtttctatgaacttccttccgttgacacacgtattcgagaaggcatggtgctatctttgtattcataaaggagtacagatctgcatcaatcttcgtccggcagatatccagacaaccattaaagaaattcgtccgacactgatgtgcagcgtaccccgtttctgggaaaaggtatatgccggtgtacaggagaagatcaatgaaacgacaggattgaagaaggcgctgatgctggatgccatcaaagtcggcagaatccataatctggattatcttcggttgggaaagacccctccggtgatgaatcaactgaaatataagttctacgagaagactatttattctttgctgaagaagacgatcggtattgagaatggaaatttctttccgacagccggtgcagccgtgcccgatgaaatcaatgaatttgttcattcggtaggaatcaacatggtggtcggctatggactgacagaatctacggctacggtatcatgtactttgccggtaggttatgatatcggttcggtaggtgtggtattgccgggactggaagtgaagataggcgaagacaatgaaatcctgctccgtggaaaaagtataaccaaaggatattataaaaaggcggaagctactgccgctgctatcgatgctgacggctggttccatacaggcgatgcaggttatttcaagaatgggcagttattcctgacagagcgcattaaggatttgtttaagacgtcgaatggtaaatatattgctccgcaagcattggaaaccaaactggtgatagatcgttatattgaccagatcgctattatcgcagatcagcggaagtttgtttctgccttgatcgttccggtgtacgggtttgtcaaggactatgcgaaggagaaaggaatcgaatacaaagatatggccgaactgttgcagcacccaaagattgtcggtctgttccgtgcacggatagagaccttgcaacagcaatttgcgcattatgaacagatcaaacgcttcacattacttcctgaacctttcagcatggagcgtggagaattgactaatacattgaagttgaaacgctcagtggtttctgaaaactacaaagaactgattgagaagatgtacgaagaataa

SEQ ID NO: 14197 - protein, 601 aa, Bacteroides thetaiotaomicron VPI
MTYHHLSVLVHRQAEKYGDRVALRYRDYETAQWIPITWNQFSGTVRQAANAFVALGVEEQENIGIFSQNKPEWFYVDFGAFANRGVTIPFYATSSPAQAQYIINDAQIRYLFVGEQYQYDSAFSIFGFCSSLQQLIIFDRSVVKDPRDVSSIYFDEFMAMGEGLPHNEVVEERTARASYDDLANILYTSGTTGEPKGVMLHHSCYLEQFHTHDERLTTMTDKDVSMNFLPLTHVFEKAWCYLCIHKGVQICINLRPADIQTTIKEIRPTLMCSVPRFWEKVYAGVQEKINETTGLKKALMLDAIKVGRIHNLDYLRLGKTPPVMNQLKYKFYEKTIYSLLKKTIGIENGNFFPTAGAAVPDEINEFVHSVGINMVVGYGLTESTATVSCTLPVGYDIGSVGVVLPGLEVKIGEDNEILLRGKSITKGYYKKAEATAAAIDADGWFHTGDAGYFKNGQLFLTERIKDLFKTSNGKYIAPQALETKLVIDRYIDQIAIIADQRKFVSALIVPVYGFVKDYAKEKGIEYKDMAELLQHPKIVGLFRARIETLQQQFAHYEQIKRFTLLPEPFSMERGELTNTLKLKRSVVSENYKELIEKMYEE

SEQ ID NO: 14198 - DNA, 1674 bp, Bacteroides thetaiotaomicron VPI
  CDS (1)..(1674)
atgattaaagagaatttcattaaactatacgaaaatagttttcgggaaaattgggatttaccttgctataccgattatggtgaatccgttcattatacttatggccaggtagccggagaaatcgcccgtatgcacctgcttttcaaacattgcagcctgcgcagaggagataaaatagccgttatcggcaaaaataatgcccactggtgcatcgcctacatggcaaccatcacctacggagccatcatcgtccctatcctgcaagactttacgcccaacgatgtgcatcatatcgtcaaccattccgagtccgttttcctctttaccagtgacagcatctgggaaagcctggaagaagaaaagctgaccggactgcgcggagttttttcgctcaccgacttccgctgcctctatcagcgggacggagaaactattcagaagtttctggtacacctcaatgatgaaatgtacgccgcctatccgaaaggattcacgcgcgaggacattcaatacactacgttatccaatgataaggtaatgctgctgaactacacatcgggaactaccggcttcagcaaaggggtaatgctgacgggcaacaatcttgccggcaatgtcactttcggcatccgcaccgagttacttaaaaaaggagataaagtgctttctttcctgccactggcacacgcctacggttgcgctttcgactttctgactgcaactgctgtcggaactcatgtcaccctgctcggtaaaacgccttctcccaaaattatcatgaaggcttttgaggaagtaaaaccgaacctgatcatcactgttccgctggtcatcgagaaaatatataaaaatgtcattcagccgctcattaataagaaaggtatgaaatgggcattaaacattcctttgctcgacacccagatttataatcagatacggaaaaagctgatagacgccttaggcggacgtttcaaagaaatcatcatcggaggcgctgccatgaatcaggaagtggaagagttcttctacaaaataaagttccctttcaccatcggttatggtatgaccgagtgcggaccactgatcagctatgctccctggaatgaatttattttaggctcttccggcaaagtgctggatatcatggaggcacgcatctataaagaaaatccggaagcggaaaccggagagattcaggtacgtggtgaaaacgtgatggtgggatattataagaatccggaagccacgcaggaagtgtttaccgaagacggctggctgcgcaccggcgaccttggtactatggacgccagcggaaatatcttcatccgcggacgactcaaaagcatgattctgagttcgagcggacagaacatcttccccgaagagctggaagccaaactcaataacctgccattcattcttgaaagcctcgtcatcgaacgcaacaagaaactggtggcactggtctatgcggattacgaagcgctggattctctcggattgaacaatccggataacctgaaaaccatcatggatgaaaatctgaagaacttaaataataatgtagctgcgtatgaaaaagtcagcaagattcagctttatcctacggaatttgagaaaaccccgaaaagaagcatcaaaaggtatctatataacagtatagctgtcgattag

SEQ ID NO: 14199 - protein, 557 aa, Bacteroides thetaiotaomicron VPI
MIKENFIKLYENSFRENWDLPCYTDYGESVHYTYGQVAGEIARMHLLFKHCSLRRGDKIAVIGKNNAHWCIAYMATITYGAIIVPILQDFTPNDVHHIVNHSESVFLFTSDSIWESLEEEKLTGLRGVFSLTDFRCLYQRDGETIQKFLVHLNDEMYAAYPKGFTREDIQYTTLSNDKVMLLNYTSGTTGFSKGVMLTGNNLAGNVTFGIRTELLKKGDKVLSFLPLAHAYGCAFDFLTATAVGTHVTLLGKTPSPKIIMKAFEEVKPNLIITVPLVIEKIYKNVIQPLINKKGMKWALNIPLLDTQIYNQIRKKLIDALGGRFKEIIIGGAAMNQEVEEFFYKIKFPFTIGYGMTECGPLISYAPWNEFILGSSGKVLDIMEARIYKENPEAETGEIQVRGENVMVGYYKNPEATQEVFTEDGWLRTGDLGTMDASGNIFIRGRLKSMILSSSGQNIFPEELEAKLNNLPFILESLVIERNKKLVALVYADYEALDSLGLNNPDNLKTIMDENLKNLNNNVAAYEKVSKIQLYPTEFEKTPKRSIKRYLYNSIAVD

SEQ ID NO: 14200 - DNA, 1665 bp, Bacteroides thetaiotaomicron
  CDS (1)..(1665)
atggaacaagaacatcagttcattgattatattgaacagagcatcattaaaaactgggataaagatgcattgacagactacaaaggaatcacgcttcaatataaggatgtagcgcgcaagatagccaagtttcacattgtattggaaagtgccggtatccagccaggagataaaatagcagtctgcggccggaacagtgcccattggggagtcaccttcttagccactatcacttacggagccgtcatcgttcctattctgcatgagttcaaagcggataatattcacaatatcgtcaatcactccgaagccaaattactctttgtcggcgatcaggcatgggaaaatctgaatgaagacgcaatgccgctactggaaggtatcgcttcactcaccgatttcactgcattggtatcgcgcaacgagaaactgacttacgccttcgaacaccggaacgctatttacggtcagcgttatccgaagaatttccgccccgaacatatctgttaccggaaggaccgtccggaagaactggctatcatcaattatacctccggcactaccggatattccaaaggagtcatgctcccctaccgcagtatttggtcgaacgtggcatactgtttcgagatgcttcccgtgaaagcgggcgatcacatcgtttccatgcttccgatgggtcatgtattcggcatggtatacgatttcttatatggtttctctgccggagcgcacatttacttcctgacacgtatgccgtctccgaagattattgcgcagtcttttgcagaaataaagccaagagtgatctcctgtgtacctttgatcgtagagaaaattatcaaaaaagatattcttccgagagtggacagcaaaatcggtaaactattgcttaaagtgcccattgtaaacgataaaatcaaatcgttggcgcggcaggctgctatggaaatcttcggtgggaacttcgatgaaatcattatcggtggtgctcctttcaatgccgaagtagaagcgttcctcaaaaagataggctttccctacaccatcgcttacggtatgaccgaatgtggcccgattatttgctccagccgttgggaaacactgaaactggcttcctgcggcaaggcaaccacccgaatggaagtccgcatcgactcgcccgaccctaaaacacatgccggagaaatcgtatgcaggggaatgaatatgatgctgggatattataaaaatccggaagcgacggcacaaattattgatgccaacggatggcttcacacgggtgatttaggaacaatcgacgacgaaggatatgtgacagttcgcggtcgtagcaagaatctgcttctgacttccagcggacagaatatctatccggaagagatagaaagcaaactgaataatatgccttatgttgccgagtcactgatcgttttgcagcacgacaagttggtcgcactgatttatccggactttgacgatgcttttgcccatggcttgcaacaggccgatatcataaaagttatggaagccaatcgtgttgaactgaatcagcagcttcccaattattctcagataagcaaagtcaaaatccatttcgaggaatttgaaaagactgcgaagaaatcaatcaaacgctttatgtatcaggaagcaaaaggataa

SEQ ID NO: 14201 - protein, 554 aa, Bacteroides thetaiotaomicron
MEQEHQFIDYIEQSIIKNWDKDALTDYKGITLQYKDVARKIAKFHIVLESAGIQPGDKIAVCGRNSAHWGVTFLATITYGAVIVPILHEFKADNIHNIVNHSEAKLLFVGDQAWENLNEDAMPLLEGIASLTDFTALVSRNEKLTYAFEHRNAIYGQRYPKNFRPEHICYRKDRPEELAIINYTSGTTGYSKGVMLPYRSIWSNVAYCFEMLPVKAGDHIVSMLPMGHVFGMVYDFLYGFSAGAHIYFLTRMPSPKIIAQSFAEIKPRVISCVPLIVEKIIKKDILPRVDSKIGKLLLKVPIVNDKIKSLARQAAMEIFGGNFDEIIIGGAPFNAEVEAFLKKIGFPYTIAYGMTECGPIICSSRWETLKLASCGKATTRMEVRIDSPDPKTHAGEIVCRGMNMMLGYYKNPEATAQIIDANGWLHTGDLGTIDDEGYVTVRGRSKNLLLTSSGQNIYPEEIESKLNNMPYVAESLIVLQHDKLVALIYPDFDDAFAHGLQQADIIKVMEANRVELNQQLPNYSQISKVKIHFEEFEKTAKKSIKRFMYQEAKG

SEQ ID NO: 14202 - DNA, 1686 bp, Vibrio vulnificus CMCP6
  CDS (1)..(1686)
atgattcaacctaacgagttaagcaaaccgcaacttgctctccctaccccaagcgatatgatcctgaaatgggcaaaggaacgcccacatgaggtatatctaaaacagatcatcaaccgacagtttgttgaattcacctattcagaagtagccgacaaagcccttcgcttagtcaccgcactcaaagaactgggagcggaacccggcgatagaatcgcactgatctctaaaaactgcgcggagtggtttatttgtgacttagccatgatgctaggtgactatgtgagcgtaccgattttcccaaccgccggagcggatacaattgaatactgcatcacacacagtgaaagtaaaatcctcattgccggcaaacttgatgatgccgccgcgactcagaaagtgatcgatgatctggtggacgtgaaaagcattgctctcccctacgatagctccccgcattgccaataccaatttaccacgctcattttgcaatcggagccgagcagcgacaggccacagcactacgacgataaattgatgtcactggtttacacctcgggaacgtccggtctaccgaaaggggcaatgctcacatatggtgcgttttcatggtctgttcagcagttaattaaccatattggcattcagcccaacgatcgattgttctcttatttgccactggcacatatcacagaacgcgtctatatcttcggttcttccattatgggaggggtacctaccgccttccctgaatctttggatacctttatcgaagacgtaaaaatgcagcgtccaacactgtttatttctgtaccacgcttatggaccttattccagcaacgtattcaagacaaactgccccaaaaacgcctcaacttcctactcaaaatcccatttgtcagcggtttgattaagaagaagttggccgatggccttggcctagatcaagcccgagtgctgggttgtggctctgctccagtctctccagccttactcgcgtggtatcacagtgttggcttgaacattaccgaagcttgggggatgacagaatcgttcgcttatagcaccttaaactacccatttagagccgacaaaataggctcggttggcaacgcaggccccggtattgagctcaaaattgcagctgatgatgagatcatggttcgtggcaaggggctattttctggatactacaaaaacgacattgccactcaagaagcttttgataaagaaggctggctacacactggcgatattggtcgactggatgccgaagggtatctcaccattcaaggtcgtaagaaagacacctttaaaacggccaaaggcaagtttgtttcacctgtccctattgagaataaactctttgaatacagccgagtagaaatgatgtgtttgattggcctcggcttgccagcgccaatcttattggtggttccgcataacttcccgaacttcgatcgcgatcgctatgaacgcacaactaaacgtgtgattgccaaaatgaacgcggaactcgaatcgcacgagcagatcaaaggggtgttgatgattaaagacccttggagtatcgacaatggcatcctaacgccaacgttaaaaatcaaacgacatgttttggaacagaaataccacgaagtggggcaaaactggccaaaagataagctcgtggtgtgggaagaataa

SEQ ID NO: 14203 - protein, 561 aa, Vibrio vulnificus CMCP6
MIQPNELSKPQLALPTPSDMILKWAKERPHEVYLKQIINRQFVEFTYSEVADKALRLVTALKELGAEPGDRIALISKNCAEWFICDLAMMLGDYVSVPIFPTAGADTIEYCITHSESKILIAGKLDDAAATQKVIDDLVDVKSIALPYDSSPHCQYQFTTLILQSEPSSDRPQHYDDKLMSLVYTSGTSGLPKGAMLTYGAFSWSVQQLINHIGIQPNDRLFSYLPLAHITERVYIFGSSIMGGVPTAFPESLDTFIEDVKMQRPTLFISVPRLWTLFQQRIQDKLPQKRLNFLLKIPFVSGLIKKKLADGLGLDQARVLGCGSAPVSPALLAWYHSVGLNITEAWGMTESFAYSTLNYPFRADKIGSVGNAGPGIELKIAADDEIMVRGKGLFSGYYKNDIATQEAFDKEGWLHTGDIGRLDAEGYLTIQGRKKDTFKTAKGKFVSPVPIENKLFEYSRVEMMCLIGLGLPAPILLVVPHNFPNFDRDRYERTTKRVIAKMNAELESHEQIKGVLMIKDPWSIDNGILTPTLKIKRHVLEQKYHEVGQNWPKDKLVVWEE

SEQ ID NO: 14204 - DNA, 1977 bp, Thermosynechococcus elongatus BP
  CDS (1)..(1977)
atgatgagtgcggcctacacctacactccccccggcggcctaccccaggatgcatcgttacccgatcactttttggcctacaaaagactccagtcgctgccggaaatgtggcccctattggcgcaacgccatggggatgtggtggctcttgatgcgccctacgaagaccctccgacccgcatcacctacagtgaactctatcaacgcattcaacgctttgccgctggcctacaagcgctgggtgtcgctgccggcgatcgcgtggccctgtttcctgacaatagcccccgctggctcattgccgatcaaggcagtatgatggcgggtgccattaatgtagtgcgcagtggtaccgccgatgctcaagaactgctctacattttgcgcgacagtggagccaccctgctgctcatcgaaaacctagctacccttggcaaactgcaagagcctctggtggatacaggagtcaaaacagtggtgctcctgagtggagaatcccctgaattggcaggttttcccctgcggcttttgaactttggtcaagtgtttacggaaggacaatatggcacagtgcgggcggtggccattacccccgataacttggcaaccctaatgtacacctccggtaccacgggtcaacccaagggcgtgatggttacccacggagggctactgagtcaaattgtcaatctctgggcaattgtgcaaccgcaggtgggcgatcgcgtcctcagtattttgcctatttggcacgcctacgaacgggtggccgagtactttctctttgcctgtggctgtagccaaacctataccaacctccgccacttcaagaatgacctgaaacgctgtaagccccactacatgattgccgtcccccgtatctgggaaagcttttacgaaggggtgcaaaagcaactgcgggatagtccggctacaaagcggcgtcttgctcagtttttcctcagtgttggccagcaatatatactgcaacggcgactgctgacgggcctgagcctgaccaacccccatcccaggggctggcagaaatggctggctcgagtgcaaaccctcctcctcaagcccctctacgaactgggggagaagcggctttatagcaaaattcgtgaagccaccggcggtgagattaaacaggtaattagtggtggcggtgctcttgctccccatttggacaccttctatgaagtcattaacctagaagttttggtgggctacggtctcactgaaacggccgtagtgctaaccgctcgccgctcttgggcgaatttacggggatccgctggccgtccaattcccgataccgccattaaaattgtcgatccagaaactaaagccccccttgagtttggccaaaaaggactggtgatggccaaggggccgcaggtgatgcgcggctactacaaccaaccagaggccacggctaaggtgctcgatgctgaggggtggtttgacactggcgatttgggctacctcacccccaatggagatctagtgctgacgggacggcaaaaggacaccattgttctcagcaacggtgaaaatattgaaccgcaacccatcgaggatgcctgtgtccgcagcccctatattgaccaaattatgctggtgggtcaagaccaaaaggctcttggtgccctcattgtgcccaatttagaggcactggaggcgtgggtagttgccaaggggtaccgactggagttgccaaaccgaccggcacaagcgggcagcggtgaggtggtgaccctggagagcaaagtcattattgatctctatcgccaagaactgctgcgggaagtgcaaaatcgccccggctatcgcccggatgatcgcattgccacgtttcgctttgtcctcgaaccctttacgatagagaatggtcttttgacccaaaccctaaaaattcgccgtcatgtcgtgagcgatcgctaccgcgatatgattaacgccatgtttgagtaa

SEQ ID NO: 14205 - protein, 658 aa, Thermosynechococcus elongatus BP
MMSAAYTYTPPGGLPQDASLPDHFLAYKRLQSLPEMWPLLAQRHGDVVALDAPYEDPPTRITYSELYQRIQRFAAGLQALGVAAGDRVALFPDNSPRWLIADQGSMMAGAINVVRSGTADAQELLYILRDSGATLLLIENLATLGKLQEPLVDTGVKTVVLLSGESPELAGFPLRLLNFGQVFTEGQYGTVRAVAITPDNLATLMYTSGTTGQPKGVMVTHGGLLSQIVNLWAIVQPQVGDRVLSILPIWHAYERVAEYFLFACGCSQTYTNLRHFKNDLKRCKPHYMIAVPRIWESFYEGVQKQLRDSPATKRRLAQFFLSVGQQYILQRRLLTGLSLTNPHPRGWQKWLARVQTLLLKPLYELGEKRLYSKIREATGGEIKQVISGGGALAPHLDTFYEVINLEVLVGYGLTETAVVLTARRSWANLRGSAGRPIPDTAIKIVDPETKAPLEFGQKGLVMAKGPQVMRGYYNQPEATAKVLDAEGWFDTGDLGYLTPNGDLVLTGRQKDTIVLSNGENIEPQPIEDACVRSPYIDQIMLVGQDQKALGALIVPNLEALEAWVVAKGYRLELPNRPAQAGSGEVVTLESKVIIDLYRQELLREVQNRPGYRPDDRIATFRFVLEPFTIENGLLTQTLKIRRHVVSDRYRDMINAMFE

SEQ ID NO: 14206 - DNA, 1599 bp, Shewanella oneidensis MR
  CDS (1)..(1599)
atggcatacgatcaagagtcacaactcgaacttggcaagtactcatcactcatagacttaatcgaacgcactagccaacgctttggcgataaaacggcatatgcttgtttggggaaaaatagcagtttcaatgagatagaacgcgactcacgttattttgctgcctatctgcaaaataacactaacttaaaacctggtgatcgcatcgcgatccagttacccaatatcacccaatttgtcatcgctgcctatggggcgctgcgagcgggccttatccttgtcaacaccaacccgctgtataccgaacgtgagctcattcaccagtttaatgattcgggtgctaaggcattggtggtgttatcggacttactgccaacattggccaaagtcgttgcaaccacccccattgaactggttatttcgactcatccgttagatcttatcgacccacaagttcagcccaagacagggcttaaaaatgttgaattctgtcatgtattacaacaaggtgcgctgttaccctttactcgctttgtaccaacattgagcgatctggcggcactgcaatatacaggtggaacaacgggactttctaagggtgcaatgctgacccacggcaatatgcttgccaatgcggcgcaggtaaaatcccgtattggtagcgtgatcagcgaaggcgaagacatttttgtcgcgccattgccgatttaccatatttacgcctttatggtgaacttggtgctttattttgaatgcggtggatgctcagtactaatccctaatccccgtgatattaatggcttaatcaaaacgctggcgaaatatcctttcaccggttttgcgggacttaacactctatttgtcgccctctgccatcaacccgaatttaaagcgctaaattttagccatttaaaaatcaccatttctggcggtactgcactcacagccgccgctgccaatctgtggcaacaaaccactggtaatactattagcgaaggttatggattgtcagaaacctcgcctgtaatctctctcaatgcgccgggatatcaaaagatcggcacgattggcaaacccgttctcgggactgaggtaaaactcttagatgaaagcggcaacgaagtcacccaaggcaccgctggtgagctcgcagcccgtggaccacaggtgatgctaggttattggaataatccacaagaaacagccaatgtgatgacacccgatggcttttttaagactggggatattgcgattcttaacgaggaaggcttccatcaaatcgttgatcgtaaaaaggatatgattattgtctccggctttaacgtatatcctaatgaagttgagaatgtgcttgctagccaccctaatatcattgaatgcgccgtggttggcgtaaaggatgatcactcgggggaagcggttaaagcctttatcgtactgaaggatgacagccaagatcatgagaaaataaaaactgccatcctcaacttctgccgagagcaactcacggcctataagctacctaagcagattgaatttatgtcacaactacctaagagtaccgtgggtaaaattttgcgcagagagcttaaaaactag

SEQ ID NO: 14207 - protein, 532 aa, Shewanella oneidensis MR
MAYDQESQLELGKYSSLIDLIERTSQRFGDKTAYACLGKNSSFNEIERDSRYFAAYLQNNTNLKPGDRIAIQLPNITQFVIAAYGALRAGLILVNTNPLYTERELIHQFNDSGAKALVVLSDLLPTLAKVVATTPIELVISTHPLDLIDPQVQPKTGLKNVEFCHVLQQGALLPFTRFVPTLSDLAALQYTGGTTGLSKGAMLTHGNMLANAAQVKSRIGSVISEGEDIFVAPLPIYHIYAFMVNLVLYFECGGCSVLIPNPRDINGLIKTLAKYPFTGFAGLNTLFVALCHQPEFKALNFSHLKITISGGTALTAAAANLWQQTTGNTISEGYGLSETSPVISLNAPGYQKIGTIGKPVLGTEVKLLDESGNEVTQGTAGELAARGPQVMLGYWNNPQETANVMTPDGFFKTGDIAILNEEGFHQIVDRKKDMIIVSGFNVYPNEVENVLASHPNIIECAVVGVKDDHSGEAVKAFIVLKDDSQDHEKIKTAILNFCREQLTAYKLPKQIEFMSQLPKSTVGKILRRELKN

SEQ ID NO: 14208 - DNA, 1674 bp, Shewanella oneidensis
  CDS (1)..(1674)
atggatcagccttggattagacatttaccaaaagatgtgcctgctgagattaatgtggatcagtattcatcgcttatcgatatgttcgagaccgcggtggctaagtatgcggatcaacctgcatttatcaacatgggggccacgctaacttaccgcaaactcgaagaacgcagtcgcgcgtttgctgcttatttacaaaatgaattgaagctgcagaagggcgaccgtgttgcactcatgatgcccaatttattgcagtaccccattgcgctcttcggtattttacgtgctggcatggtggtggttaacgttaacccactatacacccctcgcgaattaaaacaccagttaattgattcgggtgcgaaagcgattgtggtggtgtcgaactttgctcgaacattagaagaagtggtcgatcagacgcctgttaagagtgtgattatcactggacttggggatctcttaagtgcgccaaaacgcactttagtgaactttgttgttaaatacatcaaaaaactggtaccaaaatacgatttaccccatgcactttcaatgcgcgaaacgctgtcaagaggtcgacgtatgcagtacgtcaaacctgttattacaggggatgacctcgcatttttacagtataccggtggtacgactggggtttcaaagggtgccatgttgacccacagcaatgtcgtggcgaacgtattgcaggcaaatggtgcttattcgcctgcgctgcgagatggtagtgaatttgtggtaacagcattgccgctttaccatatttttgcgttaaccgtgaactgcttgctgtttttacacaagggcagtcaaaacctattgatcactaaccctcgtgatatccctggttttgtggctgaactcaaaaaatacccctttaccgcgctgacaggtgtcaacaccttattcaatgctttagttaacagtagtgatttttctgagttagatttctctcgtctaaaactctccatcggtggcggcatggcagtgcaaaaagccgtggccgataaatggcagaacattaccaaaactcgtttactcgaaggttatggcctaacagaagcttcaccgttattaacctgttgtccatataatttagatggttacaacggttctatcggttttcctgcgccatcaaccttgatccaagtgcgcgatgatgcgggtaatgtcttaccgcaaggtgagactggtgagctgttcggtaaaggcccacagatcatgaaagggtattggcaacgtccagaagaaaccgccaaagtgattgataatgacggttggctcgccacgggtgatatcggctatatggatgagcagggattcttctatattgtcgatcgtaagaaggacatgattttagtgtctggttttaacgtattccccaatgaagtcgaagaggtggttgccttacatcctaaggtgattgaagtggcagcagtgggtgtgcccaatgacgccagcggtgaattagtgaaggtatttgtggtgaaaaaagataaatctttaaccgctgaagacatcattaagcattgccgtgtgcatttaacgggatataaagtaccgaagctggtagaatttagggacgagttacctaaaaccaatgtgggtaagatcctgcgacgagaacttagagacgaagttaagcgtgcgtaa

SEQ ID NO: 14209 - protein, 557 aa, Shewanella oneidensis
MDQPWIRHLPKDVPAEINVDQYSSLIDMFETAVAKYADQPAFINMGATLTYRKLEERSRAFAAYLQNELKLQKGDRVALMMPNLLQYPIALFGILRAGMVVVNVNPLYTPRELKHQLIDSGAKAIVVVSNFARTLEEVVDQTPVKSVIITGLGDLLSAPKRTLVNFVVKYIKKLVPKYDLPHALSMRETLSRGRRMQYVKPVITGDDLAFLQYTGGTTGVSKGAMLTHSNVVANVLQANGAYSPALRDGSEFVVTALPLYHIFALTVNCLLFLHKGSQNLLITNPRDIPGFVAELKKYPFTALTGVNTLFNALVNSSDFSELDFSRLKLSIGGGMAVQKAVADKWQNITKTRLLEGYGLTEASPLLTCCPYNLDGYNGSIGFPAPSTLIQVRDDAGNVLPQGETGELFGKGPQIMKGYWQRPEETAKVIDNDGWLATGDIGYMDEQGFFYIVDRKKDMILVSGFNVFPNEVEEVVALHPKVIEVAAVGVPNDASGELVKVFVVKKDKSLTAEDIIKHCRVHLTGYKVPKLVEFRDELPKTNVGKILRRELRDEVKRA

SEQ ID NO: 14210 - DNA, 1665 bp, Shewanella oneidensis MR
  CDS (1)..(1665)
atggataaagcgattaagacgccaattgaaatgctggcgcactgggcgaatacgcgtggggatgagatttatttgcgccagccaatcaagggacagtaccttgatttcacttggaatgaagtacaagaaaaagtccagcaactcgccggagcactgcgtcatttaggtctagagccgggtgataagattgccgttctgtctaaaaactgcgccgaatggtttatcaccgatctcgccctgatgcacggcggctatattagcgttccaatctaccctaccgcgaatccagatactatccgctatgtgttgcaacacagtggtgcgaaagcgattttcctcggtaaactcgatcattgggctgaccaagaggctggcgtcggtggcgaattattgcgcctagcgatgccctacgacaccatgccagcccaatatcaatgggaacaattgctcaatatgggcaatccattaattgaagcgccattgcccgaacccgaccagataatgacgctgatttatacctcgggctcaacaggccaacctaagggtgcgattcaaacttttgctagctatggctggacctgccaagcggttgtgcgcgatctacgtactaatggtaatgatagattgttatcctatttgcctttagcccacattaccgagcgagtcgcgatcgaaggatcgtccttttattcaggcagcgtagtcgccttcgttgaaagtttggactcctttgtggccgacgtgcaacgtgctaaaccgacggtatttttctctgttccacgcctctggagcctgttccaaaagaacattatcgacaagattggtgtcagcaaactcaatttactactcaagatcccgctcatcagcagcttggtgaaacacaaaatccacaaaggtttaggactcaaccattgccgtttactcggctctggttctgcgcctattccaccttcactcattcactggtatcacagtattggtctgaatatttgtgaggcctgggggatgacggaaaactgtgcttactccatcattaactacccgttcgatgtgcgtaaaatcggcactgtgggtaaaccggtgcaggattgccaaatccgccaaggtgaggatggtgagctgctcatcaagagccctggtctaatgacagcctattatctgcaacctgaagcgactgcagcggcctttgatgcggatggttttttccatacgggcgatctctgcgccatagatgccgatggttgtgtcacgataacgggtcgggtgaaagataactttaaaaccgctaagggtaaatacgttgcaccagtgccgattgagcgcaaactcgcgcaagatccccatgttgaactgatttgcgtcataggttcaggtttgccgcatcctgtcgcattagtgcagctttctgaaggtgccaacttacaagcccgcgaagaagtgcgcgcctccctaaaagcgacactagatagtgtgaatccacatttagaatcccacgaacatgttgatgccattgtagtagtgaatgagccatggtctatcgaaaacgatgtactaacgccaacgcttaagatcaaacgccatgtactcgagaaagcctttagcgaacgtgtcgatgggatccgtggtgctcaagtacgttgggaagatgagttagcgaaaaaataa

SEQ ID NO: 14211 - protein, 554 aa, Shewanella oneidensis MR
MDKAIKTPIEMLAHWANTRGDEIYLRQPIKGQYLDFTWNEVQEKVQQLAGALRHLGLEPGDKIAVLSKNCAEWFITDLALMHGGYISVPIYPTANPDTIRYVLQHSGAKAIFLGKLDHWADQEAGVGGELLRLAMPYDTMPAQYQWEQLLNMGNPLIEAPLPEPDQIMTLIYTSGSTGQPKGAIQTFASYGWTCQAVVRDLRTNGNDRLLSYLPLAHITERVAIEGSSFYSGSVVAFVESLDSFVADVQRAKPTVFFSVPRLWSLFQKNIIDKIGVSKLNLLLKIPLISSLVKHKIHKGLGLNHCRLLGSGSAPIPPSLIHWYHSIGLNICEAWGMTENCAYSIINYPFDVRKIGTVGKPVQDCQIRQGEDGELLIKSPGLMTAYYLQPEATAAAFDADGFFHTGDLCAIDADGCVTITGRVKDNFKTAKGKYVAPVPIERKLAQDPHVELICVIGSGLPHPVALVQLSEGANLQAREEVRASLKATLDSVNPHLESHEHVDAIVVVNEPWSIENDVLTPTLKIKRHVLEKAFSERVDGIRGAQVRWEDELAKK

SEQ ID NO: 14212 - DNA, 1707 bp, Shewanella oneidensis
  CDS (1)..(1707)
atggcagccccttggcatcaagtcagttggcaggcatttgatgaaatcagccataaaatcgcacaagtgttaattcaactcggcgtacaagtgcaagaccgctgcgtgattctgtcgcaaaactgccctcaatggacctgtgccgatgtcggcaccctgaaaagccgcgccattgtggtaccgatttatccaaccagcactgtcgagcaggcgagctttatcgttaacgatgctgctgccaaggtgatttttgtcgacgatgccaagcaatatgcgctggcctgtgagctgcaaacgctttgcccgaccttagagcatgtgattgtgttcgatgccgcggtgcaactggctcaagataaacctcagcataaacatttagatagcttactggcgttggaatatgaccaaagtgctgagctcgaacagcgtttaaaagacgctaatctcgatgatttgttaaccctgatttatacctccggcacgactggcgaccctaagggcgtgatgctggattaccgcaatatggcctcgactgtgcatcagcacgatctgattttgcctttcaaaaccggcgatgtgtctttggctttcctgccgcttagccatgtgtttgagcgtggctggagcttctatgtgctgtgccgcggtggccgcaatgtgtatttgcagaatacccaaagagtaaaagaggcgattagtgctgtgcgtccgcataccctatgcgtggtgccgcgtttccttgagaaggtttacagtgccgtacaggataaagtcgctaaatctgccgagggccgtaaaaaattattcgcttgggcgatgggtgttggcgaacgtcagtttgaagtcagccaaggccgtgttaagggcggtttgtggttatctttgcagtggcgtttggcgaacaagctggtttacagcaagttgcaggctgtactcggtggacggttaaagtttatgccctgtggcggtgctgcactcgatttaaatgtggcgtctttcttccatgcgattggtattcctgtgctttgtggttatggcatgaccgaaacaaacgccacagtgacctgtaacaccttagacaatcgtgttgcgggatcaaacggtaaagtcttgcccgaaatccaaattaagctgggtaaggacgacgagattttagtccgtggcgataccgtgatgcgcggttattacaatcgccctgaagatactgctgctgcctttgaagacggctggttaaagacgggcgatgcgggtcgactcgatgcccacggcaatttatttattaccgaccgcattaaagaattaatgaaaacctccaacggcaaatacattgcgccgcagcgggttgagggcacagtgggtcgttgcccttttatcgagcaggtggcggtgattgccgatgctcgtaactatgtgactgcgctgattgtgccagcttttgaatctctcgaagcgtgggcgaaggaaaagggcttaaagtatgagtcgcccattgaactcttgcgtcacagccatgtggttgagcattttgaacaacgcttaaagcatctacagcaggaactggcaggatttgagcaaatcaaaaagtttaccctgctgccggaagctttttcgatggaggcggggttaatcactccgacgcttaagctgcgccgcaaaatgatttatcacaagtacgtccatgaaataaatgctatgtacaataattga

SEQ ID NO: 14213 - protein, 568 aa, Shewanella oneidensis
MAAPWHQVSWQAFDEISHKIAQVLIQLGVQVQDRCVILSQNCPQWTCADVGTLKSRAIVVPIYPTSTVEQASFIVNDAAAKVIFVDDAKQYALACELQTLCPTLEHVIVFDAAVQLAQDKPQHKHLDSLLALEYDQSAELEQRLKDANLDDLLTLIYTSGTTGDPKGVMLDYRNMASTVHQHDLILPFKTGDVSLAFLPLSHVFERGWSFYVLCRGGRNVYLQNTQRVKEAISAVRPHTLCVVPRFLEKVYSAVQDKVAKSAEGRKKLFAWAMGVGERQFEVSQGRVKGGLWLSLQWRLANKLVYSKLQAVLGGRLKFMPCGGAALDLNVASFFHAIGIPVLCGYGMTETNATVTCNTLDNRVAGSNGKVLPEIQIKLGKDDEILVRGDTVMRGYYNRPEDTAAAFEDGWLKTGDAGRLDAHGNLFITDRIKELMKTSNGKYIAPQRVEGTVGRCPFIEQVAVIADARNYVTALIVPAFESLEAWAKEKGLKYESPIELLRHSHVVEHFEQRLKHLQQELAGFEQIKKFTLLPEAFSMEAGLITPTLKLRRKMIYHKYVHEINAMYNN

SEQ ID NO: 14214 - DNA, 1614 bp, Oceanobacillus iheyensis
  CDS (1)..(1614)
atgaacacgcaattaactctagcatcgatgattaaacacacggaaaagtattttccaaagaaagaagtgatatcaagaacgttagccggtatacagacgtttacatatgaagagacagttcaacgtatgaaacgccttggtcatgctttagagtctcttggtattaaaaaaggtgatcgagtaggtacgtttgcgtggaatcaccatcgccatcttgaagcatattttgctgttccgagtatgggagcaatattacacacaataaatattagattagcgccggaagatttagtttatattatcaaccatgctgaagataaagtgattctagttgatgaagatctattgccattgattgaaagagttgcggatcaattagcacatgtggaagcttatatcgttatgacagaccgagaaaatctacctgaaactagtttgacttctgtctactcctatgaatcactcttagaaagagcggattcagaatatgaatttacaactgaattaaacgaagaagatcctgctggaatttgttatacctcaggaacaacaggtagacctaaaggagtggtgtatactcatcgcggaatttatttacacagtatggctttaggaatgacagatacagttggattatcagaaacggatacaacaatgccagttgtcccaatgtttcatgtgaatgcttggggtatgccatttgctgccacttggtttggagcaacacaagtattaccaggtccaatgccaacacctcaagtattagctcaattaattgatgaatataaagtgacaaccactgctggcgttccaacgatatggctagggctgttaaaagaattagagtcaggcaattactcgatgaaaagtttaagaaacatactttgtggtggatctgctgctccaaagagtatgataaaagcattcgaaacaaagtataatataccatttttacatgcatatgggatgacagaaacatcgcctttagttacggtctccagattaaaaagttatcagcataatatagattcggaagaacgactagagttgcgttccaaacaaggtatggtcgttcctggtattgaaattagagcgattaacgaaaatggagatgttacccgagatggggaagatatgggggaattgataattagaggcccatggattgccgatcaatattataaagatgatcgtagtgcagatacatttcacgatggttggttgcatacaggagatgttgtcacgatagatgaagaagggactataaaaattgtcgatcgcacaaaagatcttattaaaagcggaggagaatggatttcctctgttgacttagaaaacgctttaatggcacatgaagatatatttgaagctgctgtagtagcgataccagaccctaagtggcaagaacgtccgattgcatgtgtagtatgtaaagaaaatgcacaactgacgaaagaagatgtattgcaatttttacaacctcaatttgcaaaattctggttgccggatgaagttatatttatgaatgaaattccgaaaacatccgtaggtaaattcctgaaaaaagcattgagagaccaagtgaaagagacactatctattaaagatgagtaa

SEQ ID NO: 14215 - protein, 537 aa, Oceanobacillus iheyensis
MNTQLTLASMIKHTEKYFPKKEVISRTLAGIQTFTYEETVQRMKRLGHALESLGIKKGDRVGTFAWNHHRHLEAYFAVPSMGAILHTINIRLAPEDLVYIINHAEDKVILVDEDLLPLIERVADQLAHVEAYIVMTDRENLPETSLTSVYSYESLLERADSEYEFTTELNEEDPAGICYTSGTTGRPKGVVYTHRGIYLHSMALGMTDTVGLSETDTTMPVVPMFHVNAWGMPFAATWFGATQVLPGPMPTPQVLAQLIDEYKVTTTAGVPTIWLGLLKELESGNYSMKSLRNILCGGSAAPKSMIKAFETKYNIPFLHAYGMTETSPLVTVSRLKSYQHNIDSEERLELRSKQGMVVPGIEIRAINENGDVTRDGEDMGELIIRGPWIADQYYKDDRSADTFHDGWLHTGDVVTIDEEGTIKIVDRTKDLIKSGGEWISSVDLENALMAHEDIFEAAVVAIPDPKWQERPIACVVCKENAQLTKEDVLQFLQPQFAKFWLPDEVIFMNEIPKTSVGKFLKKALRDQVKETLSIKDE

SEQ ID NO: 14216 - DNA, 1644 bp, Oceanobacillus iheyensis HTE831
  CDS (1)..(1644)
atgacagaactaattcacaaaacagtgggacaattactacaagaccgtgcagatgacatgccaggacaagaagcagtggtatattcagatcgtgggttgcgatacacatataaagaatttaatcaactatgtgagaaggttgcaagggggataatggcgttatcgattgacaaaggtgagcacgtagcagtatggggtacaaatactcctgaatggttaactcttcaatatgctactggaaaaatgggggcagtcctagttacggtaaacacgagttaccgtgcgaatgaattagaatatttacttaaacaatctgattctacaactatatttttaatagaaaattatcgggatcactcttatattgatactttatacgaaatttgcccagaactacatgaatcaatccctggagagttgaatgctgaacgattaccatcattgaaaaatgttgtaataatgggagaaaaaaggtatccaggagcttttcattggaatgatattattgataaggcagaagaaatttcacgagaagaattaatatttcaatctcaaaatctcgatccaaatgatgtaattaatatgcagtatacatcaggaacaacaggttttcctaaaggtgtgatgttaacacatcgtaacctcacaaataatggctttaatatagctaattgtatgaaattgactgcagaagatcggttatgtatccctgtgccattttttcattgttttggatgtgtaattggtacattagcagcagttagtgtaggagcaactatgatacctattcaggaatttgaaccagaacaagtattaaaaacggtagagcaggaaagtgtcacagcgctacatggtgtacctacaatgttcattgctgaattaaatcatccaaattttgaacgatataatttgagttcattgcgaacgggagtaatggcaggatctaattgcccggtggaagtaatgaaaaatgtaatgaataagatgaatatgtctgaaataaccatttgctatggacaaacagaatcatcaccggtaattacacaaacgagagcaaatgatccaatcgagttacgtgtagaatcagttggaaaagcactgccgaatgtggaagtgaaaattatagatccagcgacaaatgaggaattaccgcattatacacaaggggagttatgtacaaggggatatcacgtaatgaaaggttattataaaaaccctgaagcgacccaacgaacaatagatgaagacggatggctgcatacaggtgacctcgcaataatggacgataatgggtactgtaagataactggaagattgaaagatatgattattcgaggtggggagaatatctacccacgagaaattgaagaattattatataaacatccgaaaatattagacgctcaagttgttggtgtaccagatgaaaaatttggagaagaagttcatgcttggattatactaaaagagggagagattagttcatctgatgaaataaaacagttttgtaatggacagatttctaaatataaaattcctaaacatatttttataactgacgcgtatccaatgactgcttcaggaaaaattcaaaaatttaagttacgtgaaaaatcgttgaatgaagttgaaagaaagatataa

SEQ ID NO: 14217 - protein, 547 aa, Oceanobacillus iheyensis HTE831
MTELIHKTVGQLLQDRADDMPGQEAVVYSDRGLRYTYKEFNQLCEKVARGIMALSIDKGEHVAVWGTNTPEWLTLQYATGKMGAVLVTVNTSYRANELEYLLKQSDSTTIFLIENYRDHSYIDTLYEICPELHESIPGELNAERLPSLKNVVIMGEKRYPGAFHWNDIIDKAEEISREELIFQSQNLDPNDVINMQYTSGTTGFPKGVMLTHRNLTNNGFNIANCMKLTAEDRLCIPVPFFHCFGCVIGTLAAVSVGATMIPIQEFEPEQVLKTVEQESVTALHGVPTMFIAELNHPNFERYNLSSLRTGVMAGSNCPVEVMKNVMNKMNMSEITICYGQTESSPVITQTRANDPIELRVESVGKALPNVEVKIIDPATNEELPHYTQGELCTRGYHVMKGYYKNPEATQRTIDEDGWLHTGDLAIMDDNGYCKITGRLKDMIIRGGENIYPREIEELLYKHPKILDAQVVGVPDEKFGEEVHAWIILKEGEISSSDEIKQFCNGQISKYKIPKHIFITDAYPMTASGKIQKFKLREKSLNEVERKI

SEQ ID NO: 14218 - DNA, 1548 bp, Oceanobacillus iheyensis HTE831
  CDS (1)..(1548)
atgaatataacggataagttagcactaactgctagggagaatccaacaaaaactgcatatatttttaccgataaggaaacaacctatggtgagttagagggtatggttcaaaagtttgcagatggtctccaaaaattaggattcagacaaggagatcatatcgcattagtattagggaatagtccatattatgtgattggattgcatggggcactaaggttaggattaacggtaattccaatgaatccattatatacccctactgaaatggcttttatgttaaaagatggtgatgttaaaggaattattacaatggatattcttattgataaatttattcctattgtagatgatctacctgcgcttgaatatattattaattgtgaaagtggaaatgaagttccagaatctataaaaaaagaccatctgccaacaaatatattacgtttccaagaagtaattactaatggtcaatttccttttaatggtccaaaattagttggagaagatttagctgttatcttgtatacctcgggtactacaggaaaaccaaaaggagcaatgcttacgcacaaaaatctgtactctaacgcacaagatgtcgcaaattatttacatattaatcaagatgaccgtgtaattgctgccttgccaatgtttcacgttttttgtttgactgtatcattaaatgcgccattattaaatggaggtacaatcattattttacctcagttctcgccaacagaagtatttcgtgtagctagagcttatcaagctacagtatttgctggcgttccaacaatgtataattacttactacagagtgtgaaaggtaatgtggatagtttttcttctttacgcttatgtatttctggaggtgcagctatgccagtatctttactagaatcattcgagcaagcttttaatgtaaaggtatctgaaggctatggtttatcagaggctgctccagtaacctgttttaatcctttagatcgtccgagaaaagcaggttctataggacaaaacattgttaatgttataaacaaagtggttgatgaaatagggaatgaattgccaccaggtgaagtaggtgaattagtagttcaagggccaaatgtgatgaaaggttattataaaatggaagaagaaactgctgcagcaatacgtgatggttggctctatacaggggacatggcaagaatggatgaagatggatatttttatattgttgatcgtaaaaaagatatgattttagttggtggttataatgtttatcctagggaagtagaagaagtgttctattctcatccttctgttgtggaagttgccgtaattggtgtcccagatccgcaaacaggtgaagcagttatagcatatgtcgttgtcgataattcggatgtgaaagagatagatttaattgagtttagtaaacaacatttagcaaaatataaagttcctcaatctatttcttttcttgaagaacttccgaaaaatacgacaggaaaaatattacggaagagtcttaaagatcaagttacaaattcatag

SEQ ID NO: 14219 - protein, 515 aa, Oceanobacillus iheyensis HTE831
MNITDKLALTARENPTKTAYIFTDKETTYGELEGMVQKFADGLQKLGFRQGDHIALVLGNSPYYVIGLHGALRLGLTVIPMNPLYTPTEMAFMLKDGDVKGIITMDILIDKFIPIVDDLPALEYIINCESGNEVPESIKKDHLPTNILRFQEVITNGQFPFNGPKLVGEDLAVILYTSGTTGKPKGAMLTHKNLYSNAQDVANYLHINQDDRVIAALPMFHVFCLTVSLNAPLLNGGTIIILPQFSPTEVFRVARAYQATVFAGVPTMYNYLLQSVKGNVDSFSSLRLCISGGAAMPVSLLESFEQAFNVKVSEGYGLSEAAPVTCFNPLDRPRKAGSIGQNIVNVINKVVDEIGNELPPGEVGELVVQGPNVMKGYYKMEEETAAAIRDGWLYTGDMARMDEDGYFYIVDRKKDMILVGGYNVYPREVEEVFYSHPSVVEVAVIGVPDPQTGEAVIAYVVVDNSDVKEIDLIEFSKQHLAKYKVPQSISFLEELPKNTTGKILRKSLKDQVTNS

SEQ ID NO: 14220 - DNA, 1938 bp, Leptospira interrogans
  CDS (1)..(1938)
atgaaaaccgccaccattccaaaaattcaatccaaaaccctatacaacgttatgaaagcttctgcggaaacttttgcagattcgaccgcacaatactataaaccggacggtaaaaattatcaggcaaatagtttcaaaaacctttatgaaacagtacaacaaattggctgcggattgatctctttaggtatagaaccagggactccgatcggtttgatcgcagactcgggagctcgctggctttggtgtagtatgggaatcacaaatataggttgtgcggatgtaccgagaggaacagattctacctcggatgatcttcgttatattctcaatcacgctgaatgttctatcacttttttagaaaacgaaaccgctttaaaaaaagttctaagtcaaaaatccgaatttcctcatctcaaaaaaattattttattcgatcaaaaaggaacacttgaagatacaaaatcttttgaaatcatattgttaaacgacttaattgaaaaaggcaaaacttggatacaaaacaaaggaaaggatgagttccataaaagagggtcggcaatccgggaagaagatttggctacgatcgtctatacatcaggcaccacgggaaaacccaaaggtgtaatgttgactcacaaaaacatagtatttaacgtagacagcgccttacaaggagaagatctaaacgtatatccaaccgacagaagtatggcgtatcttcctccttggcatattgcggaaagacttgtggaaaccgtttgtatccgtgcaggaggagcagaagccttcacttctatttctagtttaagtcaagatcttgcggatattaaacctacattgttactttcggttcctagagtttgggaaagtctttacaacaagattcatgataaagtaagaaattcttctccagttcaacaagctttatttggagcatttaaggagattgcaattacgtattataaacatctttctaggttgcaaaatttggaatattctttaacggaacaatctacatttgcttctttatggcaaaaattaatttcattttggattgtgatccttctttggattccgaatcagatttcacaactcgctttcaataaaatcaaacaaggattaggcggagaattaaaatttgcactttccggggctggggccttacctcagtacatagacacattttttaacgcgattggaattccaattttagaaggttacggaatgacagagttatctggtatttctacaaggagaattttaggagaaattacagtgggaactctaggtcgttgtattccaggagttcaaatcaaattaatggacgaaaaaggaaatgaaatcactaaaccaggaattaaaggaattgcttggcataagggagatcacgtgatgaagggttactacaaagaacccgaaaaaacgaaagagattttgagttcagatggatggttgaactcgggagatcttttaacttggacaacttcaggagaattaaaatattccgggagagccaaagacacaattgtacttttaggcggagaaaatttagagcccgagccaatcgaatttgctctggttcggagtagatttattcaacaagcgatggtaattggtcacgatcaaaaaacactcggagctttgatcgttccggatagagaaattttagaaaaatatctaaaagaatccaagtctaaaatgttaaacgaaatagaaaatttaaatggagacttggatatagttgcactttttaaaaacgaaatcaaaacgtttgtgtcgagcgaaaacggttttaagaactttgaaaaagtttccaattttagaattctaaataagaagtttgaacctggagatgaattaacacaaacaatgaaaatcaaacgaaacgtagtaacggataaatataaaaaagaaatagaagaaatgtaccagtaa

SEQ ID NO: 14221 - protein, 645 aa, Leptospira interrogans
MKTATIPKIQSKTLYNVMKASAETFADSTAQYYKPDGKNYQANSFKNLYETVQQIGCGLISLGIEPGTPIGLIADSGARWLWCSMGITNIGCADVPRGTDSTSDDLRYILNHAECSITFLENETALKKVLSQKSEFPHLKKIILFDQKGTLEDTKSFEIILLNDLIEKGKTWIQNKGKDEFHKRGSAIREEDLATIVYTSGTTGKPKGVMLTHKNIVFNVDSALQGEDLNVYPTDRSMAYLPPWHIAERLVETVCIRAGGAEAFTSISSLSQDLADIKPTLLLSVPRVWESLYNKIHDKVRNSSPVQQALFGAFKEIAITYYKHLSRLQNLEYSLTEQSTFASLWQKLISFWIVILLWIPNQISQLAFNKIKQGLGGELKFALSGAGALPQYIDTFFNAIGIPILEGYGMTELSGISTRRILGEITVGTLGRCIPGVQIKLMDEKGNEITKPGIKGIAWHKGDHVMKGYYKEPEKTKEILSSDGWLNSGDLLTWTTSGELKYSGRAKDTIVLLGGENLEPEPIEFALVRSRFIQQAMVIGHDQKTLGALIVPDREILEKYLKESKSKMLNEIENLNGDLDIVALFKNEIKTFVSSENGFKNFEKVSNFRILNKKFEPGDELTQTMKIKRNVVTDKYKKEIEEMYQ

SEQ ID NO: 14222 - DNA, 2046 bp, Leptospira interrogans
  CDS (1)..(2046)
atggcggaaaacttagcgcagctatttcgtgaatccgcggaaaaatacagagatttacctgcttttttttccaaggattctaaaaaaaattattatccaacgacttacagtcaattgtatgaacagggaattcaacttgcagaggctttgattgaattgggtgttcaacaaaaacaaaaagttggtttgttggcagacaatcggatcgaatggatcatcgctgattacggtgtgattcttacgggtgcggccaatgtccctcgtggaacggatattacagattctgaaatcgtctatattcttaatcattcagaagtggaagttgtttttatcgaaaacgataaaatgttagaaaaatttaacagaaacaagtctcagcttacaaacgtaaaaacgttgattatgatggaccctacaagtaactctcctggagtcttgaaaatgcaggaactaattgaaaagggaaaagcacttcgcgccggtggatctaaaaaggcggaagaaagaattgctgcaattgatccggaagacctttttacgttgatttatacttctggaacgactgggcttcccaaaggagttatgctcaaacattccaacatgatgcatcaggtaaactacgtaagtcctatgttggatatcaaagcaggtgctcgtcttctatcgattcttccaatttggcacgtgtttgaaagagtagtagagtatgtttgtattggcctaggtgcagctacctattacacaaacgtaagagatcttcgtcaggatttggctacggtaaaacctacttttatgggttctgcaccaagactttgggaaaatatctacaacggaatttatacaagaatcaatgatccggctcaaactccagcgcttcgtagagggctttttaaacttgcgtatttcttttctagaaagaaaaatcaggcgcttcgttttttaaaaggaatcgaagtggattatacaggaagaaatccgatcgtatctttcttttatggaattctaatgttctttcagttcctactaaccggaccgtttactctaacagttttggcgggagcattaggtgcttattttgctggaaccgaattgtatttcttgacatctcctttttacactgttgctggtttggcgcttgttttgaatagttttaccttagataaagtcgttcttgctaaaatcagagctgctacaggcggacaattggaagcttccatttctggaggaggcgcacttccaagacatgtggatgaatttttcggaaatatcgggatcaacgtattggaaggttatggaatgacggagacttctcccgttatttccgtgagaacttttgagaaactgattattggttctgtgggtgtaatcgttcctaagacgagacttcaaattcgtaacgataacaatgcagttttaactgaaatagacgaaagtggaaatatcactcaaggtaaaatgggactgaaaggagtggtttttattaaagggcctcaagttatgaaaggttattttaaaaatgaagaagccacttctaaagcgatttcagacggttggatgaacaccggtgatatgggtatgatcaatttcaaaaagactctgactcttactggtcgtgcaaaagataccgtagtgcttcttggaggggagaacgtagagccggttccgatcgaaaataaacttcaagaatctgcatatatcagtcagtgtatggtaattggtcaggatcaaaagaatttaggggctattgtagttccagacttcgaaaaacttcaggaatgggcaaaagaaaacggaattaacgaatctaacaacgagaagttgattgaaaatccgaaaatttacgatctttacagaaaagaaatcaaagctttaaacaatactaagaatggattcaaatcttttgagcaagtgactcctttcattttgatttctaaaccttttgaagttggagatgaactcaataatatgatgaaaatgaaacgtcatgtgatcactgaaaaatacagcgataagattaaaaaaatctattctacgaatcaagattag

SEQ ID NO: 14223 - protein, 681 aa, Leptospira interrogans
MAENLAQLFRESAEKYRDLPAFFSKDSKKNYYPTTYSQLYEQGIQLAEALIELGVQQKQKVGLLADNRIEWIIADYGVILTGAANVPRGTDITDSEIVYILNHSEVEVVFIENDKMLEKFNRNKSQLTNVKTLIMMDPTSNSPGVLKMQELIEKGKALRAGGSKKAEERIAAIDPEDLFTLIYTSGTTGLPKGVMLKHSNMMHQVNYVSPMLDIKAGARLLSILPIWHVFERVVEYVCIGLGAATYYTNVRDLRQDLATVKPTFMGSAPRLWENIYNGIYTRINDPAQTPALRRGLFKLAYFFSRKKNQALRFLKGIEVDYTGRNPIVSFFYGILMFFQFLLTGPFTLTVLAGALGAYFAGTELYFLTSPFYTVAGLALVLNSFTLDKVVLAKIRAATGGQLEASISGGGALPRHVDEFFGNIGINVLEGYGMTETSPVISVRTFEKLIIGSVGVIVPKTRLQIRNDNNAVLTEIDESGNITQGKMGLKGVVFIKGPQVMKGYFKNEEATSKAISDGWMNTGDMGMINFKKTLTLTGRAKDTVVLLGGENVEPVPIENKLQESAYISQCMVIGQDQKNLGAIVVPDFEKLQEWAKENGINESNNEKLIENPKIYDLYRKEIKALNNTKNGFKSFEQVTPFILISKPFEVGDELNNMMKMKRHVITEKYSDKIKKIYSTNQD

SEQ ID NO: 14224 - DNA, 2058 bp, Leptospira interrogans
  CDS (1)..(2058)
atgaaaatgtataaaaacctcgcggatatgttgatacaatccaccgagaaatatggagatcgacctgtattttggagtaaaggagaagataaagaattccatccaacttcttataaccaactttatgacatgggtatagcgcttgccgaagcgctcattcagttaggattaaaagcgagagaacacgtcggagttttggcagacaacagactagaatggatattaaccgattacgcggttcaattttctggagcggccaatgtgccaagaggaacggacgtcaccgagtctgaattggaatatattctcaatcactcggaagcaaaaatcgtttttatcgaaaatgataagatgctggaaaaatacaataaggttaaatcaaaagttcctaaagtagaaacaatcatcattatggataagtcttcctctgcaaaaggaaaaaacattcataaaatttatgatttggttgaagaaggaagatcccttagagccaaaggtagtaaaaaagcagaaaaaaggatcgaagaaattaaaccagaagatctttttactctcatttatacttctggaaccactggaatgcctaagggtgtaatgctgatgcattctaacatgattcatcaaatggtctacgtagttcctatgcttttgaccgaaatcaagcctacggatagtatgctttctatattaccaatttggcatatatttgaaagaataaacgaatacggagctatttcgagcggtatccaaacgtactatacaaaagtagccgatctcagaaacgacctcgcgaaagcaaaaccttcctttatggcttctgcccctcgcgtttgggaaaatgtttatgcaaatatttacaataaaataaacgacccaaaacaaacccctccaattcgtagggttttgtttaaactcgcgtatttcttttcgaaacactataatgcttctagaagatttttaaatggactagaagttgattacgaaaacagaaatataatgaaatctcttgtaatcggaatcagatccctgattgtccttttactaacggggccttttacgttaagcgcaatttcgattctggcttacctgactcttccggtctatgggatccatcttccaaattggcttttcttctctttagtgggtttagggcttgttttcaacgcaaaaactttagatacgatcgttctttctaaaatccgcgccgctactggaggaagattaaaggcatctttatcgggtggtggagcactacaatcacacgtagataacttctttaacgatataggtatgctcgttttagaagggtacggcatgaccgaaacaagtcccgtaatttcagtaagaccttttgtaaaaccaatcattggttccgtaggttttttggttcctaaatctgaactgattatcaaagacgaaaacggtaatgtgctaactcacatcaacgatcaatatgaagttttggctggcaaattaggacaaaaaggaatcgtttttgtaaaaggcccacaagtaatgaagggttattataaaaatccagaagtcactaaaaaaaccatcgtagacggttggatgaatactggagatatagggtttatcaatttcaaaaaaactcttacactgaccggtagagccaaagacaccgtagtattgttaggtggagaaaacgtagaaccggttccaattgaaaataaaatggatgaatctccatttatcaaacaatccatggtaatcggtcaggatcaaaaagttttaggtgcgatcattgttcctgatatggaacatttaggcgtttggtgtaaagaaaatggaatcgattcttctaaaattgatgaaataatcaaaaatcctaaagtgatcgacttttataagaaggaagttcgtagctacaatagtactaaaactgggtttaagtcttttgaacaagttcaacacgtaattctagctaaaaaaccttttgaagttggagacgagttgaccgatcttcttaaaatgaaacgtcatgtgatcactgaaaaatacagtaaagaaattaaaaaaatctacgaaaaagattaa

SEQ ID NO: 14225 - protein, 685 aa, Leptospira interrogans
MKMYKNLADMLIQSTEKYGDRPVFWSKGEDKEFHPTSYNQLYDMGIALAEALIQLGLKAREHVGVLADNRLEWILTDYAVQFSGAANVPRGTDVTESELEYILNHSEAKIVFIENDKMLEKYNKVKSKVPKVETIIIMDKSSSAKGKNIHKIYDLVEEGRSLRAKGSKKAEKRIEEIKPEDLFTLIYTSGTTGMPKGVMLMHSNMIHQMVYVVPMLLTEIKPTDSMLSILPIWHIFERINEYGAISSGIQTYYTKVADLRNDLAKAKPSFMASAPRVWENVYANIYNKINDPKQTPPIRRVLFKLAYFFSKHYNASRRFLNGLEVDYENRNIMKSLVIGIRSLIVLLLTGPFTLSAISILAYLTLPVYGIHLPNWLFFSLVGLGLVFNAKTLDTIVLSKIRAATGGRLKASLSGGGALQSHVDNFFNDIGMLVLEGYGMTETSPVISVRPFVKPIIGSVGFLVPKSELIIKDENGNVLTHINDQYEVLAGKLGQKGIVFVKGPQVMKGYYKNPEVTKKTIVDGWMNTGDIGFINFKKTLTLTGRAKDTVVLLGGENVEPVPIENKMDESPFIKQSMVIGQDQKVLGAIIVPDMEHLGVWCKENGIDSSKIDEIIKNPKVIDFYKKEVRSYNSTKTGFKSFEQVQHVILAKKPFEVGDELTDLLKMKRHVITEKYSKEIKKIYEKD

SEQ ID NO: 14226 - DNA, 2049 bp, Corynebacterium efficiens YS
  CDS (1)..(2049)
atgatatggtgccggtcgttcaacgaggtgaccctggttgtcccggccggagccggtactgaaacactatggattaatgaaccgataggcccgggggaacacactccgggcggaagccggggcccacacaccccaagggctccgatgccccgttggatccggggtgaaccgacaacacacggaaggcgagaacacgaaatgacttcagcgtcccaacccagggaattcaccgtcgaggccgaatacaccatcggggagaacgaaacctgcctgaccgccctcatcgaccaggtcaagacccgcccctacggtgtgctgttcacccggcccgcgaacttcgagtgggtcaatgtcactgcgcaggaattcctcaatgaggtcttcgccgtggccaagggcatcatcgccaccggcgtggaacagggggaccgcgtggccctgctcgccgacacccgctacgagtggtccgttctcgactacgccatctgggcagccggtgccgtgagtgtcccgatctacagctcctcctccctgtcccaggtgcagtggatcatcgaggactccggtgcggtcctggccatcaccgagacccccgatcacaccgacctgatgaaacatctcgtgctcaccgaggacggcaccccggcgctgaaggggtccacctccaagctgcgtcgcatcctggagatcaactcctccgcactggacaccctcaggtttgagggccgcgagctgtccgacgacctggtccgggaacgcatcgaagccacccgctccgccgacctggcctccctggtgtacacctccggaaccaccgggcgtcccaagggctgcgaactgacccaccacaactggctggccgaggtccgcgcgctgctgacccacccgatcggcgcgatcgcggtacccggctcccgggtgctcaccttcctgccactggcacacgtcctggcgcgtgcggtctccctggcgttcaccatcggcggcgccacccagtcccactggtcagacttctccaccctggcactggaactgcagcgtgcccgcccgaacttcatcctcggtgtaccacgtgtgtttgagaaggtccgtaactctgctgccaccaatgccgctgacggtgggccggtcaaggccgccctgttcgcccgcgcggagaaggccgccatcgactactcccgggcccaggacaccgaggaggggccgagcagggtcctggctgccgcccacaaggtcttcgaccgtctcgtctacgccaagatccgtgcggccgtgggcaactccgtgcagtacgcggtgaccggtggatccgcgatgagccatgatctgctgcacttctaccgtggcatcggcatcccgatctacgagggttatggtctgaccgaaaccgcggcggcggccgcgatcgatttcgaggaccagaagatcggcaccgtgggcaagcccctgccgggcatgaccatccgcatcaatgaccagggggagatcctgctcaaggggcagatgctcttccgcggttattggaacaacccgaaggcaaccgcggaatccatcgtcgatggttggttcaacaccggtgacctgggtgaactgctggattccggacatctggtgatcaccggccgcaagaaggatctcatcgtcaccgccggcggcaagaatgtctcacccggaccactggaggacatcatccgggcgcacccgctgatcagccaggcaatggtggtcggcgacggcaagcctttcgtcggtctgctggtgaccctggatccggatgcactcaagcggtggaagctcaaccgcaacatcccggagtcccggaccattgaggagttggccacggaaccggccctgcgcggtgagatccaggacgccatcaacaacgcgaatgccaccgtctcccactccgaggccatcaagcggttctacatcctcgaccgcgacctcaccgaggaggacgatgagctgaccccgaccctcaaggtcaagcgcaatgtggtctaccgtcgctacgccgacgccatcgagcacatctaccgcggaaagtag

SEQ ID NO: 14227 - protein, 682 aa, Corynebacterium efficiens YS
MIWCRSFNEVTLVVPAGAGTETLWINEPIGPGEHTPGGSRGPHTPRAPMPRWIRGEPTTHGRREHEMTSASQPREFTVEAEYTIGENETCLTALIDQVKTRPYGVLFTRPANFEWVNVTAQEFLNEVFAVAKGIIATGVEQGDRVALLADTRYEWSVLDYAIWAAGAVSVPIYSSSSLSQVQWIIEDSGAVLAITETPDHTDLMKHLVLTEDGTPALKGSTSKLRRILEINSSALDTLRFEGRELSDDLVRERIEATRSADLASLVYTSGTTGRPKGCELTHHNWLAEVRALLTHPIGAIAVPGSRVLTFLPLAHVLARAVSLAFTIGGATQSHWSDFSTLALELQRARPNFILGVPRVFEKVRNSAATNAADGGPVKAALFARAEKAAIDYSRAQDTEEGPSRVLAAAHKVFDRLVYAKIRAAVGNSVQYAVTGGSAMSHDLLHFYRGIGIPIYEGYGLTETAAAAAIDFEDQKIGTVGKPLPGMTIRINDQGEILLKGQMLFRGYWNNPKATAESIVDGWFNTGDLGELLDSGHLVITGRKKDLIVTAGGKNVSPGPLEDIIRAHPLISQAMVVGDGKPFVGLLVTLDPDALKRWKLNRNIPESRTIEELATEPALRGEIQDAINNANATVSHSEAIKRFYILDRDLTEEDDELTPTLKVKRNVVYRRYADAIEHIYRGK

SEQ ID NO: 14228 - DNA, 1866 bp, Bifidobacterium longum
  CDS (1)..(1866)
atggggagtatgactgaaaacatcgctgataaggccataaacgatactcgtatcgtcaagcagttcaccaatcccgtcaaggagccgattgacagcgacatcaacctgttcgatctgctcgataaccgcgccaagcgcgatcccgaaggtgccatgatcgaatacaagggcgatgatggcacttggcacccgtacagcgcccaagtattccgtgacatggtcatcgacttggccaagggcctggtcggacttggtgtcaacaagggcgattcagtcgccatcgtctcgcgcacccgctgggaatggaccgcgctggatatggcgatcatgtccatcggcgcgctcaccgtgccggtgtacgagaccaactccgccagccaggtcagctggattttcaacgattccaaagtcacgctcgccatcgccgaagatgacgggcagcgtgacaagatcgaatccgtgcgcgatgaggtgcccaccctgcgcaacgtgttcgtaatcgaggccggcggtctgaacgccatcaagacctacggcgaaagcgtcaccgacgccgaattctgggaatacaaggaagcctcccacggcgacgaccgcgccaccatcgtctacacatccggctctacaggcaccccgaagggcgtggaactgacccaccgcaacttcgccttcctggtgctttccgcgctgcagtacatgcctcgtgccggcgcatggcccaaccgccgtctgctgctgttcctgcccctgagccatgtgttcgcccgattcctggaattcttcagttttggcggcacgatttcgctggccctgagctccaatatgaagacgatggtcaaggacttcgagaccttcggtcccacgctgctgctcgccgtgccgcgtgtgtacgagaaggtctacaacgccgcctcccagcgcgccggcaccggattcgctggcaagatgttcatgcgcgccgccgaaaacgcgcgcgaatggtccaaggccgagcagaagggcgaacagctgccgattgccggacgtatcgcccacgccttctatgagcaggtggtgtacaagaagattcgcacgattttcggtccgaacgccgacttcgccattaccggcggtgccccgatggactctgagctttcccacttcttcaacggcatcggcatgccggtgcttgagggctatggcatgaccgaaacctgcggcccggtgtgtgtgagcttgccagaggacaaccgcatcggcaccatcggcatgccgatgtgcggtatcaccgccggcattgccgaggacggcgagctggtggtcaagggaccgctggtgtgcaggggctaccacaacaaccctgaggtcaccacccagcagatcaccgatggctggctgcacaccggcgatttgggcgatatctccgaagacggcttcatctccatcaccggccgtaagaaagacctcatcatcaccgccggcggcaagaacgtgtcgccgggtctgctggaggcttccgtaatgacctcgcctgtggtcaaccagtgcttggttattggcgataagaagccgttcgtggccgctctggtcacgctggatctggcggatgccaacaaatggctggaatcccagggcgccaagccggaacccgatctggcctcgctggccaagaacgccatcgttcatgccgaggtggagcgtgcggtgaacgccgccaacgagggcgtttcccgcgccgagtcgattcgtaagttcgagattctgcccgacgaattcaccgaggccaacggcatgctgaccccgagcctgaagacccgtcgcgcgcaaatcgttgagcactatcgcgagctcattgacaacgtgatctacgtcccgctgaagaagtaa

SEQ ID NO: 14229 - protein, 621 aa, Bifidobacterium longum
MGSMTENIADKAINDTRIVKQFTNPVKEPIDSDINLFDLLDNRAKRDPEGAMIEYKGDDGTWHPYSAQVFRDMVIDLAKGLVGLGVNKGDSVAIVSRTRWEWTALDMAIMSIGALTVPVYETNSASQVSWIFNDSKVTLAIAEDDGQRDKIESVRDEVPTLRNVFVIEAGGLNAIKTYGESVTDAEFWEYKEASHGDDRATIVYTSGSTGTPKGVELTHRNFAFLVLSALQYMPRAGAWPNRRLLLFLPLSHVFARFLEFFSFGGTISLALSSNMKTMVKDFETFGPTLLLAVPRVYEKVYNAASQRAGTGFAGKMFMRAAENAREWSKAEQKGEQLPIAGRIAHAFYEQVVYKKIRTIFGPNADFAITGGAPMDSELSHFFNGIGMPVLEGYGMTETCGPVCVSLPEDNRIGTIGMPMCGITAGIAEDGELVVKGPLVCRGYHNNPEVTTQQITDGWLHTGDLGDISEDGFISITGRKKDLIITAGGKNVSPGLLEASVMTSPVVNQCLVIGDKKPFVAALVTLDLADANKWLESQGAKPEPDLASLAKNAIVHAEVERAVNAANEGVSRAESIRKFEILPDEFTEANGMLTPSLKTRRAQIVEHYRELIDNVIYVPLKK

SEQ ID NO: 14230 - DNA, 2088 bp, Bifidobacterium longum
  CDS (1)..(2088)
atgcgtgaacatgtagaagaacccagatatgtcaccaccgatgacgacaccgtctactcgctgctgtccaaacgagcagctcgcacgccggatgacatcatcgcggaatggcaggatgacaacacccaccaatggcgcagcgccacagctactgaaatgctgtcccgcgtacgcgaggtggccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagatccgtgtcaatcatccgggcatgaaatacgtgttcaatttcaaggccgatggccttgacgctgtcgttgacttcgggcatggcgtatccgatgagacgttggatgcggctatcgctcgtatcaaagccgatgatctgctcaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccgctggcgcactgcttcgcccgctacatccagtacgtgtgcatcggtggctgcggcgtggtcggatacattcccgacaccaagcgactgctcgccgatatccgcagcttcaagcccacctacctgctgggcgtgccacgtgtgttcgagaaggtgtataacgcggcctcgcagaaggctggtgccggcatccaggggcatatcttcgcccagtcggtcaagcacttcgtcaagtggagcaaggatgagcaggccggtcgcggccattcgttcatcgagcgcatgcgccattcgttctacatggccacggtgggcaaatccattcgttccgctctcggaccgaacctcaaatggctggcctgcggtggtgcgccgctcaacgtggatttggcccactttttcaacggcatgaatgacatcaccttcatccagggttatggcatgaccgaaaccgccgctccgatgctcgtcaattgggaggacgacaacgagatcggttcggtcggcaagcctgggcctggcatgggcgtgcgtcttggcgaagacgatgaaattgagctgaccggcccgaacgtgttccttggctactacaagcagcccgaactcaccgcacagacgatgactgccgacggctggatcaaaaccggcgatctgggtcgtatcgacgaccgcggcttcaccttcattaccggacgcaagaaggacatcatcatcaccgccggcggcaagaacatcagccccgccccgatggaggatgtcatcgacacctgcccgatcgtggctcatgcagtagtagtcggcgacggcaagccgttcgtgtccgcacttatcgagctcgaccccgaaatgctgcattcctggctggaaggtcagggcctcaatgccgacatgacactcgccgaggccagcgacaacgacgcggtgcgcgcctttatccagcagtacatcgaccaggccaacgccaatgtctcccgcgctgagtccgtgcgcaaattcgcggtgctggatgaggaattcagtcaggagcacggcacactcaccccgagcatgaaagtggtgcgtcccaaggtattgcagcgctacgccaccgtcatcgaggaggatctgtacgcgcccaagccatccaacaagccgctgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgctgacaatgccgctgacaccggcagcaagccggaccagccggctgacgagaagaatgaggagtaa

SEQ ID NO: 14231 - protein, 695 aa, Bifidobacterium longum
MREHVEEPRYVTTDDDTVYSLLSKRAARTPDDIIAEWQDDNTHQWRSATATEMLSRVREVAKGLLGLGVKAGTMVLIYSPTCYEWGVADFACAAIGAVVVPVYETDSARQTAGIVEEVDPAIAFAGDFQRAQTLEQIRVNHPGMKYVFNFKADGLDAVVDFGHGVSDETLDAAIARIKADDLLTVVYTSGSTGKPKGAMLSNRNYTHIVLNGYEILRGMLYDDNRLLLFLPLAHCFARYIQYVCIGGCGVVGYIPDTKRLLADIRSFKPTYLLGVPRVFEKVYNAASQKAGAGIQGHIFAQSVKHFVKWSKDEQAGRGHSFIERMRHSFYMATVGKSIRSALGPNLKWLACGGAPLNVDLAHFFNGMNDITFIQGYGMTETAAPMLVNWEDDNEIGSVGKPGPGMGVRLGEDDEIELTGPNVFLGYYKQPELTAQTMTADGWIKTGDLGRIDDRGFTFITGRKKDIIITAGGKNISPAPMEDVIDTCPIVAHAVVVGDGKPFVSALIELDPEMLHSWLEGQGLNADMTLAEASDNDAVRAFIQQYIDQANANVSRAESVRKFAVLDEEFSQEHGTLTPSMKVVRPKVLQRYATVIEEDLYAPKPSNKPLPATAKIIDSTLETVKKSSESVKQASEQVKQASEQMKTSVSDSIASVSEKIKKSKAEPEEGETGDSADNAADTGSKPDQPADEKNEE

SEQ ID NO: 14232 - DNA, 2112 bp, Bifidobacterium longum
  CDS (1)..(2112)
atgggcgattacaatttgaactttgagaagcgttcgcctcatggctggacgacactgaaaggtttacaggagcaagacttgtcggttatcaattccttcacgcagcacacgatcaatctcacccgtaaggcgctcaggttgggatccgacttcgtccacccggtccacgacgacaccccggacgagcccgattacctgtccaacgccgacgtgccggtcgaggccaatatcgctttgcctcacagcgacgattgggacgacggccacctgaccgtcaccgacatcgaccccgtcaccggcctgctcaccacctccaccgaaggcaatccgccgctggacgaaggtacgtccatctacgacctgtatgcggaccgcgccgaacgtatgggcgatgagccgctgtacacctacaagtccggcaacgattgggtgaccgtcaccgccaacgagttcctggctgacgtgcgtgccgtggccaagggcctgattcattacggcctgaagaagggcgatgccgtggcattcatgtgccgcacttcctacgactgggacctgaccgacgcggcgatcatggcctgcggcggtgtgctggccaccgtctacgacaccgattcggccgagcagattcgcaatatcgtcaacaactccgatgcccgactgctgatcgtgcaggacacggacatgcgtaagaaggcggatggggccgtcgaagagtgcccgtccctggagcacatcatcaccatcgagaccggtggcttggacgagatcaaggcctacggcaccacggtctcggacgaggagctggacgagcgcatcgattcggtcaagaagaccgacctgtgttccatcgtgtacacctccggttccacggccgcgccgaaaggcgtggagatgacccacgagcactactgccagaccgcgctgaatctgccggcctacatgcccgatctgctgcacgacaagaggaacaccatcctgctgttcctgccgcaggcccattccttcgcccgcgccatcaactacatcgtcgtctcctcgaacgtccgcatctacatcgccaccggcatcaagacgctgatcagcgatctgcaggtggccaagcccactctcatgatcgtggtgccgcgcgtgctggagaaggtgtacaacgccgcgtcccagaaggccggccacggccccaagggcgtggtgttcgcctccgccgtggtggccgcgcagaactatatgaaggaggtctccgccaatggcaaggcaggtgcactgacccgcactcgccgcgctgccttcgatccgattgtctactcttcgctgcgcgaagtgctcggcggtcgcgccaagtggattgtggccggcggtgccccgcttgacccggaactgctggctttcttccgtggcgcgggtgtgcctgtatacgagggctatggtctgaccgagaccaccgcaccgtgcgcgttcagcccgctgggtacgccgttccacgctggttccgtgggcatcgcattccccggattctccctgcgcatcgccgaggacggcgaaattcaggtcaagggtcgtgccgtgttcccgcgctatcacaagaacgacgaggccactgagctgtcgttcaccgaagatggctggtatgtcaccggcgacttgggccgtatcgacaacgatggcttcctgtacatcaccggtcgtaagaaggatctgattatcactgcaggtggtaagaacgtctcccccggcccgatcgaggaagtcattcagcgttgcgagttcgtctcccaggcactggtgctgggtgataagcgtccgttcatctccgcattggtgacgctggacgaggagtcgctgcgcccgtggctggccgccaagggcctggacgagaacatgccgctggaggatgccgccaagaacgccgccgtgcgcgccgaagtgcagaagtgggtcgatcaggccaacgagggcgtctcccgcgccgagtccgtgcgcaagttcatcatcctgcccgaggagttcactcaggaaaacggcctgatgaccgcttccatgaaggtgattcgtcccaaggtcatcaagcgctactccaccctcctcaacacccagatgtacacgaagcggaagtaa

SEQ ID NO: 14233 - protein, 703 aa, Bifidobacterium longum
MGDYNLNFEKRSPHGWTTLKGLQEQDLSVINSFTQHTINLTRKALRLGSDFVHPVHDDTPDEPDYLSNADVPVEANIALPHSDDWDDGHLTVTDIDPVTGLLTTSTEGNPPLDEGTSIYDLYADRAERMGDEPLYTYKSGNDWVTVTANEFLADVRAVAKGLIHYGLKKGDAVAFMCRTSYDWDLTDAAIMACGGVLATVYDTDSAEQIRNIVNNSDARLLIVQDTDMRKKADGAVEECPSLEHIITIETGGLDEIKAYGTTVSDEELDERIDSVKKTDLCSIVYTSGSTAAPKGVEMTHEHYCQTALNLPAYMPDLLHDKRNTILLFLPQAHSFARAINYIVVSSNVRIYIATGIKTLISDLQVAKPTLMIVVPRVLEKVYNAASQKAGHGPKGVVFASAVVAAQNYMKEVSANGKAGALTRTRRAAFDPIVYSSLREVLGGRAKWIVAGGAPLDPELLAFFRGAGVPVYEGYGLTETTAPCAFSPLGTPFHAGSVGIAFPGFSLRIAEDGEIQVKGRAVFPRYHKNDEATELSFTEDGWYVTGDLGRIDNDGFLYITGRKKDLIITAGGKNVSPGPIEEVIQRCEFVSQALVLGDKRPFISALVTLDEESLRPWLAAKGLDENMPLEDAAKNAAVRAEVQKWVDQANEGVSRAESVRKFIILPEEFTQENGLMTASMKVIRPKVIKRYSTLLNTQMYTKRK

SEQ ID NO: 14234 - DNA, 1974 bp, Oryza sativa
  CDS (1)..(1974)
atgatgaagcacttggtggagtcggagaaggcggcggagaatgccgggccgacgtaccggaacgtgctggccaaggacgccgggcttctgcggccgccgccgggggtcgagagctgctgggacgtcttcaattcggtggagaagtacccggacagcccgatgctcggtcgccggagagtcgtcgacgacggcaaggcaggtgaatatgtttggatgacttacaaggaggtttatgacgttgtgatgaaacttgctgcctccattagcaagtcaggaatcagcaagggtgaaagctgtggcatctacggcgcaaactgccctgaatggatcatcagcatggaggcttgcaatgcacttggggtttcatgcgtgcctctctatgatagtcttgctggtgcagtggagtttatcgtgtgccatgctgaaatccagattgcttttgtggaagagagaaaaatcgcagagctcttgaaaacttgtcatgccacatcaaagtatttgaagatcatcagctttggaggtgtgacaaatgaccaaaaagaggaggctaaaaatcatgggatgtccatattctcatgggaggaattcctgatcatgggaggtgatcatcattttgatcttcctgaaaagaagaaatctgacatctgcacaataatgtacacaagcgggacaactggagaccctaaaggtgttatgatatcaaatgaaagccttcttgttaacatcactggtgctgattgcgtgaccaggtctattggcgaaccttttgatcatgatgatgtttatatatcgtatcttccactggctcatatctttgatagaatctttgaagaattattcatttcacacggatcaaaaattggattttggcgtggggacgtcaagctgttggtcgatgacattgcagctctaaaaccaacagtattctgtgcagttccacgagtacttgatagaatatactcacttacaggaaagatctcgtctggtggcatactgaagaaagctttattcaatattgcttacaagaaactggacagcatgaggaaaggaattaaacacgagaaagcagctccattttttgacaaattagttttcagcaaggtgaaagaaagactgggtggaaaactacgttttatcgtgtctggtggtgcccctttatctgtagcagtggaagaatttttgagggttgtgacatgtgcaagtgttgttcaaggctatctcacggaaactggtgcggcgtcatttgttgcaataccaaatgatttttccatggttgggactgttggtccaccagttgagcatttggatgcacgtcttgagtcagttccagagatgggctatgacgctttgtcgagcattcctcgtggagaggtatgtgtaaaaggaagtgttctattctcaggatactacaaaagggaggatcttacacaggaagtcatgattgatggatggttccacacagatgactatatgccaaataccatgtataatacaggggatgttggcgagtggcaaccaaatgggtccttgaaaatcattgacaggaagaaaaatatattcaagctttcacagggagaatatgttgcagtagaaaatctcgagaatgtgtacggggttctccaagagatagattcgatatggatttacggaaatagttttgaatctttccttgttgctgtcataaatcccaaccaacaagttcttgagcattgggctgaacaaaatggtatctctggaagtttatctgaattatgtgaaaattcaagagctaaagaatatattctttcagaactcacgaagattgcaaaggaaaagaagctgaaaggctatgagttcataagagctgtacatcttgacccattaccatttgatatggagcgtgatcttataaccccaacatacaagaagaaacgaccacagttgcttaagcactatcagggaaccattgacgcactctacaagatggcaaagtaa

SEQ ID NO: 14235 - protein, 657 aa, Oryza sativa
MMKHLVESEKAAENAGPTYRNVLAKDAGLLRPPPGVESCWDVFNSVEKYPDSPMLGRRRVVDDGKAGEYVWMTYKEVYDVVMKLAASISKSGISKGESCGIYGANCPEWIISMEACNALGVSCVPLYDSLAGAVEFIVCHAEIQIAFVEERKIAELLKTCHATSKYLKIISFGGVTNDQKEEAKNHGMSIFSWEEFLIMGGDHHFDLPEKKKSDICTIMYTSGTTGDPKGVMISNESLLVNITGADCVTRSIGEPFDHDDVYISYLPLAHIFDRIFEELFISHGSKIGFWRGDVKLLVDDIAALKPTVFCAVPRVLDRIYSLTGKISSGGILKKALFNIAYKKLDSMRKGIKHEKAAPFFDKLVFSKVKERLGGKLRFIVSGGAPLSVAVEEFLRVVTCASVVQGYLTETGAASFVAIPNDFSMVGTVGPPVEHLDARLESVPEMGYDALSSIPRGEVCVKGSVLFSGYYKREDLTQEVMIDGWFHTDDYMPNTMYNTGDVGEWQPNGSLKIIDRKKNIFKLSQGEYVAVENLENVYGVLQEIDSIWIYGNSFESFLVAVINPNQQVLEHWAEQNGISGSLSELCENSRAKEYILSELTKIAKEKKLKGYEFIRAVHLDPLPFDMERDLITPTYKKKRPQLLKHYQGTIDALYKMAK

SEQ ID NO: 14236 - DNA, 4382 bp, Plasmodium falciparum
  CDS (591)..(3506)
taaaaataaataataataataaaaataaaaaaaaaaataataataataataataaataatgaaccaaataatattttataatattataaaaatgttttatatttgtattttataaaaatatccctcttgtttttgttctatttttttttttttttttttttgtaatatatatatatatatataatatatttttatttatttaatttctttttgcgtagtggttaaaatatatagaacaagagggaataattattaaagagtttaccaagattgtatgtaaaatattattttatgagatgaaatacgttttattatgttatatatatatgtatcatcattttaaataataatacatagaaaaaaaaagatatatatatatatataaatatataatatattctaatgataattccaaaaatgtaacataataatatatttgttcctaatttataataaaatacatatatattttttttgaaaatattattgtttagaaaataattatattattattatatatatatatatatatatataatatttaaatggtttaatttattttttattttattttatttttttgttatattatgaatattatatttaccgtatgtactttttttatttatctaatatttgtgataggatatgtaacacaaataaatggaagatcgaagtgtttttcagaaatatatgaaaaggcatgcaatgaagaagaatcaaatgtatattgtataaaagatcataagaagaaaagttctgtatatacttttaaacacattttgaaattattattagaaaaaaagaaatcagacaatgataaaataggtttcgtagaaaatagttgtggtgaaataaacaattttatgacatatggaaccttttatgaaaaggtttgttcatttagtcattctttagatacttatggagggaaaggtattgaagccaggaaatatgatgaagataaaaataatggtatgtttaaattattgggtttatatgggagtaattctataaattggctagttaccgatatgggatgtatgatgagtggtgtcactacaatagtaatgcattctaaatttagcatagatttaattgtagatattttaaaaagaacacagctagaatggttatgtatagatttagatttggttgaaggtttattgtgtcatataaaggaattaccacatttgaaaaaactaataatattagatactttagttaaatataagaaaaaaggtattaacgaggaagaaagtgatgatgaaaagaaatatgaaggattaaggaaagacagcaacaataaaaaaaacaacaaaaataacaaagacaacaaaaataacaaaggcaacaaaaataacaaagacaacgaaaaaaaccaccaccaccacaacaacaacaacagtattaataataagaagaataagaccgagagagagggggagggggggaaaaatgcactacatgaattttccaatttagaaaaagatgttagctcagggtcatttgaatatgataaggaaaaattagaaaagcttaatgttttaaaagagaaagccaaggaatttggaataagtattatagaatttgataatatgacaaagggtattaaaaagacaaatatgaagattcagaatgaagatcctgatttcattacatctattgtatatacttctggaacatctggacaaccaaaaggtgttatgttaagcaataaaaattttcatagcacagtagcaccattatgtgatcataatgtaataaaaaacatgaaaccgaaaacccatttttcttatttacctgtatcacatgtatttgagagagttttggtttatatggctgttattcttggtataaaaataaatatatcgagtaaggatattagttgtttttctaaagatttatataattcagatgttgaggtacttgcaggtgtacctaaagtgtttactagaatatatacaaatattatgacagaaataaataatttgccagttttaaaaaaatcgttagtaaaaaatattttatctttacgtaaacattttaataatggatcttttggtaaatttattgagaaatgtactaatatatcttctcgaataaaaggtaatgtgaatccaaaaatgcaaatgttattaaatggtggtggtaaattatcttcaaaaattgctgacgaattatgtgttttgttaaatgttgattatattcaaggatatggattaactgaatcgactggtgctttgtttgtacaagatggattaggatgtaatactgaaaatgtaggtggacctatttcttctagtaccagatataaattaatttcttgggaaaaatataaggcgaatgatttatgtcctaaaggagaattatttgttaagagtgattctatgtttagtggttactttttagaaagagaatatacaaagaatgcatttactgatgatggttattttaaaacaggtgatgtttttcaaataaatgaagatggttctttaacatttttagatagatcaaagggtttggttaaattatctcaaggagaatacatagagaccgatatgttaaataatctttattctgtgattctttttgtaaatttttgtgttgcatatggtgatgattctatggatggtcctctggccattatatctgttgataaaagtttattgttcaaatgtttaaaagaagataatatgttagaaggtactggagttaatgaaaagaattattcagaaaaattaattgacgaaatattaaatcaatctatttatgttgattatgtaaaggggaagatgatggaagtatataagaaaaccaatttaaacagatataatattattaatgacatatatttgacttccaaaacgtgggacatgaataattaccttactccgacattaaaaataagaagattcaatgtatttaaagatttttctttttatatagatcaagttaaaaagaaatatgaagacaaattaaaaggcagtagtacagatagtaagagtagtgtaaagagtggtggcaagaaggaagaaaaggaaaataaaaagaacgatataggggaaaataaagtaaaaagtgaggtaaaaaatgaggtaaaaaatgaggtaaaaagtgaggtaaaaaatgaggtaaaaagtgaggtaaaaaatgaggtaaaaaatgaggtaaaaagtgaggtaaaaagtgaggtaaaaaatgaggtaaaaaatgaggtaaaaagtgaggtaaaaagtgaggtaaaaagtgaggtaaaaagtgaggtaaaaagtgaggtaaaaaatgaggtaaaaagtgaggtaaaaagtgaagaaaaaaatgaaaagaaagcaaaagaacgattaacaaaatcaaaaatatcaaaacctgaacaaagaaatgttttaaaatgtgaacaaaataatgctgtatgtaattttccgacaaataagaaaatagttaaagaaacaaacttaaaacaattaagagttccaaatgtacccgaattacaagtcaatgcataaataatatggaagttcaataattgggatatgaaataaaaaataattgaaaggtatattaagatatataaaggttttctcagaaatgatttattaacattatttattattattttattttatactattttttttgttttattttattttattttattttattttactgggtttggtttggtttgttttacttaattatttatttatttatttatttaaatatttttttttttttttttttttctattttattttttttttttttctattttatttttttttttttttgttatataatttttgtatataccaaaagataaaagttgtcatccaaatgataaatccatttattaatttaattcattttttaaaatatttttgtataaacaatatacattttaaaattttagataatgagaaataatatactcattatatttagacataaaattatatttttttaatatatttatatttttatgtataacatataagaaaaaaaaaaaaaaaaaaaaaaaaaaaattgttacctccttgtataagatactaatttatttaaagtttacattatatatgtatatattttcaaatataattaaatatatatatatatatatataattttttttttttatatatgtatttttattattttatttttgttttattatattataaataatttttgatattgttattcactaagatattttaaatgattaactgattcaatatatattatatatgtttttacatttttaattaatttttatcttttttaagtttcaaaaatatttagcattacaatgaataatttggtaaagatttaagagtataatatgaaaatatatattatatatatattatatatatatttag

SEQ ID NO: 14237 - protein, 971 aa, Plasmodium falciparum
MNIIFTVCTFFIYLIFVIGYVTQINGRSKCFSEIYEKACNEEESNVYCIKDHKKKSSVYTFKHILKLLLEKKKSDNDKIGFVENSCGEINNFMTYGTFYEKVCSFSHSLDTYGGKGIEARKYDEDKNNGMFKLLGLYGSNSINWLVTDMGCMMSGVTTIVMHSKFSIDLIVDILKRTQLEWLCIDLDLVEGLLCHIKELPHLKKLIILDTLVKYKKKGINEEESDDEKKYEGLRKDSNNKKNNKNNKDNKNNKGNKNNKDNEKNHHHHNNNNSINNKKNKTEREGEGGKNALHEFSNLEKDVSSGSFEYDKEKLEKLNVLKEKAKEFGISIIEFDNMTKGIKKTNMKIQNEDPDFITSIVYTSGTSGQPKGVMLSNKNFHSTVAPLCDHNVIKNMKPKTHFSYLPVSHVFERVLVYMAVILGIKINISSKDISCFSKDLYNSDVEVLAGVPKVFTRIYTNIMTEINNLPVLKKSLVKNILSLRKHFNNGSFGKFIEKCTNISSRIKGNVNPKMQMLLNGGGKLSSKIADELCVLLNVDYIQGYGLTESTGALFVQDGLGCNTENVGGPISSSTRYKLISWEKYKANDLCPKGELFVKSDSMFSGYFLEREYTKNAFTDDGYFKTGDVFQINEDGSLTFLDRSKGLVKLSQGEYIETDMLNNLYSVILFVNFCVAYGDDSMDGPLAIISVDKSLLFKCLKEDNMLEGTGVNEKNYSEKLIDEILNQSIYVDYVKGKMMEVYKKTNLNRYNIINDIYLTSKTWDMNNYLTPTLKIRRFNVFKDFSFYIDQVKKKYEDKLKGSSTDSKSSVKSGGKKEEKENKKNDIGENKVKSEVKNEVKNEVKSEVKNEVKSEVKNEVKNEVKSEVKSEVKNEVKNEVKSEVKSEVKSEVKSEVKSEVKNEVKSEVKSEEKNEKKAKERLTKSKISKPEQRNVLKCEQNNAVCNFPTNKKIVKETNLKQLRVPNVPELQVNA

SEQ ID NO: 14238 - DNA, 2451 bp, Plasmodium falciparum
  CDS (1)..(2451)
atgagcattattttaacctttttagctttatttgtttttttaatttgtgtgtttccatgtattacggaagatactcataaatacgtgtactccgagatttgtggaaaaggggcgaatgaaaatgaatcaagcgtatattgtatgaaggatcataagaagaagaattctttatatgtttataaacatattatgaaatttttcatagataaatataaatcaattcccaatgaaatagcattagtagaacattcttatggggaaccccaaaattatataacatatgacaatttttttagaaaagtatcatcatttagtcatactttgaatacttatgaaggaaaaggtattgaatccaaaaaatataatgaaaaacaaaataatggtatatttaaattattaggtatatatggaagtaattcaattaattggctagcttctgatttgagtgcaatgatgagtggagttactacattagtgatgcattctaaatttagtattgatgtaattgtagatatattaaatgaaacacaattggaatggttatgtttagatttagatttggttgaaggattattaaatcatataaatgaattaccacacctaaaaaatcttataattttagataccttatctaaaaataaagaaataaatttaaataaggaagaaaataataatgataagaagaataaatcctcaggaaatagcactagtgtaaaaggaaatgatttatcgaacatgattgaaattacgtgttcaggtcctttggaatatgataaggaaaaactaaaaaagtataatgaattaaaaaaaaaatgtgagaaatgtggaaagaagctaatgttgtttgatgatatgacaaagactcaaactaaaaaattcactattaaaaatgaagaccctgattttgttacgtctattgtatatacctctggaacatcaggaaaaccgaagggtgttatgctgagcaataaaaatatttacaatcaattattttcattatataatcatagtgtaagagaaaggtatagttttaaaaatcatttatcttatttacccatatctcatgtgttcgagagaacatttgcttatagtatattaatgtatggtggaacattaaatgtatggggtaaagatattaattatttttctaaagatatatataatactaaggaaaatataatgggtggggtacctaaggttttttgtagaatttatactaatataatgacagaaatagacaatttaccatctcctaaaaggcggcttgtaagaaaaattttatctttacgtaaatctgatcacaatggtccttttagtaaattccttgaaagcatttttcatatatcgaaaaaaataaaagataaagtaaatcctaatttggaaattatactaagtggcggtgggaagttatcaccagatatagcagaagaattttgttatttattaaatataaaatattgtcaaggttatggtttaactgaaactgcaggtgctattcttggtaatcatgcagatgatgaacatttcgaatatataggaggtcccattgcaccaaatacaaaatataaagtaagaacatgggaaacatataaagcaactgatacactgccaaaaggtgaattattaattaaaagtgattccatgtttagtggatactttttagaaaaggaatgtaccaaaaatgccttcacagatgatggttattttaaaacgggagatattgtacaaattaatgataatggttctgtaacctttttagatagatcaaagggtttggttaaattgtctcaaggtgaatacatagaaacagatttattgaataatctctattcgcaaattagttttataaataattgtgttgtatatggtgacgattcaatggatggtccactagccataatttcagtggataaatatttactttttttaagtttaaaagatgataatatgttagaaatgactggagttaatgaacaaaattatttagataaactaactgatgataatataaataataatatttttcttgattatgttaaagaaaaaatgttagaagtttataaggaaacaaatttaaatagatacaatattattaataacatatatttaacttcaaaagtttgggacacaaataattacctaactccaacatttaaggttaaaagattttatgtatttaaagattatgcatttttcattagtcaggttaaagaaatatataataataaattaaaaggatgtgctcctattagtgtgaatagtgaaaacaaggacgaagaaaaaaaaaatgatagcaaaaaaaaggaagaaaaagattcagaaaaattatcaaatgagtctacttcaaatcaaaataaaaacgatatgggaaaacatgaaaaatatgttgaaaataaaaaggtcaaattgggagctacatatggaacacgtcaaaaagaaatgaataaatga

SEQ ID NO: 14239 - protein, 816 aa, Plasmodium falciparum
MSIILTFLALFVFLICVFPCITEDTHKYVYSEICGKGANENESSVYCMKDHKKKNSLYVYKHIMKFFIDKYKSIPNEIALVEHSYGEPQNYITYDNFFRKVSSFSHTLNTYEGKGIESKKYNEKQNNGIFKLLGIYGSNSINWLASDLSAMMSGVTTLVMHSKFSIDVIVDILNETQLEWLCLDLDLVEGLLNHINELPHLKNLIILDTLSKNKEINLNKEENNNDKKNKSSGNSTSVKGNDLSNMIEITCSGPLEYDKEKLKKYNELKKKCEKCGKKLMLFDDMTKTQTKKFTIKNEDPDFVTSIVYTSGTSGKPKGVMLSNKNIYNQLFSLYNHSVRERYSFKNHLSYLPISHVFERTFAYSILMYGGTLNVWGKDINYFSKDIYNTKENIMGGVPKVFCRIYTNIMTEIDNLPSPKRRLVRKILSLRKSDHNGPFSKFLESIFHISKKIKDKVNPNLEIILSGGGKLSPDIAEEFCYLLNIKYCQGYGLTETAGAILGNHADDEHFEYIGGPIAPNTKYKVRTWETYKATDTLPKGELLIKSDSMFSGYFLEKECTKNAFTDDGYFKTGDIVQINDNGSVTFLDRSKGLVKLSQGEYIETDLLNNLYSQISFINNCVVYGDDSMDGPLAIISVDKYLLFLSLKDDNMLEMTGVNEQNYLDKLTDDNINNNIFLDYVKEKMLEVYKETNLNRYNIINNIYLTSKVWDTNNYLTPTFKVKRFYVFKDYAFFISQVKEIYNNKLKGCAPISVNSENKDEEKKNDSKKKEEKDSEKLSNESTSNQNKNDMGKHEKYVENKKVKLGATYGTRQKEMNK

SEQ ID NO: 14240 - DNA, 2022 bp, Plasmodium falciparum
  CDS (1)..(2022)
atggataatggtaataatgaaatactgtactcagtaaaaataagcgaaccaagggacaagaactctactggtatatatcgtcatcctgagtataaagataaattatgtgaaaattttgatgataagaaatttaataatatgtgggaagtgtttgatagagtatcaactaaattcaaggaaagagattgtatgggtgttcgtgagaaattagaagataacaaacgtggtgcttaccaatggaagaattttggagaggtgaaagaattaataatgaaagtaggatctggtttgcttaatatgaatgcttgcccattaattatgtgtgatgatcaaagaattccaaaggctcgttttttaggtttatatatgcctaattgtccagaatggaatatttgtgatttaggatgtaatgcatacaatattattacggtaccattatatgattctttaggtcctcaatcaagtagatttatattagatcaaacacagatggaaactattgtatgtgacaagacatgtgctcgtaatttatttaagtccttagaaacatgcgaagagatatatttgaaaacattaattttagttgatgaaatagatgacgaaattaaaaaagagtgttcaaaatataatttgaaaattatattatgggaagaattaattaaacaaggtgaaaaaaaaattgtaaaagtaccacaaggagcattaaataatatattttcgatatgttatacatcaggaacaacaggttatcctaaaggagttattatgacaaatagaaattttataggtatattagcagctgcttatattggtccatctaggttaccagatttatgtattaatgaaaatgatatacatatatcatatttaccattagcccatatatatgaaagattaatgatttatttatttatggctcatggtgtaaaagtcggttattactcaggtaatgtacagacattattagaagatattcaagaattaaaaccaacattatttattagcgtaccaagattatataatagaatacatgaaaggatatttaattctttaaagaaaaaatctggtttagttcaatcattattcaataaaggtttacaaaacaaaataaaaagattaagttcttctggttcgacaactcatgtattatgggataaattacttttcaataaagctaaaaaaattttaggtggacatgtaagagctatgttaaatggttcagcaccaataagtgtcgatgttgtcaaaaaattaagaaccatcttttgtgtacctatgtttgaaggttatggaatgactgaatctttgggtgcttcttttatcacacattcgcaagatcgtaatattggacatattggaggtcctgtcccatgtattgaatttaaactagtatctgttcctgaaatgaattatttagtaacagataatccacctaaaggtgaattgtatttaagaggaccaagtacatgcaacctaggttatttcaaattagaaaaagaaacaaatgaattattagaaaaagatggattcattcgtacaggagatattgccttattaagtccaaatggatccttaaccattatagatagaaaaaagaatatttttaaattagcacaaggagaatatgtagctgtagaaaaagtagaggcatcatataaacaatctttatttattagccaaatttttgtatttggatattcctatgaatctgttctcgtttgtgttatttgtccatcgacagattccatcgatatatggagaacacaaaagaaaatcaaagcaactgatgaagaagtaattaaattaccagaatttaaagcagatgttattaatgatttaacatccatagggaaaaaagacggactcaaaggatttgagcaaattaaggatattcatttcactcttgaggcatttactattgaaaatgatttaatgacacccacaggaaaaattaaaagacatgaagctaagaagagatttaaaaaggaaattgatgagatgtatgaaaagttgaagcaatag

SEQ ID NO: 14241 - protein, 673 aa, Plasmodium falciparum
MDNGNNEILYSVKISEPRDKNSTGIYRHPEYKDKLCENFDDKKFNNMWEVFDRVSTKFKERDCMGVREKLEDNKRGAYQWKNFGEVKELIMKVGSGLLNMNACPLIMCDDQRIPKARFLGLYMPNCPEWNICDLGCNAYNIITVPLYDSLGPQSSRFILDQTQMETIVCDKTCARNLFKSLETCEEIYLKTLILVDEIDDEIKKECSKYNLKIILWEELIKQGEKKIVKVPQGALNNIFSICYTSGTTGYPKGVIMTNRNFIGILAAAYIGPSRLPDLCINENDIHISYLPLAHIYERLMIYLFMAHGVKVGYYSGNVQTLLEDIQELKPTLFISVPRLYNRIHERIFNSLKKKSGLVQSLFNKGLQNKIKRLSSSGSTTHVLWDKLLFNKAKKILGGHVRAMLNGSAPISVDVVKKLRTIFCVPMFEGYGMTESLGASFITHSQDRNIGHIGGPVPCIEFKLVSVPEMNYLVTDNPPKGELYLRGPSTCNLGYFKLEKETNELLEKDGFIRTGDIALLSPNGSLTIIDRKKNIFKLAQGEYVAVEKVEASYKQSLFISQIFVFGYSYESVLVCVICPSTDSIDIWRTQKKIKATDEEVIKLPEFKADVINDLTSIGKKDGLKGFEQIKDIHFTLEAFTIENDLMTPTGKIKRHEAKKRFKKEIDEMYEKLKQ

SEQ ID NO: 14242 - DNA, 2436 bp, Plasmodium falciparum
  CDS (1)..(2436)
atgaatatttcatttacggtgtgtagcttatttatattactaattaatgttgttttacatggagcgcaaaagaattctgaaaaaaatgtatacacggaaatatgtgaaaagccagcgaatggaaatgaatcaagtgtatactgtatgaaagattacaaaaagaaaagttctttatatggttataaacatattatgaatttcttattaggaaatctaaataaacataaaaataatatagcagtagtggaacatgataatggtgaaccaaacaattatttgacttataatgatttttttaaaaaagttttatgttttagtaatacattgaatacttatgaaggaaaaggtattgaagaaaaaatgtataaaaaagaagaaaaaaataatggtaaatttagattgttgggtttgtatggtagtaattcaataaattggatagccgctgatatggcttctatgcttagtggtgttacaacattagttatgcactccaaatttagtttagatgtaattgtagatatactaaaggaaaccgaattagaatggttatgtttggatttagaattggttgaagggttattagctcatagaaatgaatttccacacttgaaaaatcttataatattagatacattaaataaatcaaataaaataaattctaaaggtttagaaaaaagtgataaaaacaaaaaatctaaggaaaaagataatggtttagttaatgttgattatgataaagaaaaattaaaaaaaataaaagatttaaaagtaaaagctagaagtgttggaataaatattatggaatttgatgagatgtcaagaaaagaacctaaaaaaataaaaataaataatgaagaccctaattttattgcttcaattgtatatacatctggaacatcaggaaaaccaaaaggtgttatgttaagtaatgaaaattttcacaatactgtagtaccattatgtgatcataatataataaaagaatataatcccaaaacacatttttcttatttaccagtatcgcacatatatgagagagttcttgttcatatcttattcatgttaggtggaactataaatatatggagtaaagatataaataatttctctaaagatttattaaattctaaaggtgaagtactagcaggtgttcctaaagtttttaatagaatttataccaatattatgacagaaataagtaatttacccccttttaagagatggttagtaaaacgtattatatctatgcgtaaggctaataataatggaagttttagtcaatttcttgaaggactttttaaaatttcttcaaaaattaaagacaaagtaaacacgaatttacaagttatattaaatggtggtggaaagttatcacccaaaattgctaatgagttaagtgttttattaaatataaattattaccaaggatatggtttaacagaatccactggtcctatttttgtgcaagatactagtgataacaatagtgaaagtatgggaatacctttttctccaaatacaaagtttaaagtaaaaacatgggaaacttataaagccaccgatgctttaccaaaaggggaattactgattaagagtggttctatatttagtggatactttttggaaaaagaaaatacagataaatcttttactgaagatggttattttaaaacaggggatgtggttcaagttaatagtgatggttcattaacatttttagatagatctaaggggttagttaaattatcacaaggtgagtatatcgaaacagatttgttgaataatctttattcacaaattagttttataaataattgtgttgtatatggtgatgattcaatggatggaccactaggtattctttctgtggataaatatttattatatagatctttaaaagatgaccatatgttagaaaaaactggaattactgaagataattataatgatagattaaatgatgaagatataaatcaatctatttttgttgaatatgtcaaagagaaaatgatggaaacttataatagtacaaaattaaatagatataacataataaatcatatttatttaacatctaaaatatgggatactaataattatcttacacccacattaaaggtgaaaagattctatgtatttaaggattataactttttcattgaagaagttaaaaaaacatataaacacaaattaaaaggagttgatgaagtcaacaaaaataaggaaaaaaaagaagagaagaagaatgaaaaaaataaaaaccaaaaaaatgaagagcaaaattcaaaagatatacataccaaaaacgcagttcagcaatcgaagttaaggcccacaaaagaaaattttacagaaaagaaagaagaaaaagaaaagaatacaaaattaagagtacgagctaaagatatgtcccaagaattagaattaaataaataa

SEQ ID NO: 14243 - protein, 811 aa, Plasmodium falciparum
MNISFTVCSLFILLINVVLHGAQKNSEKNVYTEICEKPANGNESSVYCMKDYKKKSSLYGYKHIMNFLLGNLNKHKNNIAVVEHDNGEPNNYLTYNDFFKKVLCFSNTLNTYEGKGIEEKMYKKEEKNNGKFRLLGLYGSNSINWIAADMASMLSGVTTLVMHSKFSLDVIVDILKETELEWLCLDLELVEGLLAHRNEFPHLKNLIILDTLNKSNKINSKGLEKSDKNKKSKEKDNGLVNVDYDKEKLKKIKDLKVKARSVGINIMEFDEMSRKEPKKIKINNEDPNFIASIVYTSGTSGKPKGVMLSNENFHNTVVPLCDHNIIKEYNPKTHFSYLPVSHIYERVLVHILFMLGGTINIWSKDINNFSKDLLNSKGEVLAGVPKVFNRIYTNIMTEISNLPPFKRWLVKRIISMRKANNNGSFSQFLEGLFKISSKIKDKVNTNLQVILNGGGKLSPKIANELSVLLNINYYQGYGLTESTGPIFVQDTSDNNSESMGIPFSPNTKFKVKTWETYKATDALPKGELLIKSGSIFSGYFLEKENTDKSFTEDGYFKTGDVVQVNSDGSLTFLDRSKGLVKLSQGEYIETDLLNNLYSQISFINNCVVYGDDSMDGPLGILSVDKYLLYRSLKDDHMLEKTGITEDNYNDRLNDEDINQSIFVEYVKEKMMETYNSTKLNRYNIINHIYLTSKIWDTNNYLTPTLKVKRFYVFKDYNFFIEEVKKTYKHKLKGVDEVNKNKEKKEEKKNEKNKNQKNEEQNSKDIHTKNAVQQSKLRPTKENFTEKKEEKEKNTKLRVRAKDMSQELELNK

SEQ ID NO: 14244 - DNA, 1647 bp, Hotaria tsushimana
  CDS (1)..(1647)
atggaaatggaaaaggaggagaatgttgtatatggccctctgccattctaccccattgaagaaggatcagctggaattcagttgcataagtacatgcaacaatatgccaaacttggagcaattgctttcagtaacgcccttactggagtggacatttcttaccaagaatactttgatattacatgtcgtttagctgaggcaatgaaaaactatggtatgaaacaagaaggaactattgctttgtgcagtgaaaattgtgaagaatttttcatccctgtacttgctggtctttacattggggtggctgttgcacctactaatgaaatttacacattgcgtgaacttaatcatagtttgggcatcgcacaaccaactattgtattcagctccagaaaaggcttacctaaagttttagaagtgcaaaaaacagttacatgcatcaaaacaattgttattttagatagtaaagtaaactttgggggctacgattgtatggaaacttttattaagaaacatgtagaattaggttttcgaccaactagctttgtacccattgatgtaaagaaccgtaaacaacacgttgctttgcttatgaattcttctggatctactggtttacctaaaggtgtactaattacccacgaaggtacagttacaagattctcacacgctaaggatccaatttatggaaaccaagtttcacctggtactgctattttaactgtcgttccgttccatcatggatttgggatgtttaccactttaggatactttgcttgtggataccgtgttgtaatgttgacaaaatttgatgaagaactatttttgagaactatgcaagattataagtgtaccagtgttattcttgtaccaacgttatttgctattctcaacaagagtgaattgatcgataagtttgatttatctaatctaactgaaattgcttctggtggagctcctttggcaaaagaagttggcgaagcagtcgctagaagatttaatctacccggtgtccgtcagggttacggattaacagaaacgacatctgcatttattattaccccagaaggtgatgataaacctggagcatctggaaaagtagtacccctattcaaagtaaaagttattgatcttgacactaaaaaaactttgggtgtcaaccgacgaggagagatctgtgtaaaaggacccagtcttatgttaggctacttgaacaatccggaagcaacaaaagaaactattgatgatgagggttggttgcacactagagatattggatattacgacgaagacgaacatttcttcattgtcgatcgtttgaaatcattaatcaaatacaaggggtaccaggtaccacctgctgaattggaatccgttcttttgcaacatccaaatatatttgatgctggtgtggctggtgttcccgattccgaagctggtgaacttccaggggctgtagttgtaatggaaaaaggaaaaactatgactgaaaaggaaattgtggattatgttaatagtcaagtagtaaaccacaaacgtctgcgtggtggcgttcgttttgtggatgaagtgcctaaaggtctaactggtaaaattgatgctaaagtaattagagaaattcttaagaaaccacaagccaagatgtaa

SEQ ID NO: 14245 - protein, 548 aa, Hotaria tsushimana
MEMEKEENVVYGPLPFYPIEEGSAGIQLHKYMQQYAKLGAIAFSNALTGVDISYQEYFDITCRLAEAMKNYGMKQEGTIALCSENCEEFFIPVLAGLYIGVAVAPTNEIYTLRELNHSLGIAQPTIVFSSRKGLPKVLEVQKTVTCIKTIVILDSKVNFGGYDCMETFIKKHVELGFRPTSFVPIDVKNRKQHVALLMNSSGSTGLPKGVLITHEGTVTRFSHAKDPIYGNQVSPGTAILTVVPFHHGFGMFTTLGYFACGYRVVMLTKFDEELFLRTMQDYKCTSVILVPTLFAILNKSELIDKFDLSNLTEIASGGAPLAKEVGEAVARRFNLPGVRQGYGLTETTSAFIITPEGDDKPGASGKVVPLFKVKVIDLDTKKTLGVNRRGEICVKGPSLMLGYLNNPEATKETIDDEGWLHTRDIGYYDEDEHFFIVDRLKSLIKYKGYQVPPAELESVLLQHPNIFDAGVAGVPDSEAGELPGAVVVMEKGKTMTEKEIVDYVNSQVVNHKRLRGGVRFVDEVPKGLTGKIDAKVIREILKKPQAKM

SEQ ID NO: 14246 - DNA, 3260 bp, Homo sapiens
  CDS (444)..(2606)
cggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactataaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14247 - protein, 720 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 14248 - DNA, 2052 bp, Gibberella moniliformis
  CDS (1)..(2052)
atgtatcatacagtgccctatacgatcgagtctccgggctatctcaaggtggcaggcgagagtcttcctcgtcgtcatcctcgagccaaacatggcctcctacgatatccctccgcaggagtgctaactgtcttcgatatcgtgcgccgtagcgctaaattgtaccctgataacaaggctgtcggtagccgaagactcatcaagatgcaccgcgagttcaagataatacaagacaaagaaaaagaatggatatactatgaattgggcccttacaattacttgagctattcacaatacgaactgctcgccatccagatcggctctggtctgcgcaagttgggcctctctagcagtaacaaggtatatttatttggtacgactagcgcaaattggatatccatgtcacacggatgtgcctcccaaggaattcccatcgtcacaggttacgacacgcttagtgcaacggacattcaacattctttgtcgcaaactcacgctgaggtgatatatcttgacccacatcttctgggtactgcaagcattgcactcgaaaactcccaagtaaaaaccgttattatcaatacaggttccatattttccgggggttacgatattgatcagttcaggaacgagcacccgcaattcaacgtaatcacgtatgaggaacttatccagcttggaagacacaatctgaaggaaccgatccccgtcaagtcatctgatctcttttgtatcatgtatacctctggctctacagggcttccaaacggttgctgcatcacccacgaaaactttcttgcaggcaagctgaccagatcctcaacagtcactggactattaggtggtatagatgacttcgttagcgaccaagaacgtgttcttgcatatttgcctttggcccatatcttcgagatggcacttgaaaatctggtcatgtatatcggcggcacactcggttatggtaaccccaagacccttactgatgcctctctccgagaatgtaatggagacatggttgagttcaagcctactataatggttggagtcccgcagatttgggagaccatcaggaaagctgtcctctccaagcttaactgctccggttttgttgccaaaacggtgttctggactgcgatgagcttcaagtcctttgccgtgaggtatagtctacctggcaaaggtgtattcgatgatttggtattcggcagagttcggcaaatgacaggtggacgactgcggtatatcctcaacggcagcagcggcatcgcagatagcaccaaggagttcctctcactaatagtggcagagatgcttacaggatatgggctcaccgagacatgtgccaatggtgcattgagctctccttttgagcaaacaactagcgcaatcggttccacttcacctgctatagatgtgaagctcgtctctattcccgagctggggtatttcacagatgcggacgctggcccttgtcaaggcgagatcttggtacgcggaccagcagtcttcaagggatatttcaacaatcctcaagggactgaaaaggcctttgccccgggaggatggtttaaaacaggcgacattggcgagtttgatgatcgtggtcatctcaagattattgaccgtatcaagagccttgtcaaaatgcaaggtggcgagtatatcgccctggaaaagcttgaatccatctacaggacatctcaagccattcttcaagtcatggtacatgcagatttcgaatatacaaggccaattgtcatcatcatgccaaacacaaaattcctgcaggacaagtcccgggagcttggctttagtgatgatgatagtaccttgagcagcgaaagaatgtcagcatatgtcctcgacgatctccaggatatagccaggcggtccggcttatccaagattgaaacagtaaccggagttgttataacggatattgaatggaccccacagagtggactagtcactccgacgatgaagcttaaccggaggttcatcttgaactactttagagatgaagtggaaaagtgtatgcaaagcattggatga

SEQ ID NO: 14249 - protein, 683 aa, Gibberella moniliformis
MYHTVPYTIESPGYLKVAGESLPRRHPRAKHGLLRYPSAGVLTVFDIVRRSAKLYPDNKAVGSRRLIKMHREFKIIQDKEKEWIYYELGPYNYLSYSQYELLAIQIGSGLRKLGLSSSNKVYLFGTTSANWISMSHGCASQGIPIVTGYDTLSATDIQHSLSQTHAEVIYLDPHLLGTASIALENSQVKTVIINTGSIFSGGYDIDQFRNEHPQFNVITYEELIQLGRHNLKEPIPVKSSDLFCIMYTSGSTGLPNGCCITHENFLAGKLTRSSTVTGLLGGIDDFVSDQERVLAYLPLAHIFEMALENLVMYIGGTLGYGNPKTLTDASLRECNGDMVEFKPTIMVGVPQIWETIRKAVLSKLNCSGFVAKTVFWTAMSFKSFAVRYSLPGKGVFDDLVFGRVRQMTGGRLRYILNGSSGIADSTKEFLSLIVAEMLTGYGLTETCANGALSSPFEQTTSAIGSTSPAIDVKLVSIPELGYFTDADAGPCQGEILVRGPAVFKGYFNNPQGTEKAFAPGGWFKTGDIGEFDDRGHLKIIDRIKSLVKMQGGEYIALEKLESIYRTSQAILQVMVHADFEYTRPIVIIMPNTKFLQDKSRELGFSDDDSTLSSERMSAYVLDDLQDIARRSGLSKIETVTGVVITDIEWTPQSGLVTPTMKLNRRFILNYFRDEVEKCMQSIG

SEQ ID NO: 14250 - DNA, 1950 bp, Chlorobium tepidum
  CDS (1)..(1950)
atgatcacattcaaagcgttcctgtcacgtcgtccattgttggacatccttgttgaccgtttgcgtcagagccgattgcctcgattctcttctcatcattccggaatcaaacactcatttatgggactcatcaatcctgatttccagaccttgcccgaactgttcacctcggtgttcagtcatttcaaaggacagcctgacaaagcgcctatcgccaggaaaatcaatggcgcttactcgccgatcagttacgactcgctggcggaagattgccgccactttgccgcttatctgaaagaaaggggcatcgagccgggcgaccgggtggccattttgtcagagaaccgtccgggatggtacctggccgatatagcgattctttcgctcggggcaaccgacgtgccactctatccatcccttccgccaaaccagatcgagtatatcctgaacaactgcagcgcaaagggcatcatcgtctcaaacatgctgcagctcggcaaaatcctctccatctggccaaagcttccggagctgaacatggtgatcgtcatgaacaagctcgatgagccggttgaagatgtgatcgacctgagccaggcgaaaaccgaggggaaaaaagtgctggaggcaaaaccgtggctgctcgacggcatcaaaagcaatcccgacgatgtagcgacgctcatctacacatcaggaacaacagggttgccgaaaggggtcatgctcacccaccggaacatttgtgaaaacgtcaaatcgtgctcaacggtcatccggatcgaccaaaccgacagcagcctctcattccttccactctcgcacgcctacgagcgcaccggtggatactacctcatgttcgcctgtggtgcacggatcaatctcgccgaaagcgtcgaaaccatctcgctcaacatctcggaagccaaacccaccatcatctttacggtgccaagactcttcgaccgcatgaaggcaagcattctcaagtcggtgacaagcgaaggcggcgtaaaggagaaaatcttcttctgggctgtcagcaccggtgaaaaataccacaagcagctcgccaccggaaaggtgtcgccgctgctcgccgtgcagcacaacctggccgacaagctggtttacagcaaaatccgcaagaaattcggtggaaagctgcgctacttcgtctccggcggcgcagcgctgccccagaaaacgggcgagtttttccagtccatcggcattacgatcctcgaagggttcggcctgaccgaaacctcgcccgtcaccaatgtcaaccggcccgaaaaagtgaagtttggcacagtcggcctaccggtgaaaaatgtcgaggtgaagatcgcaccggatggcgaaatcatgctcaagggtcccaacatcatgaagggctactggaaagacgaggccgcgtccgccgaagtcctcagggatggctggctctacacgggcgacatcggcgaggtcgattctgaaggatacctgaaaatcaccgaccgcaaaaagcatatcatcgtaaccagcggcggcaagaacatcgctcccctgcagatcgagaacctcattctcgacagtccatacgttgatcaggccatgattgtcggcgaaaagcgaccgttcctcatcgcgctcatcgtgccggatttcctcaagctcagggatttcgcggcagaacaccagatcaaagcatcaagcaccaaagagctgatcaacaccaaagaggtgattgaggtttacgagaagctgctgaagagcatctcccgccagcttgccacccatgaaaaggtgcggaaattcctgcttctcgaggagccattctcgattgaaaacggcatgatgaccccgacgctcaagctcaagcgcaaggagatcaccacaaaattcagcgccgaaatcgacaacctttacaacacgctgaacatggtctataatacggagtga

SEQ ID NO: 14251 - protein, 649 aa, Chlorobium tepidum
MITFKAFLSRRPLLDILVDRLRQSRLPRFSSHHSGIKHSFMGLINPDFQTLPELFTSVFSHFKGQPDKAPIARKINGAYSPISYDSLAEDCRHFAAYLKERGIEPGDRVAILSENRPGWYLADIAILSLGATDVPLYPSLPPNQIEYILNNCSAKGIIVSNMLQLGKILSIWPKLPELNMVIVMNKLDEPVEDVIDLSQAKTEGKKVLEAKPWLLDGIKSNPDDVATLIYTSGTTGLPKGVMLTHRNICENVKSCSTVIRIDQTDSSLSFLPLSHAYERTGGYYLMFACGARINLAESVETISLNISEAKPTIIFTVPRLFDRMKASILKSVTSEGGVKEKIFFWAVSTGEKYHKQLATGKVSPLLAVQHNLADKLVYSKIRKKFGGKLRYFVSGGAALPQKTGEFFQSIGITILEGFGLTETSPVTNVNRPEKVKFGTVGLPVKNVEVKIAPDGEIMLKGPNIMKGYWKDEAASAEVLRDGWLYTGDIGEVDSEGYLKITDRKKHIIVTSGGKNIAPLQIENLILDSPYVDQAMIVGEKRPFLIALIVPDFLKLRDFAAEHQIKASSTKELINTKEVIEVYEKLLKSISRQLATHEKVRKFLLLEEPFSIENGMMTPTLKLKRKEITTKFSAEIDNLYNTLNMVYNTE

SEQ ID NO: 14252 - DNA, 2103 bp, Arabidopsis thaliana
  CDS (1)..(2103)
atggaatttgcttcgccggaacaacgtcgtctcgaaaccattcgatctcacatcgatacttctccgaccaacgatcaatcatcatctctattcctcaacgccaccgcttcttctgcttcacctttctttaaagaggatagctacagtgttgtgcttccagaaaagcttgatactggaaaatggaatgtctacagatctaaaagatcgcctacgaaactcgttagtaggttcccggatcatcctgaaatcgggactttacatgacaattttgtacatgctgttgaaacatatgctgaaaacaagtatcttggtacacgagttcggtccgatggaaccattggagagtattcatggatgacatatggagaagcagcgtctgagcgacaagccattggttcaggactcttgtttcatggagttaaccaaggagattgcgttggactctattttattaacagaccagagtggttggttgtggatcatgcttgtgcagcatattcatttgtctctgttcctttatatgatacacttggtccagacgctgttaagtttgtggtgaatcatgctaatctgcaagctatattttgtgtaccacaaaccttgaatattttgctaagcttcctagcggaaatcccatccattcgtctcattgtggtggtgggaggggctgatgagcatttgccatcacttcctcgaggaactggagtcacaattgtatcataccaaaagctattgagtcagggtcgaagtagcttacatccattttcgcctccaaagccagaagacattgcaaccatatgctacacaagtggaaccacaggaacaccaaagggtgttgtgttgactcatggaaacttgatcgcgaatgtcgctggttccagtgtggaagcagaattctttccttcagatgtktacatatcatatcttcctttggcgcacatatatgaacgtgcaaatcagattatgggggtgtatggtggtgttgctgtcggtttctatcagggggatgtcttcaagctgatggatgattttgctgtgttaagaccaacaatattctgtagtgtccctcgcttatataatcgaatatatgatggcattacaagtgccgtaaaatcatctggggttgtgaaaaaaaggcttttcgaaattgcctataactcaaagaagcaagcgatcattaatgggcggactccttctgcattttgggacaagctggtgttcaacaaaataaaagaaaagcttggtggacgggttcggtttatggggtctggtgcttctcctttgtcacctgatgtcatggatttcttgagaatatgctttggatgttcggtgcgtgaagggtatggtatgaccgagacttcttgtgtcataagtgctatggatgatggtgacaatttatctggccatgtcggttcccctaatccagcttgcgaggtaaaacttgtggatgttcccgaaatgaattacacatcagacgatcaaccatacccacgtggtgaaatctgtgtaagaggaccaatcatcttcaaaggctactacaaagatgaagaacaaacgagagaaattcttgatggagatggctggctacacacaggagatatcgggttgtggttacctggtggtcggctcaagatcatagacaggaagaagaacatatttaagttggcgcaaggagaatatatagcaccagagaagatcgaaaatgtttataccaaatgtagattcgtttcgcagtgtttcattcacggtgatagcttcaattcctctctagtagctatagtttcagtcgaccccgaagttatgaaagattgggctgcatcagaaggcatcaagtatgagcatctaggacagctctgtaacgatccaagagtgcgaaagactgttcttgctgagatggatgaccttggaagagaagctcagttgagagggtttgagtttgcaaaggctgtgactttggtgccagaaccattgaccttggagaatggacttctcacaccaacattcaagataaagagacctcaagcaaaagcctactttgcagaagcaattagcaaaatgtatgcggaaatcgcagcctcgaaccccattccttctaaactgtga

SEQ ID NO: 14253 - protein, 700 aa, Arabidopsis thaliana
MEFASPEQRRLETIRSHIDTSPTNDQSSSLFLNATASSASPFFKEDSYSVVLPEKLDTGKWNVYRSKRSPTKLVSRFPDHPEIGTLHDNFVHAVETYAENKYLGTRVRSDGTIGEYSWMTYGEAASERQAIGSGLLFHGVNQGDCVGLYFINRPEWLVVDHACAAYSFVSVPLYDTLGPDAVKFVVNHANLQAIFCVPQTLNILLSFLAEIPSIRLIVVVGGADEHLPSLPRGTGVTIVSYQKLLSQGRSSLHPFSPPKPEDIATICYTSGTTGTPKGVVLTHGNLIANVAGSSVEAEFFPSDVYISYLPLAHIYERANQIMGVYGGVAVGFYQGDVFKLMDDFAVLRPTIFCSVPRLYNRIYDGITSAVKSSGVVKKRLFEIAYNSKKQAIINGRTPSAFWDKLVFNKIKEKLGGRVRFMGSGASPLSPDVMDFLRICFGCSVREGYGMTETSCVISAMDDGDNLSGHVGSPNPACEVKLVDVPEMNYTSDDQPYPRGEICVRGPIIFKGYYKDEEQTREILDGDGWLHTGDIGLWLPGGRLKIIDRKKNIFKLAQGEYIAPEKIENVYTKCRFVSQCFIHGDSFNSSLVAIVSVDPEVMKDWAASEGIKYEHLGQLCNDPRVRKTVLAEMDDLGREAQLRGFEFAKAVTLVPEPLTLENGLLTPTFKIKRPQAKAYFAEAISKMYAEIAASNPIPSKL

SEQ ID NO: 14254 - DNA, 2106 bp, Arabidopsis thaliana
  CDS (1)..(2106)
atggattcttcttcttcgtcttcctccgccgccgcacgccgccgtatcaacgctatccactctcacctcgtcacctcttctcgctcttcccctctcctccgctccaatcccaccgccggcgagttctgtcttgataatggctatagtgttgttcttcccgagaaactgaatactggcagttggaacgtctacagatctgcaaaatccccgttcaagctcgttagcagattcccagatcatcctgacatcgctactctccatgacaattttgagcatgctgttcatgattttcgagattacaagtatttaggaactcgtgttcgtgtcgacggaactgttggagactacaaatggatgacatatggagaagctggtacagcaagaactgctttaggttctggtttggttcatcacgtaatccccatgggatcttctgttggaatttacttcatcaatcgcccagagtggctcattgttgatcatgcttgttcttcttattcttatgtgtctgttcctttgtatgatactcttggtcctgatgctgtgaaatttattgtcaatcatgcaactgtgcaagccatattttgtgtggcagagactttaaactctttacttagctgtttgtctgagatgccaagtgtacgcctggtggtggttgttggagggttaattgaatctttaccctcgcttccctcatcatcaggagtgaaagttgtatcctattcggtgttactgaatcagggtcgtagtaaccctcagcgattttttccaccaaaacccgatgatgttgcaaccatatgctatacaagcggaacaactgggacacccaagggagtcgtattaactcatgcaaacttgattgccaatgttgctggctccagctttagtgtgaagtttttctcttcagatgtttacatttcgtatcttccacttgctcacatttacgaacgagctaatcagatcctaacagtgtactttggagttgctgttggattctaccaaggggacaatatgaaactactggatgatttggctgctctgagacctactgtatttagcagtgtccctcgattatacaatagaatatatgctggtatcattaatgcagtaaaaacctctggtggtctgaaagagagactcttcaatgctgcctataatgcaaagaagcaggctctcttgaatggaaagagtgcttctcccatatgggacaggttggtatttaataaaataaaggacagacttggagggcgggttcgttttatgacgtctggtgcttcacctctctctcctgaagtgatggaatttttgaaagtatgctttggaggaagggtaacagagggatatggaatgactgaaacatcttgtgttataagtggaatggacgagggtgataacctcactggacatgttggctctcctaatccagcttgtgaaataaagcttgtggatgtcccagaaatgaactatacatcagcggatcagccccatccccgtggcgaaatatgtgttaggggtcctatcatttttacaggctattacaaagatgaaattcaaacgaaagaggtgattgatgaagatggatggcttcacactggagatataggtctgtggctgccgggaggacgtctaaaaattattgacagaaagaagaacatcttcaaattggcgcagggggagtatatagctccagagaaaattgaaaacgtctatgccaaatgcaaatttgtgggccagtgcttcatatatggtgatagctttaattcatcattggtagctgttgtatcggttgatccagatgtgctgaaaagctgggcagcttcagaaggcattaagggaggagatctgagagaattgtgtaataatccgagagtgaaagcagcagtactatctgacatggacactgttggaagagaagctcagttgagaggcttcgagtttgcaaaggctgtgacattggtgctggaaccatttactctggaaaatggcttgttgactccgacgttcaagattaagagaccacaagcaaaggaatatttcgcagaagcaataacaaacatgtacaaggagcttggtgcttctgatccctctgctaatagaggtttgtga

SEQ ID NO: 14255 - protein, 701 aa, Arabidopsis thaliana
MDSSSSSSSAAARRRINAIHSHLVTSSRSSPLLRSNPTAGEFCLDNGYSVVLPEKLNTGSWNVYRSAKSPFKLVSRFPDHPDIATLHDNFEHAVHDFRDYKYLGTRVRVDGTVGDYKWMTYGEAGTARTALGSGLVHHVIPMGSSVGIYFINRPEWLIVDHACSSYSYVSVPLYDTLGPDAVKFIVNHATVQAIFCVAETLNSLLSCLSEMPSVRLVVVVGGLIESLPSLPSSSGVKVVSYSVLLNQGRSNPQRFFPPKPDDVATICYTSGTTGTPKGVVLTHANLIANVAGSSFSVKFFSSDVYISYLPLAHIYERANQILTVYFGVAVGFYQGDNMKLLDDLAALRPTVFSSVPRLYNRIYAGIINAVKTSGGLKERLFNAAYNAKKQALLNGKSASPIWDRLVFNKIKDRLGGRVRFMTSGASPLSPEVMEFLKVCFGGRVTEGYGMTETSCVISGMDEGDNLTGHVGSPNPACEIKLVDVPEMNYTSADQPHPRGEICVRGPIIFTGYYKDEIQTKEVIDEDGWLHTGDIGLWLPGGRLKIIDRKKNIFKLAQGEYIAPEKIENVYAKCKFVGQCFIYGDSFNSSLVAVVSVDPDVLKSWAASEGIKGGDLRELCNNPRVKAAVLSDMDTVGREAQLRGFEFAKAVTLVLEPFTLENGLLTPTFKIKRPQAKEYFAEAITNMYKELGASDPSANRGL

SEQ ID NO: 14256 - DNA, 2169 bp, Arabidopsis thaliana
  CDS (1)..(2169)
atggcttcaacgtctctcggagcttcgattctcgtttctcactgctgctcagctcctgaatttcaagtttctgggatgagattggtgtttggttacaaggcttttggctgcagaacttcacgcaggggatttcgagttcgctgcgaatccaagattcaggagaaggagttaaggcggtgttcgccattcttagaacgcttatcattgccaagggaggctgctttgagctctaatgaatggaagtctgttcctgatatttggagatcatctgtggagaagtacggtgacagagttgcggtggtagatccgtatcatgacccgccttctacattcacgtacagacagttggaacaagaaatcttggactttgttgagggtttacgagtcgttggagtgaaagcagacgagaagattgcactttttgctgataactcctgtcgatggcttgttgcggatcaaggtataatggccacaggagcagtcaatgttgttagaggatccagatcgtctgttgaagagttattgcagatatactgtcattcggaaagtgtagcccttgttgtggataaccctgagtttttcaatcgcattgcggagtcattttcttacaaggcagctccaaaatttgtgattcttctctggggggaaaaatcgtcgttggttacagcgggtaggcacacaccagtctatagttacaacgaaattaaaaagtttggacaagagagacgtgcaaaatttgcaagatctaatgattctgggaagtatgaatatgaatacatcgatccagatgatatagccacaattatgtataccagtggaaccacaggaaatccaaaaggtgttatgctcacacatcagaatttgttacaccagataagaaacttgtccgattttgtgcctgcggaagctggggaaagatttctgagtatgttgccatcatggcatgcttatgaacgggcttgtgaatacttcatatttacatgtggagttgagcaaaagtatacgtctataagattcttaaaggatgatctcaagcgttatcaaccacactatcttatttcagttcctttagtatatgagacactctacagcgggattcaaaagcaaatttctgcaagctcccctgctcgtaaatttttggcacttacattgatcaaagtcagcctggcatatacggaaatgaaaagagtttatgagggtctttgtttgacaaaaaatcaaaagcctccaatgtatattgtttcgttggtggattggttgtgggcgagagtagttgcatttttcctatggccattgcatatgttggctgaaaagcttgtacacagaaaaattcgttcgtctattgggataacaaaggctggtgttagtggaggtggtagtttacctatgcatgttgacaagttttttgaggccatcggtgtgaatgtacaaaatgggtatggtttgacagaaacctcaccggttgtctctgcgcgaaggcttaggtgtaacgttcttggctcagttgggcatcctattaaagatacagagttcaaaattgtagatcatgagactggtactgttcttccacctggttcaaagggcattgtcaaagtcagaggcccaccggtgatgaaaggttactacaagaatccactggccaccaagcaggttatagatgacgatggatggttcaatactggagatatgggttggattactcctcagcactcaacaggacggagtcgtagctgtggaggtgtcatcgttcttgaagggcgtgccaaggacactatcgtgctttccacaggtgaaaatgtggaaccattggagattgaagaagcggccatgagaagcaatttgattcaacaaatagtggttattggacaggatcaacgccgccttggagctattgttatcccaaacaaagaagcagcagaaggagcagcaaagcagaaaatttcacctgtagattctgaagtcaatgaacttagcaaggagacgataacaagcatggtctatgaagaactaaggaaatggacgtcacaatgctcgttccaagtgggaccagttctgatcgtggatgaaccattcacgatagacaacggtttaatgacaccgacaatgaaaataagacgggacaaggtggttgatcaatacaagaatgaaatagaaagactctacaagtag

SEQ ID NO: 14257 - protein, 722 aa, Arabidopsis thaliana
MASTSLGASILVSHCCSAPEFQVSGMRLVFGYKAFGCRTSRRGFRVRCESKIQEKELRRCSPFLERLSLPREAALSSNEWKSVPDIWRSSVEKYGDRVAVVDPYHDPPSTFTYRQLEQEILDFVEGLRVVGVKADEKIALFADNSCRWLVADQGIMATGAVNVVRGSRSSVEELLQIYCHSESVALVVDNPEFFNRIAESFSYKAAPKFVILLWGEKSSLVTAGRHTPVYSYNEIKKFGQERRAKFARSNDSGKYEYEYIDPDDIATIMYTSGTTGNPKGVMLTHQNLLHQIRNLSDFVPAEAGERFLSMLPSWHAYERACEYFIFTCGVEQKYTSIRFLKDDLKRYQPHYLISVPLVYETLYSGIQKQISASSPARKFLALTLIKVSLAYTEMKRVYEGLCLTKNQKPPMYIVSLVDWLWARVVAFFLWPLHMLAEKLVHRKIRSSIGITKAGVSGGGSLPMHVDKFFEAIGVNVQNGYGLTETSPVVSARRLRCNVLGSVGHPIKDTEFKIVDHETGTVLPPGSKGIVKVRGPPVMKGYYKNPLATKQVIDDDGWFNTGDMGWITPQHSTGRSRSCGGVIVLEGRAKDTIVLSTGENVEPLEIEEAAMRSNLIQQIVVIGQDQRRLGAIVIPNKEAAEGAAKQKISPVDSEVNELSKETITSMVYEELRKWTSQCSFQVGPVLIVDEPFTIDNGLMTPTMKIRRDKVVDQYKNEIERLYK

SEQ ID NO: 14258 - DNA, 1683 bp, Xanthomonas campestris
  CDS (1)..(1683)
atgagtcaggcacgtccttggttgcaaagttatccggccggagtggccgcggagatcgatctggagcagttccgcaccgtggcggaggttttcgccacctcggtggcgcgcttcgctgatcgtcccgcgtatcacagcttcggcaagaccattacctaccgcgaagcagatcagctggtcgaccagttcgcggcctatctgctcggcgagttgcagctgaaaaaaggcgaccgcgtcgccttgatgatgcccaactgcctgcaatacccgattgccaccttcggcatcctgcgcgccggtctgaccgtggtgaacgtcaacccgctctacaccccgcgcgagctcaagcaccagttgatcgactcgggctccagcgtgctggtggtcatcgacaacttcggcaccactgtgcagcaagtgatcgccgacacgcaggtcaagcaggtcatcaccaccggcctgggcgacatgctcgggttcccgaaagccgcactggtcaactttgtcgtcaagtacgtcaagaagctggtgccggagtaccgcatcaacggcgcgatccgcttccgcgacgcgctggcactgggccgcaagcaccgcgtcccgaccctgcagatcgagccggacgacatcgcctttttgcagtacaccggcggcaccaccggcgtggccaagggcgcgatgctgacccaccgcaacctggtcgccaacatgcagcaggcgcaccagtggctggccggcaccggcaagctggaagaaggccacgaggtggtgatcaccgcgctgccgctgtaccacatcttcgcgttgacggcgaacggcctggtcttcatgaagatcggcggctgcaaccacctgatcagcaacccgcgcgacatgccgggcttcgtcaaggaactcaagaagacccgcttcaccgcgtttaccggcgtcaatacgctgttcaatggcttgctcaatacgcccggcttcgatcagatcgacttttcgtcgttgaagatgaccctcggcggcggcatggcagtccagcgctcggtcgccgaacgctggaagcaggtgaccggcctgactctggtcgaggcttacggcctgaccgagacctcgcccgccgcctgcatcaacccgatggatctggtcgactacaacggctcgatcggcctgccgattccgtccaccgatgcctgcatcaaggacgacgacggcaaggtgctggcgctgggcgagatcggcgagctgtgcatcaagggcccgcaggtgatgaagggctattggaagaaggccgacgagaccgccaaggtcatggacgccgaaggctggctgcacaccggcgacatcgcgcgcatggacgaacgtggcttcgtctatatcgtcgaccgcaagaaggacatgatcctggtgtccggcttcaacgtgtaccccaacgagatcgaagacgtcatcgcgacgatgccgggcgtgctcgaagtggccgcagtcggcgtgccggatgaaaagtccggcgaaatcgtcaaggtggtgatcgtcaagaaagaccaggccctgaccgccgaggacgtaaaggcgcactgccgcaccaacctgaccggctacaagcagccgcgcgtgatcgagttccgcaaggaattgccgaagaccaacgtcggcaagatcctgcgtcgcgaattgcgggatgcggccaaggcatag

SEQ ID NO: 14259 - protein, 560 aa, Xanthomonas campestris
MSQARPWLQSYPAGVAAEIDLEQFRTVAEVFATSVARFADRPAYHSFGKTITYREADQLVDQFAAYLLGELQLKKGDRVALMMPNCLQYPIATFGILRAGLTVVNVNPLYTPRELKHQLIDSGSSVLVVIDNFGTTVQQVIADTQVKQVITTGLGDMLGFPKAALVNFVVKYVKKLVPEYRINGAIRFRDALALGRKHRVPTLQIEPDDIAFLQYTGGTTGVAKGAMLTHRNLVANMQQAHQWLAGTGKLEEGHEVVITALPLYHIFALTANGLVFMKIGGCNHLISNPRDMPGFVKELKKTRFTAFTGVNTLFNGLLNTPGFDQIDFSSLKMTLGGGMAVQRSVAERWKQVTGLTLVEAYGLTETSPAACINPMDLVDYNGSIGLPIPSTDACIKDDDGKVLALGEIGELCIKGPQVMKGYWKKADETAKVMDAEGWLHTGDIARMDERGFVYIVDRKKDMILVSGFNVYPNEIEDVIATMPGVLEVAAVGVPDEKSGEIVKVVIVKKDQALTAEDVKAHCRTNLTGYKQPRVIEFRKELPKTNVGKILRRELRDAAKA

SEQ ID NO: 14260 - DNA, 1638 bp, Methanosarcina mazei Go1
  CDS (1)..(1638)
atggatcttatagaagattccctgggaaagtattttgaaaaacaggtagctgtagaccccaaccatgagtttatcatttatcctgaccggaacctgcgcttcacttacggtcagttcaacgagagagttaacaaccttgcaaaaggtcttcttgcaatcggaataaagaaaggagaccacgtagggatctgggcaaaaaatgtccctgactggcttacatttatgtttgccacagctaaaataggggcagtgctggtcaccgtaaacactgcttacaggagccatgaagttgagtatgtgcttaaacaatcggatatgaaggctctggctcttatagacagtttcagggaagtcgattatcttgaaattatcaatgggctcgtcccggagctgaaaagctcggaaaggggacgcctgaaaagcaagaaattcccccatcttaaaagcataatctatgtaggacaggaaaagcacaggggaatgtataacaccgccgagctgatactccttggcagccattacccggatgatgagcttaaagagatcatggaagatgtgagcggggacgatgtggtcaatatgcagtacacctcaggaactaccggttttcccaagggggttatgctgaccagcaaaaacatcctgaataacgggctgtccataggtgaccgccagaaatttacccatgaagaccgcctctgtctgcccgtgccccttttccactgcttcgggatagtgctcggggttatggctatcctgacccacagaggaacccttgtcatgcttgaggtttttgaccctctccttgtacttgctgcggtccagaaagagaagtgtactgccctctacggcgtgcctacaatgttcattgcagagtacacccacccaatgtttgatatgttcgacctctcttctctgaggacaggtatcatggccggttctacctgccctgtggaagccatgaaaaaagtagtaaaagatatgcactgccaccagatcacaagcgtttacgggcttacggaagcctctcctggcatgacccagaccactgtggacgaccctgtggaactcagggtagaaaccgtgggtaaatgcttcccgggtgtagaagtcagagtggttgaccctgctaccaataaaccagtacctccgaatactgtaggggagatttgctgccgtgggtacaatattatgaagggctactacaaaatgccggaagaaacgaaaaatgtgattgacgaagaaggctggctgcatagcggagaccttggaacctgtgacgaaaacggctactacaggataacaggcagaataaaggacatgatcatccggggaggagaaaacatatatcccagggaaatcgaggagttcctgcacgccatgcctggagtcaaagacgctcaggtcgtcggcatacccgacaagaaatatggagaaatcgttggagcctttgttatacttgagaaagatgaagaccttactgaagccgatataagagactatgcgataagcaaaatagcccggtataaggttcccaaacacatcttcattgtggatgagtaccctctgacagcaagcggaaagatccagaaatacaagctcagagaaatggctgtagaaatgatgaagaatagataa

SEQ ID NO: 14261 - protein, 545 aa, Methanosarcina mazei Go1
MDLIEDSLGKYFEKQVAVDPNHEFIIYPDRNLRFTYGQFNERVNNLAKGLLAIGIKKGDHVGIWAKNVPDWLTFMFATAKIGAVLVTVNTAYRSHEVEYVLKQSDMKALALIDSFREVDYLEIINGLVPELKSSERGRLKSKKFPHLKSIIYVGQEKHRGMYNTAELILLGSHYPDDELKEIMEDVSGDDVVNMQYTSGTTGFPKGVMLTSKNILNNGLSIGDRQKFTHEDRLCLPVPLFHCFGIVLGVMAILTHRGTLVMLEVFDPLLVLAAVQKEKCTALYGVPTMFIAEYTHPMFDMFDLSSLRTGIMAGSTCPVEAMKKVVKDMHCHQITSVYGLTEASPGMTQTTVDDPVELRVETVGKCFPGVEVRVVDPATNKPVPPNTVGEICCRGYNIMKGYYKMPEETKNVIDEEGWLHSGDLGTCDENGYYRITGRIKDMIIRGGENIYPREIEEFLHAMPGVKDAQVVGIPDKKYGEIVGAFVILEKDEDLTEADIRDYAISKIARYKVPKHIFIVDEYPLTASGKIQKYKLREMAVEMMKNR

SEQ ID NO: 14262 - DNA, 2619 bp, Mus musculus
  CDS (157)..(2250)
gcggcggcagaggcaggatctgaggctgcggggctgcgggcctgggaagcagtgcgggccgggctgggccggctcaccgacatgctgaccttcttcttggtgtcggggggttctctctggctgtttgccgagattgctctctcacttctggagaagatgcagacccaggagatcctgaggatcctgcggctgcccgagctatcggacttgggccagtttttccgcagcctctcagctaccaccctcgtgagtgtgggtgcactggctgccgtccttgcctactggctcactcaccggccaaaggccttgcaaccaccatgcaacctcctgaagcagtcggaagaagtggaggacggtggtggagcccggcgatctgtgattgggggttgcactcaattgcttacccattactatgacgatgcccggaccatgtaccaggtgttccgccgtgggcttagcatctcagggaatggaccctgtcttggcttccggaagccagagcaaccttaccagtggctgtcctaccaagaggtggccaaaagggctgaatttctggggtcggggcttctccagcacgactgtaaagtgggcacagagcagttcgttggtgtttttgcacaaaatcggccggagtggatcattgccgagctggcctgctacacgtattccatggtggtggtaccgctctacgacaccctgggcccagggtctatcagctacatcatcaatactgcggacatttgcacggtaatcgtcgataaaccccacaaggcaacacttctgctggaacacgtggagaggaaggagactccgggcctcaagctggtcatcctcatggagccgtttgaggacgccctgagagagagaggaaagaagtgcggggtggacatcaagtccatgcaggctatagaggactgtggccgagagaatcatcatgcccccgtgcccccacggcctgatgacctctccatcgtgtgtttcacaagtggtacaacagggaaccccaaaggtgcaatgctcacccacgggaacgtggtggccgatttctcgggctttctgaaagtgacagagagtcagtgggccccgacctgtgcggacgtccacttttcctacttgcctttagcacacatgtttgagcgcatggtgcagtctgttgtctactgccacggagggcgcgtgggcttcttccagggagacatccgcctcctctcagatgacatgaaggctctccgccctaccatcttccctgtggtcccacggctgctgaatcggatgtatgacaagatcttccaccaggcagacacctcactaaagcgctggctcctggagtttgcagcaaagcgcaagcaggcagaggtccggagcggaatcatcagaaacaatagtatctgggatgaactcttctttaataagattcaggccagtcttggtgggcatgtgaggatgattgtcactggagcagcccccgcgtcaccaacggttctgggattcctacgagcagctctggggtgccaggtctatgaaggttatgggcaaactgaatgcacagctgggtgtaccttcacaacgccaggggactggacatcagggcatgtaggggcacctctgccctgcaaccacatcaagctggtcgatgcagaggaactcaactactggacctgcaaaggagaaggagagatatgtgtgaaaggaccaaatgtgttcaaaggctacttaaaagacgaggacaggacaaaggaggccctggacagcgacggctggcttcacactggagacattgggaaatggctgccggagggaacactcaaaatcattgatcggaaaaagcacatatttaaacttgctcagggggaatatgttgcgccagagaagatcgagaacatctacatccggagtgagcctgtggcacaaatctacgtccacggggacagcttaaaggcctttttggttggcattgtcgtgcctgaccctgaagtcatgccttcctgggctcagaagaaaggaatcgaagggacctatcaggaactctgcatgaaaaaggaattgaagaaagccattctggatgacatggtgatgctggggaaagaaagcggactgcattcttttgaacaggttaaagccatttacatccattgtgacatgttctctgttcaaaatggtctgctgacaccaacactaaaggctaagagaccggagctgagagagtacttcaaaaagcaaatagaagagctttacttagtctccgtgtgaagctccaggagggcccgtctcagtccgatgaactttgcagcaatattatagttattcgtgagagaaaggaatcagaatgccacagctcaaagtgaacaagcacctgatttttgcaactgagcctttcctgacccaagaagtctctaacaatattttctctaccatcaccaagtacactttatttttattaaatgatattgtagcaagctgctaaaaaaaattatcgcaaacggtaatgtaaaaacaaatcaagacactttctgaagaactgtgtaccactaaaagtaatatattcgcaatgttcacagaattccattaaacataaagaaaaaacataaaaaaaaaaaaaaaaaaaaaaaaaaaaaaaaa

SEQ ID NO: 14263 - protein, 697 aa, Mus musculus
MQTQEILRILRLPELSDLGQFFRSLSATTLVSVGALAAVLAYWLTHRPKALQPPCNLLKQSEEVEDGGGARRSVIGGCTQLLTHYYDDARTMYQVFRRGLSISGNGPCLGFRKPEQPYQWLSYQEVAKRAEFLGSGLLQHDCKVGTEQFVGVFAQNRPEWIIAELACYTYSMVVVPLYDTLGPGSISYIINTADICTVIVDKPHKATLLLEHVERKETPGLKLVILMEPFEDALRERGKKCGVDIKSMQAIEDCGRENHHAPVPPRPDDLSIVCFTSGTTGNPKGAMLTHGNVVADFSGFLKVTESQWAPTCADVHFSYLPLAHMFERMVQSVVYCHGGRVGFFQGDIRLLSDDMKALRPTIFPVVPRLLNRMYDKIFHQADTSLKRWLLEFAAKRKQAEVRSGIIRNNSIWDELFFNKIQASLGGHVRMIVTGAAPASPTVLGFLRAALGCQVYEGYGQTECTAGCTFTTPGDWTSGHVGAPLPCNHIKLVDAEELNYWTCKGEGEICVKGPNVFKGYLKDEDRTKEALDSDGWLHTGDIGKWLPEGTLKIIDRKKHIFKLAQGEYVAPEKIENIYIRSEPVAQIYVHGDSLKAFLVGIVVPDPEVMPSWAQKKGIEGTYQELCMKKELKKAILDDMVMLGKESGLHSFEQVKAIYIHCDMFSVQNGLLTPTLKAKRPELREYFKKQIEELYLVSV

SEQ ID NO: 14264 - DNA, 1825 bp, Glycine max
  CDS (36)..(1676)
aaagtcgcaaaaattctcctcctacaccaacaaaaatggcaccttctccacaagaaatcatcttccgatccccactccccgatattccgatccccacacatctcccattgtactcttactgcttccaaaacttgtcacagttccatgaccgtccatgcctcatcgacggcgacaccggcgagaccctcacctacgccgacgtcgacctcgctgctcgccgcatcgcctccggcctccacaaaatcggcatccgccagggtgacgtcatcatgctcgtcctacgcaactgcccgcagttcgccctcgccttcctcggcgccacccaccgtggcgccgtcgtcaccacagccaaccccttctacacgccggcggagcttgcgaagcaagcgacggccacgaaaaccaggctcgtcataacgcaatccgcgtacgtagagaaaatcaagagtttcgcggacagcagcagcgatgtcatggtgatgtgcattgatgatgatttttcttatgaaaacgacggcgttttgcatttctcaacgctcagtaacgccgacgaaacggaagcccctgccgttaagattaaccctgacgagctcgttgcgcttccgttttcttctggcacgtctgggctccccaagggcgttatgttatcgcataaaaacttggtcaccacgatagcgcagttagttgacggcgaaaacccgcaccaatacactcacagcgaggatgtgctactctgtgtgttgcctatgtttcatatctatgcgctcaattccattttgctctgcgggattcgttccggtgcggccgtgcttattttgcagaagtttgagatcactactctgttggagctcatcgagaagtacaaggtgacggttgcgtcgtttgtgccgcccatcgttttggcgttggttaagagcggagagactcatcgctacgacctgtcgtctattcgcgctgtggtcaccggcgcggcacccttaggaggggaacttcaagaagccgttaaggctaggctaccacacgctacttttggacagggatatgggatgacagaagcaggaccacttgccattagcatggcatttgcaaaagtaccctctaagattaaaccaggtgcatgcggaaccgttgtgagaaacgccgagatgaaaatcgtggatacagaaacgggtgattcacttccaagaaacaaacacggtgaaatttgcataataggcacaaaggtcatgaaaggatatctaaatgacccagaggctacagagagaactgtagacaaagaaggatggttacacacaggagatattggtttcattgatgatgatgatgaactcttcattgttgatcggttaaaggaattgatcaaatacaaaggattccaagtggctcctgctgagcttgaagcattgttgattgcccacccaaacatttctgatgctgccgttgtaggcatgaaagatgaagctgcaggggaaattccagttgcatttgttgtaaggtcaaatggttctgagatagccgaggatgaaatcaagaaatacatttcacaacaggtggttttttacaagagaatatgtagagttttcttcacggactctattcctaaagcaccctcaggcaaaattctgcgaaaggtattaactgcaagacttaacgaaggtttggtggtggccaattaggtccataattgtgacagaggaaaatcgtggctgttttacttaccgtaccacaggcccttcctgttgtggtttttgttccaattttatatctcgttatcaatatatatatataatatgcaagtattgcatgaaaaaaaaaaaaaaaaaaa

SEQ ID NO: 14265 - protein, 546 aa, Glycine max
MAPSPQEIIFRSPLPDIPIPTHLPLYSYCFQNLSQFHDRPCLIDGDTGETLTYADVDLAARRIASGLHKIGIRQGDVIMLVLRNCPQFALAFLGATHRGAVVTTANPFYTPAELAKQATATKTRLVITQSAYVEKIKSFADSSSDVMVMCIDDDFSYENDGVLHFSTLSNADETEAPAVKINPDELVALPFSSGTSGLPKGVMLSHKNLVTTIAQLVDGENPHQYTHSEDVLLCVLPMFHIYALNSILLCGIRSGAAVLILQKFEITTLLELIEKYKVTVASFVPPIVLALVKSGETHRYDLSSIRAVVTGAAPLGGELQEAVKARLPHATFGQGYGMTEAGPLAISMAFAKVPSKIKPGACGTVVRNAEMKIVDTETGDSLPRNKHGEICIIGTKVMKGYLNDPEATERTVDKEGWLHTGDIGFIDDDDELFIVDRLKELIKYKGFQVAPAELEALLIAHPNISDAAVVGMKDEAAGEIPVAFVVRSNGSEIAEDEIKKYISQQVVFYKRICRVFFTDSIPKAPSGKILRKVLTARLNEGLVVAN

SEQ ID NO: 14266 - DNA, 1881 bp, Encephalitozoon cuniculi
  CDS (1)..(1881)
atggatatggcgagcagaataagagtgacggacgatgggtctgtgcagcacgtgaactaccagaagggcattgtgtgtgccccggacgggtcaaagacaatcctggagctcctcggggcacgctgcgcctcgatgggcagcgaccccttcctcggcacaatagtcggcagcgaggtcaagtacaggtctgcagaggacatctggagagaggccgagggccttgcagccctcttcgcgcggctcttggcacaggaggacaaggtcggaatatactccgtcaacaggtacgagtgggtggtgtctgagatggcgtcgtacatgtctgggtgcatcaacgttccgctgtactcgacgttctcgccggcggatgtgcggcagattctcgcggagaccgagatgaaggtgtgtgttgcatctgcagacaaggcacagctgctcctggagactgtgctcgaggacagcaaggcggggctttcgtgcattgtgctgatggacagggacgcgggggttgccgagaggctccggaatgcaggtgttctggtgtactacttcggggacgttgtctcctcgggggacaaggctggcaggaagcggtacccgaagggggacgaccttgcaacgatatgctacacaagcgggacgtctgggagtccgaagggcgtgatgctgacgcacaggaactttgtgtcgtgtgttgcagggatctcgcgggggtcgcgggccggggagatggtggagattgggagggacgacgtgtatctctcgtacctcccgcttgcgcatgtgatggagagggtgtgcatgaacatctcgatggcgtctgggtgcaggatagtgtttttcagggggaatctgaaggagatcaaggaggactaccttgttgtgaggccgacgtttattattgctgtgccgcgggtgctgaacctgttcaaggagaagattgaggagaaggtgcagcagaagaactttgcggcgcggtgtgcattccggggggcgctctggtacaagatgtggagggtaagcaagggagagctccggagcaggtttgtggactggcttgtttttgaccggattgccaaggagtttggggggcggatcaaccggattctgtgtgggtctgcgcctctccggagggaggttctggtgtacatgcaggctgtgctgtcgtgcaggattttccagggatacgggcagacggagaatgtgggtgcggggattgtgcagccgctggactcgcgcgtgtacgacaatgtggggattccgtttcctgcgaatgaggtgaatctcggggagattcccgaggagcttgggtctgagtacatgcggcggtaccccgggtgcagggttggggagattctgctgcggggggacaatgtgacgcaggggtactacaagaggcccaaggagactgggcagctgtttacgaaggacggatggctccggactggggacattgggatgtttgactcttcagcgggggtgttttctgtgattgggcgtgtgaaggacgggttcaagacgtcgcagggggagtacattgaccctgagaagcttgaggtgctgtatgcggacggggatgttgtccaggacgtgtgcattccgcggcggtctgacagcgaccggatagttgcgattgttgtgtgccccgagacgaagaagagcgatgcggagattcttgcgcatgtgcgtgagactggggagaagctgttcaagcagaggaggataacgaggcttgagattccgtggcgtgttgttgtgctgcggcgggggtttgagagttttgagggggcggacctcctcacgccgactgcgaagaagaggaggcccctgattgagcggtacttttctcaggagattgactctctgcttgggattaaatga

SEQ ID NO: 14267 - protein, 626 aa, Encephalitozoon cuniculi
MDMASRIRVTDDGSVQHVNYQKGIVCAPDGSKTILELLGARCASMGSDPFLGTIVGSEVKYRSAEDIWREAEGLAALFARLLAQEDKVGIYSVNRYEWVVSEMASYMSGCINVPLYSTFSPADVRQILAETEMKVCVASADKAQLLLETVLEDSKAGLSCIVLMDRDAGVAERLRNAGVLVYYFGDVVSSGDKAGRKRYPKGDDLATICYTSGTSGSPKGVMLTHRNFVSCVAGISRGSRAGEMVEIGRDDVYLSYLPLAHVMERVCMNISMASGCRIVFFRGNLKEIKEDYLVVRPTFIIAVPRVLNLFKEKIEEKVQQKNFAARCAFRGALWYKMWRVSKGELRSRFVDWLVFDRIAKEFGGRINRILCGSAPLRREVLVYMQAVLSCRIFQGYGQTENVGAGIVQPLDSRVYDNVGIPFPANEVNLGEIPEELGSEYMRRYPGCRVGEILLRGDNVTQGYYKRPKETGQLFTKDGWLRTGDIGMFDSSAGVFSVIGRVKDGFKTSQGEYIDPEKLEVLYADGDVVQDVCIPRRSDSDRIVAIVVCPETKKSDAEILAHVRETGEKLFKQRRITRLEIPWRVVVLRRGFESFEGADLLTPTAKKRRPLIERYFSQEIDSLLGIK

SEQ ID NO: 14268 - DNA, 3671 bp, Drosophila melanogaster
  CDS (316)..(2463)
acgttgtgcgccattccgtcacttctgcgggcgccaaactaacttaagcaaaaagttactaaaaacaacattgaaacgcagtttatgaaatacaactcactatcgtattgtgtgtgaaactacaaactgaacatctggagaggaacaactgacatcatcctattgtattattgttgcgtccattgttcgtttgttcttgccattaatcagagctgggctcttttggaggatacgcctcacacccacaattttcactaccgatcaaaaaacactcatttaattcatagatcggacaagtagagaaaaggcagcaagatgttcatcgaagacgatgcgcaaatggacagcttctgggtgcagagcgctattggcgcgatcaaggcgatcgcctttgtctacgacatcatcacccttccggtttacttggtgctgcagaagccctggaaacgccgtcaggactcgcgtcgcgtgaaggcaaagatcgtgcggaatgatgacaatgagctgacctaccggaccacggatccaccacgggatgtccacgtgaagatgctgcaagagaatatcgataccctggagaaggtattcaactatgtggccaaaacttacacgtcgaagcgttgtctgggcacccggcagatcctcagcgaggaggatgaggtgcagcagaacggtcgagtcttcaagaagtacaacctcggtgactacaagtggaagacgttcaccgaggcggagcgcacggcggctaatttcgggcgcggtctgcgagaacttggccagaaaccacgcgagaacattgtcatctttgccgaaacgcgagccgaatggatgatagctgcccacggatgcttcaagcaggctatgcccattgtcactgtctatgctacgctgggcgatgatggagttgctcattgcatcaccgaaacggaagtcaccacggttatcacctcccatgatctgctgcccaagtttaagacgctgctcgacaaatgcccattggtgaagactattatctatattgaggatcagctgcaaaagacagaaaccactggcttcaaggagggcgtcaagatcttgccgtttaaccaagttgtcaagacaggacaggacagtaaatttgagcacgttccacccaagggagatgacattgccattatcatgtacacttccggatccactggcacacctaagggtgtcctcctctcgcacaagaactgcattgcgacaatgaagggatttgttgatatggtgcctatctatccggatgatgtactgatcggattcctgcccctggctcacgtttttgaattggttgcggaaagtgtgtgtctcatgactggcgttccaattggctactcgacccccttgactctgatcgacactagcagcaagatcaaacgcgggtgcaagggcgatgccaccgtcctgaagcccacctgcatgacttcggtgccgctgatattggatcgcatttccaagggtattaacgacaaggttaactctggctcggcgttcaagaaatcactcttcaaattcctttaccagtacaaagtcaagtgggtgcagagggggtacaagacgccgctgattgataaactggtgttcaagaaggtggcaaagctaatgggtggcaaagtgcgcattatcatgtctggcggagcgcctctgtcagcagatacacatgagcagatcaagacctgcttgtgcttggagctgattcagggctatggccttacggaaactacgtctggagccactgtcatggactaccgtgatatgacctatggacgcactggaggaccattaactgtctgcgacatccgtctagtcaactgggaagaaggcaactaccgcgtcacaaataaaccttatccccagggtgaggttctcattggtggcgagtgtgtctcccagggatactacaagttgcccggcaagaccaacgaggatttctttgaggaggatggacagagatggtttaaaaccggcgacattggcgaaatacaagctgatggcgtacttaagattattgatcgtaagaaggatctggttaagctgcaggccggcgagtatgtttcccttggcaaagttgaatctgagcttaagacttgcggaatcatcgagaacatttgcgtatacggagatccgacaaagcagtacacagtggcgctggtcgttcccaaccaaaaccatttggaggagctggcacagaagcatggcctgggtgataagtcctttgaggagctgtgctcatcaccgatcatagagaaggctattctcaaggaaattgctgagcatgcgcggaaatgtaaattgcaaaaatatgaggttcccgccgccatcacactttgtaaggaggtctggtctccggacatggggctggtaaccgccgccttcaagctgaagcgcaaggatatccaggacagatatcagcatgatattaaccgcatgtacgcctcatgaaagtcaatgtactaagccagaggtaccagatgcagcaacgacaacaacacgcaaacattaaagcagcagcaatgaagctagtgtgtactaattgtttttagtagcaccccacacagcataagcatgcatacgaaatccaaaaccaaactagcttaagtcctaaaagatctaaatgccgagcagtacatgcaggaaccgattagccacattgcgcatgtaaagacagacagaatgttctcatttgcctttttcgtttcgttttatcttatttgctagaaatcgaaaattactcgtttctcattttaataagttcgcaaagacttgcttggcagatatgtagctgaagctgagtttggtttggaaatgcgctgtgtatgtgctaggaatgctgttcaaccgattgacaatgataatggtaatgataactgaatgccgatgatgagaaggaatattgtatactgtacagttttcggtttatagtacattgtgtggcaaatttatattgcagaaaaatacttatttttatattaagcttaagtggttgcctattaattatgtacatacgatatacacattcatataaaagcatatatgtgtaaaataaatctaatatttagtgtacttctctatgctaagttaaatgtatggaattcttgaagtaatgaaatgtagacagcagcaatgaaagcgacttgattatgaattaaaagccacaattgaaagtaaagaacctaagaatttcccttgcaaatgcttctttttggcgcagagtaaaatacatctaaacacaaatggaaccatccaaaaattacttttaattacacaaaggcataaaggttacaaaggcaattgtaatatatattttagctcaatttagttaaaaaaaggacatcaaatgaattttatgaaatatattatgtaaaacacgtaaagagaaaagtcaaaattaatatgcaacaaatgaaagacttagtaccaaaatataataaaaacactgaaatcactagaaggccaacaaaacgcctatatctaaaactaaaatgtaataacatttgttttagatgtgcaagaactttttgaataaattgtagtcatatttttagttaaactatgtatatttaggaaacgtttagcaattttttgtggaaacgttacgtttcttttcaataaaattcaaatgatacaaaaaaaaaaaaaaaaaaaaaaaa

SEQ ID NO: 14269 - protein, 715 aa, Drosophila melanogaster
MFIEDDAQMDSFWVQSAIGAIKAIAFVYDIITLPVYLVLQKPWKRRQDSRRVKAKIVRNDDNELTYRTTDPPRDVHVKMLQENIDTLEKVFNYVAKTYTSKRCLGTRQILSEEDEVQQNGRVFKKYNLGDYKWKTFTEAERTAANFGRGLRELGQKPRENIVIFAETRAEWMIAAHGCFKQAMPIVTVYATLGDDGVAHCITETEVTTVITSHDLLPKFKTLLDKCPLVKTIIYIEDQLQKTETTGFKEGVKILPFNQVVKTGQDSKFEHVPPKGDDIAIIMYTSGSTGTPKGVLLSHKNCIATMKGFVDMVPIYPDDVLIGFLPLAHVFELVAESVCLMTGVPIGYSTPLTLIDTSSKIKRGCKGDATVLKPTCMTSVPLILDRISKGINDKVNSGSAFKKSLFKFLYQYKVKWVQRGYKTPLIDKLVFKKVAKLMGGKVRIIMSGGAPLSADTHEQIKTCLCLELIQGYGLTETTSGATVMDYRDMTYGRTGGPLTVCDIRLVNWEEGNYRVTNKPYPQGEVLIGGECVSQGYYKLPGKTNEDFFEEDGQRWFKTGDIGEIQADGVLKIIDRKKDLVKLQAGEYVSLGKVESELKTCGIIENICVYGDPTKQYTVALVVPNQNHLEELAQKHGLGDKSFEELCSSPIIEKAILKEIAEHARKCKLQKYEVPAAITLCKEVWSPDMGLVTAAFKLKRKDIQDRYQHDINRMYAS

SEQ ID NO: 14270 - DNA, 2204 bp, Homo sapiens
  CDS (171)..(2183)
gcgctcctcctcgtcccagcgctagcgggcacgcggttcctttttgggagctttccgagtgccaggcgccggccggctgcgaagacgcggtgggccgcccctccgattgaaatcacagaagatattcgtgttcttcttaagagaaaaagaggacatttaagaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggagggggcccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgaca

SEQ ID NO: 14271 - protein, 670 aa, Homo sapiens [sequence omitted]

SEQ ID NO: 14272 - DNA, 1619 bp, Populus tomentosa
  CDS (8)..(1618)
cgccacaatgaatccacaagaagaattcatctttcgctcaaaattaccagacatctacatcccgaaaaaccttcccctgcattcatacgttcttgaaaacttgtctaaacattcatcaaaaccttgcctgataaatggcgcgaatggagatgtctacacctgtgctgacgttgagctcacagcaagaagagttgcttctggtctcaacaagattggtattcaacaaggtgacgtgatcatgctcttcctaccaagttcacctgaattcgtgcttgctttcctaggcgcttcacacagaggtgccatcaccactgctgccaatcctttctccacccctgcagagctagcgaaacatgccaaggcctcgagagcaaagcttctgataacacaggcttgttactacgagaaggttaaagattttgccagagaaagtgatgttaaggtcatgtgcgtggactctgccccggatgggtgcttgcacttctcagagctaacacaggcagacgaaaatgaagcgcctcaggtcgacattagtcctgatgatgtcgtggcattgccttattcatcagggactacagggttgccaaaaggggtcatgttaacgcacaaagggctaataaccagtgtggctcaacaggtagatggagacaatcctaacctgtattttcacagtgaagatgtgattctgtgtgtgctccctatgttccatatctatgctctgaattcaataatgctgtgtgggctgagagtcggtgcctcgattttgataatgccaaagtttgagattggtactttgctgggattgattgagaagtacaaggtatctatagcaccggttgttccacctgtgatgttggcaattgctaggtcacctgatcttgacaagcatgacttgtcttctctgaggatgataaaatctggaggggctccattgggcaaggaacttgaagatactgtcagagctaagtttcctcaggctagacttggtcagggatatggaatgaccgaggcaggacctgttctagcaatgtgcttggcatttgccaaggaaccattcgacataaaaccaggtgcatgtgggactgtagtcaggaatgcagagatgaagattgttgacccagaaacaggggcctctctaccgaggaaccagcctggtgagatctgcatccggggtgatcagatcatgaaaggatatcttaatgaccctgaggcaacctcaagaacaatagacaaagaaggatggttgcacacaggcgatatcggctacattgatgatgatgatgagcttttcatcgttgacaggttgaaggaattgatcaagtataaagggtttcaggttgctcctgctgaactcgaagctttgttaatagcccatccagagatatccgatgctgctgtagtaggaatgaaagatgaggatgcaggagaagttcctgttgcatttgctgtgaaatcagaaaagtctcaggccaccgaagatgaaattaagcagtatatttcaaaacaggtgatattctacaagagaataaaacgagttttcttcattgaagctattcccaaggcaccatctggcaagatcctgaggaagaatctgaaagagaagttgccaggcatataac

SEQ ID NO: 14273 - protein, 536 aa, Populus tomentosa
MNPQEEFIFRSKLPDIYIPKNLPLHSYVLENLSKHSSKPCLINGANGDVYTCADVELTARRVASGLNKIGIQQGDVIMLFLPSSPEFVLAFLGASHRGAITTAANPFSTPAELAKHAKASRAKLLITQACYYEKVKDFARESDVKVMCVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGASILIMPKFEIGTLLGLIEKYKVSIAPVVPPVMLAIARSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGEICIRGDQIMKGYLNDPEATSRTIDKEGWLHTGDIGYIDDDDELFIVDRLKELIKYKGFQVAPAELEALLIAHPEISDAAVVGMKDEDAGEVPVAFAVKSEKSQATEDEIKQYISKQVIFYKRIKRVFFIEAIPKAPSGKILRKNLKEKLPGI

SEQ ID NO: 14274 - DNA, 2184 bp, Arabidopsis thaliana
  CDS (1)..(2184)
atgcaaattcgtctgaaacctgattattccttcttcatcgcctcttcctcaacgatggcttcgacttcttctttgggaccttctacactactctcttacggttctccttctcgtcagtttcctgattttgggttcagattgatttcgggtcacgaaagtgttcgaattccatcattccggcgatttcgggttcactgcgagtcaaaggaaaaagaagtgaagccgtcttctccatttcttgaaagctcctcgttttcgggagatgctgctttgcgctctagtgaatggaaggctgttcctgatatttggagatcatctgcagaaaagtatggtgatagagttgcattggtggatccttatcatgatcctcctttgaaactgacgtacaagcagttggaacaagaaattttggactttgctgagggcttacgagttcttggagtgaaagcagatgagaagattgcactttttgctgataactcctgccgatggcttgtttcagatcaaggtataatggccacaggggcagtcaatgttgtcagaggatctaggtcctctgttgaagagttactgcagatataccgtcattctgaaagcgtagccattgttgtggataatcctgagtttttcaaccgcattgctgagtcatttacgtcaaaggcatctctgagatttttgatacttctctggggtgagaaatcatcactggtcacacaggggatgcagattccagtttacagttatgcagaaattataaaccaaggacaggagagtcgtgcaaaattatcagcatctaatgataccaggagctatagaaatcaattcatcgattcagatgatacagctgcaattatgtataccagtggtaccacgggaaatccaaaaggcgttatgcttacacatcggaatctcttacaccagataaaacatttatccaaatatgtacctgctcaagctggggataaatttctaagcatgctaccatcatggcatgcctatgaacgtgctagtgaatacttcatattcacttgtggagttgagcaaatgtatacatctataagatacttaaaggatgatctaaagcggtaccaaccgaactatattgtgtccgttcctctagtatatgagacactttacagtgggattcaaaagcaaatttctgcaagttctgctggccgtaaatttctagcacttacattgatcaaagtcagtatggcatatatggagatgaaaaggatatatgagggtatgtgtctgacaaaagagcaaaagcctccaatgtatattgttgcttttgtggattggttgtgggcgagagtaattgctgccttgttgtggccattacatatgttggccaaaaagcttatctacaagaaaattcattcgtctattgggatatcgaaggctggtattagcggaggtggtagtttacccattcatgttgacaagttttttgaggccatcggtgtgattctacaaaatggttatggtttgacagagacctcacctgttgtctgtgcacggacacttagctgcaatgttcttggctcagctgggcatccaatgcatggtacagaattcaaaattgtagatcctgagactaataatgtactccctcctggttcaaagggcattatcaaagtcagaggtccacaggttatgaagggttattataagaatccatcgactacaaagcaagttctaaatgagagtggatggttcaatacaggagacaccggttggattgctcctcatcactcaaaagggcggagtcgccactgtggaggtgtcattgttcttgaaggccgtgcaaaagacacaattgtactttccacaggtgaaaatgtggaaccgttggagattgaagaagccgccatgagaagcagggtgattgaacaaattgttgttattggacaggaccgacgtcgccttggagctatcattatcccaaacaaagaggaagcacaaagagtagatcctgaaacatccaaagaaacactaaagagcttggtctaccaagaactgagaaaatggacatcagaatgttcgtttcaagtcggaccagtcttgatcgtcgacgaccctttcacgatagacaacgggttaatgacaccaactatgaagattagacgggacatggtcgtggctaaatacaaagaggagattgatcaactctacagttaa

SEQ ID NO: 14275 - protein, 727 aa, Arabidopsis thaliana
MQIRLKPDYSFFIASSSTMASTSSLGPSTLLSYGSPSRQFPDFGFRLISGHESVRIPSFRRFRVHCESKEKEVKPSSPFLESSSFSGDAALRSSEWKAVPDIWRSSAEKYGDRVALVDPYHDPPLKLTYKQLEQEILDFAEGLRVLGVKADEKIALFADNSCRWLVSDQGIMATGAVNVVRGSRSSVEELLQIYRHSESVAIVVDNPEFFNRIAESFTSKASLRFLILLWGEKSSLVTQGMQIPVYSYAEIINQGQESRAKLSASNDTRSYRNQFIDSDDTAAIMYTSGTTGNPKGVMLTHRNLLHQIKHLSKYVPAQAGDKFLSMLPSWHAYERASEYFIFTCGVEQMYTSIRYLKDDLKRYQPNYIVSVPLVYETLYSGIQKQISASSAGRKFLALTLIKVSMAYMEMKRIYEGMCLTKEQKPPMYIVAFVDWLWARVIAALLWPLHMLAKKLIYKKIHSSIGISKAGISGGGSLPIHVDKFFEAIGVILQNGYGLTETSPVVCARTLSCNVLGSAGHPMHGTEFKIVDPETNNVLPPGSKGIIKVRGPQVMKGYYKNPSTTKQVLNESGWFNTGDTGWIAPHHSKGRSRHCGGVIVLEGRAKDTIVLSTGENVEPLEIEEAAMRSRVIEQIVVIGQDRRRLGAIIIPNKEEAQRVDPETSKETLKSLVYQELRKWTSECSFQVGPVLIVDDPFTIDNGLMTPTMKIRRDMVVAKYKEEIDQLYS

SEQ ID NO: 14276 - DNA, 1911 bp, Amorpha fruticosa
  CDS (28)..(1650)
tcacaaacacaaaataccattcccgcaatggcatttgagacagaagaaccaaaggaattcatcttcaggtcaaaattaccagaaatcccaatctccaaacaccttccccttcactcttactgctttgagaacctctcagaattcgggtcacgtccatgcttgatcagtgccccaacaggggacgtgtacacctactatgacgtggaactcaccgctagaagagttgcctctggactcaacaaattgggtgtccaacaaggtgatgtcatcatgctccttcttcctaattcaccagaatttgtgttctccttcttgggtgcctcttaccgtggtgccatgatcactgctgccaacccattcttcacatccgctgagattgcaaaacaggccaaagcctccaacaccaagttgcttataacacaagcttcttactacgacaaggttaaggatttggatgtgaagttggtgttcgtggactctccccctgatgggcacatgcactattcagagctgcgtgaggctgatgagagtgacatgcctgaggtgaagaccaaccctgatgatgtggtggcacttccctattcgtcagggacaacagggttgcccaaaggggtgatgttatctcacaaagggttggcgaccagcatagcacaacaagttgatggggaaaaccccaacctctactttcacaatgaggatgtcatattgtgtgtgcttccactctttcatatatattctctcaattctgttctgttgtgtgggttgagagccaaggctgctattttgctgatgccaaagtttgagatcaatgccttgttgggtctcattcagaaacaccgagtaacaattgcccctattgtcccacccattgttttggccattgccaagtcaccggatcttgaaaagtatgatctctcttccattagggtgttgaaatctggaggggcttctctgggcaaagaactcgaagacactgtgagggctaaattccccaaggccaaacttggacagggatacggaatgactgaggcagggccagtgctaacaatgtgcttagcatttgctaaggaaccgatagatgtaaaaccaggtgcatgtggaaccgttgtaagaaatgcagagatgaagattgtggatcctgaaactggtaattcgttgccacgaaaccagtccggtgaaatttgcataagaggcgaccagatcatgaaaggttatctaaatgatcaagaggctacgcagagaaccatagacaaagaagggtggttgcatacaggtgacatcggctacatcgacgatgacgatgagttattcatcgttgacaggcttaaggaattgatcaaatacaaaggatttcaggtggctcctgctgaactcgaagcccttcttctctctcatcccaagatcaccgatgctgctgtggttccaatgaaggatgaagcagctggagaggtacctgttgcatttgtggtgagatcaaatggtcacacagacacaaccgaggatgaaattaagcagtttatctccaaacaggtggtgttttataaaagaataagcagagtattcttcattgatgcaattcccaagtcaccgtcaggtaaaatcttacgaaaggatctaagagcaaagcttgcagcaggtgttccaaattgaaaattctaattccaagatatatgatattaccattatcatacgatgcccgcacaaagctccataaaccttgaaggccagagtgcggacgcgtgcttggagcttgaccgcattacttatattcacacgagggcagacatgattaccttaaaagggggggttgctaattatattttaaaactatattgggtaaaatttgattcgatcaaggactttcatattatataatatcgaagtataatttttcaaaaaaaaaaaaaaaaa

SEQ ID NO: 14277 - protein, 540 aa, Amorpha fruticosa
MAFETEEPKEFIFRSKLPEIPISKHLPLHSYCFENLSEFGSRPCLISAPTGDVYTYYDVELTARRVASGLNKLGVQQGDVIMLLLPNSPEFVFSFLGASYRGAMITAANPFFTSAEIAKQAKASNTKLLITQASYYDKVKDLDVKLVFVDSPPDGHMHYSELREADESDMPEVKTNPDDVVALPYSSGTTGLPKGVMLSHKGLATSIAQQVDGENPNLYFHNEDVILCVLPLFHIYSLNSVLLCGLRAKAAILLMPKFEINALLGLIQKHRVTIAPIVPPIVLAIAKSPDLEKYDLSSIRVLKSGGASLGKELEDTVRAKFPKAKLGQGYGMTEAGPVLTMCLAFAKEPIDVKPGACGTVVRNAEMKIVDPETGNSLPRNQSGEICIRGDQIMKGYLNDQEATQRTIDKEGWLHTGDIGYIDDDDELFIVDRLKELIKYKGFQVAPAELEALLLSHPKITDAAVVPMKDEAAGEVPVAFVVRSNGHTDTTEDEIKQFISKQVVFYKRISRVFFIDAIPKSPSGKILRKDLRAKLAAGVPN

SEQ ID NO: 14278 - DNA, 2689 bp, Rattus norvegicus
  CDS (29)..(2194)
cactgtcttcagtgaatgctcacagcagatgccacgcagttctgaagctggatactgctgtttgtccagggactccaatatgcctgacagcagagacgatcagcagcagggtgccagcatggggacctccccagacaactcacaaaccagctccttaattgatgggcggacactctccaaagagtctccaagtcatggtctcgagctctcagctccagaaaaggcaagagctgcctctttggatgcttcagaggaagcactatggacaactcgggccgatgggagagtgcgcctgcgcctggaacccttctgtacgcagcttccctacaccgtgcaccagatgttctatgaggccctggataagtacgggaacctcagtgctctgggcttcaagcgcaaggacaagtgggagcgcatctcttactaccagtactacctgattgcgcgcaaagtagccaaaggcttcttgaagctcggcctggagcgtgctcacagcgtggcgatcctcggcttcaactctccagaatggtttttctctgcggtgggcacagtgtttgcagggggcatcgtcaccggcatttacaccaccagctccccagaggcctgccagtacattgcccatgactgccgagccaatgtcatcgtggttgacacacagaagcagctggaaaagatcctgaagatctggaaagacttgccacatctaaaggcagtggtgatataccaagaaccccctcccaagaagatggccaatgtgtacacgatggaggaactcatagaactggggcaagaagtgcctgaggaggccctagatgccatcatcgatacccagcagcccaaccagtgctgtgtgctcgtctacacatcaggcaccacaggaaaccccaagggtgtgatgctgagtcaagacaatatcacatggacagcacggtatggcagtcaggctggggacatccagccagcggaagtgcagcaagaggtagtggtcagctacttgcctctcagccacattgctgcccagatctatgacctgtggacgggcatccagtggggggcccaggtctgctttgcagatccagatgcccttaaggggaccctggtgaacacactgcgggaggtggagcccacatcccacatgggagtgccccgagtatgggagaagatcatggaacggatccaggaggtggccgctcaatctggcttcatccgccgcaagatgctgctgtgggccatgtctgtcaccttggagcagaacctcacctgccctagcaacgacctgaagcccttcacgagcagactggcggattacctagtattagccagggtccgtcaggctctgggctttgccaagtgtcagaaaaacttctatggagcagctcccatgacggcagagacacaacgcttctttctgggcctcaacatccgcctgtacgcaggctatggcctcagtgagagcactggccctcacttcatgtccagcccctacaactatcggctttacagctccggcagggtggtgcccggctgtcgggtgaagctggtgaatcaggatgcagatggcattggtgagatctgtctgtggggccgcaccatcttcatgggttatctgaacatggaggacaaaacacatgaggccattgattctgaaggctggctacacacaggtgacatgggccgtctggatgatgacggcttcctctacatcaccgggcgcctcaaagaattaatcatcactgcgggcggggagaatgtgcccccggtgcccatcgaggaggctgtgaagatggagttgcccatcatcagcagcgccatgctgattggggaccagaggaagttcctgtccatgctgctaacactgaagtgcacactgaacccagaaacgtctgagccaaccgacaatctgacggagcaagctgtggagttctgccagagggtgggcagcaaggccagcaccgtatccgagatcgtggggcagaaagacgaggctgtgtatcaggccatccacgaagggatccagagggtgaacgcgaacgcggcagcccggccctaccacatccagaagtgggccattctcgaacgtgacttctccatttcaggtggagaactgggacccaccatgaagttgaaacggctcacggttctggagaagtacaaagatatcattgattccttttatcaagagcaaaaacagtagtcaggagccatgcttgtggcttctgctgaagaccagcctggcaagcatcctccacaggaacctgacaaactgcttttacccttagttcagggcacagcactgacatctccaatgccttcacctgcaaattgattctaaccagtgctcctattcaggtgtccaatgagaccattctccttcccagagaaggactgctcactttggcctcgggtccaggcagatttacaaggttctagttcataggtctcctagggctggctgttggagagggaaagggattggcagtcccattactaatgtgtgctgcagagacagcagtcacagctcgcctaatggcctgactttaattctggcttcttggaaactagtatcactctgccacctcacacacgagagagaagcttgatgcttaataatctgctgctgccgctgtgactgtatttagtgtgtaattttcagtattaaaccttttaacagatctgcaaaaaaaaaaaa

SEQ ID NO: 14279 - protein, 721 aa, Rattus norvegicus
MPRSSEAGYCCLSRDSNMPDSRDDQQQGASMGTSPDNSQTSSLIDGRTLSKESPSHGLELSAPEKARAASLDASEEALWTTRADGRVRLRLEPFCTQLPYTVHQMFYEALDKYGNLSALGFKRKDKWERISYYQYYLIARKVAKGFLKLGLERAHSVAILGFNSPEWFFSAVGTVFAGGIVTGIYTTSSPEACQYIAHDCRANVIVVDTQKQLEKILKIWKDLPHLKAVVIYQEPPPKKMANVYTMEELIELGQEVPEEALDAIIDTQQPNQCCVLVYTSGTTGNPKGVMLSQDNITWTARYGSQAGDIQPAEVQQEVVVSYLPLSHIAAQIYDLWTGIQWGAQVCFADPDALKGTLVNTLREVEPTSHMGVPRVWEKIMERIQEVAAQSGFIRRKMLLWAMSVTLEQNLTCPSNDLKPFTSRLADYLVLARVRQALGFAKCQKNFYGAAPMTAETQRFFLGLNIRLYAGYGLSESTGPHFMSSPYNYRLYSSGRVVPGCRVKLVNQDADGIGEICLWGRTIFMGYLNMEDKTHEAIDSEGWLHTGDMGRLDDDGFLYITGRLKELIITAGGENVPPVPIEEAVKMELPIISSAMLIGDQRKFLSMLLTLKCTLNPETSEPTDNLTEQAVEFCQRVGSKASTVSEIVGQKDEAVYQAIHEGIQRVNANAAARPYHIQKWAILERDFSISGGELGPTMKLKRLTVLEKYKDIIDSFYQEQKQ

SEQ ID NO: 14280 - DNA, 2378 bp, Arabidopsis thaliana
  CDS (107)..(2269)
atcgaaaaggtttaaactttacgtttttctctggaacccgattcgaagaaatcatcaagaagtttcctttcactgatttctcaatctattcgtagctttcgcgcttatggaagattctggagtgaatccaatggattcaccatctaaaggcagtgactttggagtctatggaatcataggaggtggaatcgtggctttacttgtgcctgtgttactctctgtggtgttgaatggaaccaaaaaggggaaaaagagaggtgttcccatcaaagtaggtggcgaggaaggttacacaatgcgtcatgctcgagctcctgaattggttgatgtaccttgggaaggagctgctactatgcctgctttgtttgagcagtcttgtaagaagtattcgaaagatcggttactaggaactagagagtttatagataaggaatttattactgctagtgatgggaggaagtttgagaagcttcatttaggagagtataaatggcaaagttatggagaggtttttgaacgtgtttgtaactttgcgtcggggttagttaatgtaggacataatgttgatgatcgtgttgctatcttttcggatactcgtgctgagtggtttatcgcgtttcagggatgtttcaggcagagcataaccgttgttactatttatgcttctttaggagaagaggctttgatttactcactcaatgagactcgagtgtcaaccttaatatgtgactcaaaacaacttaagaagttgtctgcgatacaatcaagcttgaaaactgtgaagaacattatttacattgaagaagatggagtagatgttgcttctagtgatgtcaatagtatgggtgatataactgtttcgtcgatctctgatttttttaaactccccccccacaacgctgttcaaccgatcttaccttcgaagaatggagttgctgttataatgtttaccagtggtagtactggtctaccaaagggagttatgattacccacggaaatcttgtcgcaactgctgcaggagttatgaaagtggttccaaagttggataaaaatgatacatatattgcgtacttacctttggctcatgtgtttgagctggaagctgagattgtggtctttacctcaggtagtgccatcggttacggctcagcaatgactttaactgacacttcaaataaagttaagaaaggaaccaaaggagatgtttcagctctgaagccaactataatgactgcagttccagctattctggatcgtgtccgagaaggagttcttaaaaaggttgaggaaaagggagggatggcgaagaccctttttgactttgcatacaagcgccggttagcagctgtggatggaagttggtttggtgcctggggtttggagaaaatgttatgggatgctcttgtcttcaagaaaatacgcgctgtgcttggaggacacatccgttttatgctcgttggaggagctcctctgtctcctgattcgcaacgcttcatcaatatctgcatggggtctcccatcggccaaggatatggattgactgaaacgtgtgctggagctacgttttctgagtgggacgatcctgctgttggtcgtgttggacctccacttccatgcggctacgttaagctcgtttcttgggaagaaggtggctacagaatttcagataaaccaatgcctagaggggagattgtggtaggtggtaacagtgtaacagcaggttacttcaacaatcaagaaaaaaccgatgaggtttacaaggtcgatgagaagggcacaaggtggttttacaccggagatattgggagattccaccctgatggatgtctcgaagtcatcgatagaaagaaagatattgttaaacttcaacatggggaatacgtatcccttggaaaggtggaggcagctttgggttcgagcaattacgttgataacatcatggtccacgcagacccaattaacagctactgtgtagctcttgttgttccatcacgaggagcattagagaaatgggcagaggaagctggagttaaacacagcgaattcgctgagctatgcgagaaaggtgaagcagtcaaggaggttcaacaatctcttaccaaggccgggaaggcggcaaagctcgaaaagtttgagcttccagcaaagatcaagttgctgtcagagccgtggacaccggagtcgggattggtcactgctgctcttaagataaagagagaacaaataaagtccaagttcaaagatgaactcagcaagttatatgcctaaaaacttttcttggacttgtgacaaactccatatatttcagtctgactttccacattttgttatatctacaataaacttgaagtttttctccttttgttaattcaatacc

SEQ ID NO: 14281 - protein, 720 aa, Arabidopsis thaliana
MEDSGVNPMDSPSKGSDFGVYGIIGGGIVALLVPVLLSVVLNGTKKGKKRGVPIKVGGEEGYTMRHARAPELVDVPWEGAATMPALFEQSCKKYSKDRLLGTREFIDKEFITASDGRKFEKLHLGEYKWQSYGEVFERVCNFASGLVNVGHNVDDRVAIFSDTRAEWFIAFQGCFRQSITVVTIYASLGEEALIYSLNETRVSTLICDSKQLKKLSAIQSSLKTVKNIIYIEEDGVDVASSDVNSMGDITVSSISDFFKLPPHNAVQPILPSKNGVAVIMFTSGSTGLPKGVMITHGNLVATAAGVMKVVPKLDKNDTYIAYLPLAHVFELEAEIVVFTSGSAIGYGSAMTLTDTSNKVKKGTKGDVSALKPTIMTAVPAILDRVREGVLKKVEEKGGMAKTLFDFAYKRRLAAVDGSWFGAWGLEKMLWDALVFKKIRAVLGGHIRFMLVGGAPLSPDSQRFINICMGSPIGQGYGLTETCAGATFSEWDDPAVGRVGPPLPCGYVKLVSWEEGGYRISDKPMPRGEIVVGGNSVTAGYFNNQEKTDEVYKVDEKGTRWFYTGDIGRFHPDGCLEVIDRKKDIVKLQHGEYVSLGKVEAALGSSNYVDNIMVHADPINSYCVALVVPSRGALEKWAEEAGVKHSEFAELCEKGEAVKEVQQSLTKAGKAAKLEKFELPAKIKLLSEPWTPESGLVTAALKIKREQIKSKFKDELSKLYA

SEQ ID NO: 14282 - DNA, 1875 bp, Photuris pennsylvanica
  CDS (7)..(1665)
gccaccatgtcaatagagaataacattttgataggaccacctccgtactatcctttggaagaaggtactgcgggagaacaattacacagagcgataacacgatatgccgcagttccaggaacactagcttatacagatgtacacaccgaacttgaagttacttataaggagtttttagatgtaacatgtcgcttagctgaagctatgaagaactatggcttaggcttacagcatactatttctgtatgtagtgaaaactgcgtacaattctttatgccagtttgcgctgctttatatattggggttgcaaccgcgcctacaaacgatatttataacgaacgtgaattgtataacagcttaagtatctcacagccaactgtagtatttacatctagaaactcattgcagaaaattctaggagtacaatcacgtttacctgttataaagaaaattattatgctcgatactaaaaaagattacttggggtatcaatctatgcagtccttcatgaaagaacacgttcctgccaatttcaatgtatcagcatttaaaccactttcatttgatcttgaccgagttgcatgtattatgaactcttcaggttctacgggattaccaaaaggtgtaccaatatcgcacagaaacaccacatacaggttttcccattgcagagatccagtatttggcaatcaaattattccggatacaactatactatgtgctgttccattccatcatgcgtttggcactttcacaaatttaggatatataatatgtggcttccacgtagtgcttatgtacagattcaatgaacacttattcttacaaacactacaagattacaaatgtcaaagcgcgttaatagtacctacagtacttgcgtttcttgctaaaaaccctttggttgataaatatgatttatcacatttacatgaaattgcttctggtggtgccccactttcaaaagaaatttcagaaatagcagcaaaacgatttaaactaccaggaatacgacaagggtatggtctaactgaaacaacgtgtgctattgtaattactgctgaaggagaatttaaacctggggctgtcggaaaagttgtaccattttattccttaaaagttcttgatcttaatacaggaaaaaaattggggccaaacgagaggggggaaatatgtttcacaggacctatgattatgaaaggttatataaataatccagaagcaacacgcgagataattgatgaagagggatggatacactctggtgatataggatattttgatgaagatggccatgtatacattgttgatcgattgaaatctttgattaaatacaaaggctatcaagttccgcccgccgagttagaagctttactgctgcagcatccatttattgaagatgcaggagttgcgggtgttcccgatgaagttgcgggtgatcttcctggtgctgttgtagttttaaaagaaggaaaatctattacagaaaaagaaatccaggattacgtggcagggcaagtaacttcttcgaaaaagttacgaggaggtgttgaatttgtgaaagaggtacccaaaggttttactggaaaaattgataccagaaaaataaaagaaatacttattaaggcacaaaaaggcaaatccaaatccaaagccaaattgtaaactgtaaagtgtttgttaatgttgttaaacattttataaaatacactgtatctatttattagtaaccaaaatgcttctaacatcaagatgcctatatctaagaaagttgtatttatatattttggggtttttggtgattatgtcaaatgtatgtgtgaaaagggtatacgtagtttaagggacataaaaataaataaaattaattattgg

SEQ ID NO: 14283 - protein, 552 aa, Photuris pennsylvanica
MSIENNILIGPPPYYPLEEGTAGEQLHRAITRYAAVPGTLAYTDVHTELEVTYKEFLDVTCRLAEAMKNYGLGLQHTISVCSENCVQFFMPVCAALYIGVATAPTNDIYNERELYNSLSISQPTVVFTSRNSLQKILGVQSRLPVIKKIIMLDTKKDYLGYQSMQSFMKEHVPANFNVSAFKPLSFDLDRVACIMNSSGSTGLPKGVPISHRNTTYRFSHCRDPVFGNQIIPDTTILCAVPFHHAFGTFTNLGYIICGFHVVLMYRFNEHLFLQTLQDYKCQSALIVPTVLAFLAKNPLVDKYDLSHLHEIASGGAPLSKEISEIAAKRFKLPGIRQGYGLTETTCAIVITAEGEFKPGAVGKVVPFYSLKVLDLNTGKKLGPNERGEICFTGPMIMKGYINNPEATREIIDEEGWIHSGDIGYFDEDGHVYIVDRLKSLIKYKGYQVPPAELEALLLQHPFIEDAGVAGVPDEVAGDLPGAVVVLKEGKSITEKEIQDYVAGQVTSSKKLRGGVEFVKEVPKGFTGKIDTRKIKEILIKAQKGKSKSKAKL

SEQ ID NO: 14284 - DNA, 1862 bp, Populus balsamifera subsp
  CDS (7)..(1629)
cccgcaatggacgccataatgaattcacaagaagaattcatctttcgctcaaaattaccagacatctacatcccgaaaaaccttcctctgcattcatacgttcttgaaaacttgtctaaatattcatcaaaaccttgcctgataaatggcgcaaacggagatgtctacacctatgctgacgttgagctcacagcaagaagagttgcttctggtcttaacaagattggtattcaacaaggtgacgtgatcatgctcttcctaccaagttcacctgaattcgtgcttgctttcctaggcgcttcacacagaggtgccattgtcaccgctgccaatcctttctccacccctgcagagctagcaaaacatgccaagcctccaagaacaaagcttttgataacacaggcttgttactacgacaaggttaaagattttgcacgagaaagtgatgttaaggtcatgtgcgtagactctgccccagatgggtgcttgcacttttcagagctaacacaggctgacgaaaatgaagtgccccaggtcgactttagtcctgatgatgttgtagcattgccttattcatcagggactacagggttaccaaaaggggtcatgctaacgcacaaagggctaataaccagtgtggctcaacaagtagatggagacaatcctaacctgtattttcacagtgaagatgtgattttgtgtgtgttgcctatgttccatatctatgctctgaattcaataatgctttgtgggctgagagttggtgcctcgattttgataatgccaaagtttgatattggtactctgctgggattgattgagaagtacaaggtatctatagcaccagttgttccacctgtgatgttggcaattgctaagtcacctgattttgacaagcacgacttgtcttctttgaggatgataaaatctggaggggctccattgggcaaggaacttgaagatactgtcagagctaagtttcctcaggccagacttggtcagggatatggaatgaccgaggcaggacctgttctagcaatgtgcttggcatttgccaaggaaccatttgacataaaaccaggtgcatgtgggactgtcgtcaggaatgcagaaatgaagattgttgacccagaaacaggggcctctctacggaggaaccagcctggtgagatctgcatccggggtgatcagatcatgaaaggatatcttaatgaccctgaggcaacctcaagaacaatagacaaagaaggatggttgcacacaggcgatatcggctacattgatgacgatgatgagcttttcatcgttgacagattgaaggaattgatcaaatataaagggtttcaggttgctcctgctgaactcgaagctttgttactagcccatccacagatatccgatgctgctgtagtaggaatgaaagatgaggatgcaggagaagttcctgttgcatttgtagtgaaatcagaaaagtctcaggccaccgaagatgaaattaagcagtatatttcaaaacaggtgatattctacaagagaataaaacgagttttcttcattgaagcaattcccaaggcgccatcaggcaaaatccttaggaagaatctgagagaaacgttgccaggcatataactgaagacgttactgaacatttaaccctctgtcttatttctttaatacttgcgaaaatgccaatgaatcattgtagtgttgaatcaagcgtgcttggaaaagacacgttaccaaacgttaagaacattactgttcttgttatacaagctctttaatgttgcttttgtacttgggaaaacataagttctcctgtcgccatatggagtaattcaattgaatattttggttttttt

SEQ ID NO: 14285 - protein, 540 aa, Populus balsamifera subsp
MDAIMNSQEEFIFRSKLPDIYIPKNLPLHSYVLENLSKYSSKPCLINGANGDVYTYADVELTARRVASGLNKIGIQQGDVIMLFLPSSPEFVLAFLGASHRGAIVTAANPFSTPAELAKHAKPPRTKLLITQACYYDKVKDFARESDVKVMCVDSAPDGCLHFSELTQADENEVPQVDFSPDDVVALPYSSGTTGLPKGVMLTHKGLITSVAQQVDGDNPNLYFHSEDVILCVLPMFHIYALNSIMLCGLRVGASILIMPKFDIGTLLGLIEKYKVSIAPVVPPVMLAIAKSPDFDKHDLSSLRMIKSGGAPLGKELEDTVRAKFPQARLGQGYGMTEAGPVLAMCLAFAKEPFDIKPGACGTVVRNAEMKIVDPETGASLRRNQPGEICIRGDQIMKGYLNDPEATSRTIDKEGWLHTGDIGYIDDDDELFIVDRLKELIKYKGFQVAPAELEALLLAHPQISDAAVVGMKDEDAGEVPVAFVVKSEKSQATEDEIKQYISKQVIFYKRIKRVFFIEAIPKAPSGKILRKNLRETLPGI

SEQ ID NO: 14286 - DNA, 1704 bp, Rhizobium loti
  CDS (1)..(1704)
atgccgaaggcgctcacggaacttgccgccggcctgcccgaaaagccgtggctcaagagctatccgaaaaatgtccaggccgagatcggggtgttgccctacagttcgatcggcgatttcctggtcgccgcctgcaagcagttttccgcccagccggccttcacctgcatggacaaatccatcagctacgcagatgtcgagcagctgtcggcggccttcggtgcctatctgcaatcgaaggggctgcaaaagggtgcgcgcgtcgccgtgatgatgcctaacgttctgcaatatccggtggcgatgatgggcatcctgcgcgccggctatgtcgtggtgaacatcaatccgctctacacgccgcgcgagctggagcaccagctcaaggattccggcgcacaagccatcgtcatcctggagaacttcgccaacacgttgcaggcggtaatcgccaggaccgcggtcaagcatgtcgtggtggcggccatgggcgacatgctcggcggcctcaagggcacgatcgtcaacttcgtggtgcgccgcgtgaagaagatggtgccggcatggtcgctgcccgggcatgtcaagttcaacgcggcgatgaaggccggcgccggccttggcttcaagccggccaaggttgcggccgacgatgttgccttcctgcaatatacgggcggcaccacgggcgtgtcgaaaggcgccacgctgctgcaccgcaatgtgctctccaatgtcgtgcagaacgcacagtggatggaagacgcctatacgatcaagccgaaaccggcacacccgaacttcatctgcgcgctgccgctctatcatatcttcgcgctgacggtgaacgcactgatgggcatgcagcaaggcgcccgcaacgtgctcattcccaacccgcgcgatattccagccttcgtcaaggaactccagaagtatccggtccacatctttcccggcctcaacacgctgttcaacgcgctgctcaacaatgaggacttccgcaaactcgacttcaagccgctggtgctgacactgggcggcggcatggcggtgcagaagggcgtcgccgaacgttggaaggctttgaccggttgccctgtcactgaaggctacggcctctcggaaacctcgccggtggcgacggccaacaagttcagttccggcgacttcaccggcacgatcggcctgcccttgccgtcgacggaaatcgccatccgcgacgatgacggcaacaatttgccgctgggcgaggtcggcgagatctgcatccggggaccgcaggtgatggcgggttactggaaccggcctgacgagaccgccaaggtgatgaccaaggacggctacttcaagtcaggcgacatgggcttcatggacgagcgcggctacaccaagatcgtcgatcgcaagaaggacatgatcctggtctcgggcttcaacgtctatcccaacgagctcgaggaggtcgtggcgatgcatccaggcgtgctcgaagtcgcggcgatcggcgtgccagacgagcattcgggcgaagtgccgaagctgttcatcgtcaagaaggatccagccctgaccgtggaagccatcgccgctttttgccgcgaaaacctgaccggctacaaacggcccaaatatatcgagttcaggaccgaattgccgaagacgccggtcggcaagatcctgcggcgggcattgcgcgcctga

SEQ ID NO: 14287 - protein, 567 aa, Rhizobium loti
MPKALTELAAGLPEKPWLKSYPKNVQAEIGVLPYSSIGDFLVAACKQFSAQPAFTCMDKSISYADVEQLSAAFGAYLQSKGLQKGARVAVMMPNVLQYPVAMMGILRAGYVVVNINPLYTPRELEHQLKDSGAQAIVILENFANTLQAVIARTAVKHVVVAAMGDMLGGLKGTIVNFVVRRVKKMVPAWSLPGHVKFNAAMKAGAGLGFKPAKVAADDVAFLQYTGGTTGVSKGATLLHRNVLSNVVQNAQWMEDAYTIKPKPAHPNFICALPLYHIFALTVNALMGMQQGARNVLIPNPRDIPAFVKELQKYPVHIFPGLNTLFNALLNNEDFRKLDFKPLVLTLGGGMAVQKGVAERWKALTGCPVTEGYGLSETSPVATANKFSSGDFTGTIGLPLPSTEIAIRDDDGNNLPLGEVGEICIRGPQVMAGYWNRPDETAKVMTKDGYFKSGDMGFMDERGYTKIVDRKKDMILVSGFNVYPNELEEVVAMHPGVLEVAAIGVPDEHSGEVPKLFIVKKDPALTVEAIAAFCRENLTGYKRPKYIEFRTELPKTPVGKILRRALRA

SEQ ID NO: 14288 - DNA, 1701 bp, Rhizobium meliloti
  CDS (1)..(1701)
atggcggaagcaagcacgcaacaggcgggctccagcacggcgaagatttggcttggatcctacccgccgggcgtgccggccgaaatcggcccgctcacctatcgatccatcggcgaattcttcgatcacgcggttgcgcaatattcctggcgccccgcattcacctgcatgggcaaggcactgaccttctccgatctcaatacgcattcggcgaaaatcggcgcctggctgcagtcgctggggctcgcgaagggcgatcgggttgcggtgatgatgcccaacatccttcaaaatccggtcatcgtctatgggatcctgcgagccggcttcaccgtcgtcaacgtcaatccgctctatacgccgcgcgaactggagcaccagttggtggatgccggcgccaaggcgatcttcgtgcttgagaatttcgctcatacggtcgagcaggtgctggcccgcacggaggtcaagcatgtcgtggtcgccagcatgggcgacatgcttggtgcgaagggggcaatcgtcaatctggtggtgcgccgcgtcaagaagctcgtccccgcctggtcgattccaggtcacctttcgttcaagacggttcttgccaagggcgcgacgctcggcttcaagcgcccgaacgtagcgccgggagatgtcgccttcctgcaatatacgggcggcaccaccggtgtttccaagggcgcaacgctgacgcacgccaatctcctgtccaacatggcccagatggagctgtggctgaacacggccttcctgcgcaagccgcgcccggagagcctcaccttcatgtgcgcgcttccgctctaccatatcttcgcgctcacggtgaattcgctgatgggactggcaaccggcggcaacaacatcctgataccgaacccgcgcgacatccccgccttcgtcaaggagctcggcaggtacaggacgaacatctttccggggctgaacacgctcttcaacgcgttgatgaacaattccgaattccgcaaactcgacttctcttccctgatcctgaccttcggcggcggcatggcggtgcagcggccggtcgccgagcgctggctggagctgaccggctgcccgatccatgagggctacggactttccgagacgtcgccggtcgccaccgccaaccgcctcgacaccgacgatttcaccggcacgatcggcataccgctgccctcgacggaggtcgagatccgcgacgaggacgggcgcacgcttcccgtcggcgaaatcggtgagatctgcattcgcgggccgcaggtgatggcgggttactggcagcgccccgaggaaacggccagggccatttcgccggacggcttcttccgcaccggggatgtcggcttcatgaacgccgagggactgacgaagatcgtcgatcggaagaaggacatgatcctcgtctcgggattcaacgtgttccccaacgagatcgaggaagtggcggcgacccatcccggcatcctcgaatgcgccgcaatcggcgttgccgacccgcattccggcgaggcggtcaagctcttcgtcgtgcgcaaggacccgaacctcaccgaagaagaggtcaagcgccactgtgccgccagcctcaccaactacaagcggccgcgatacgtggaattccgcaccgaactgcccaagtcgaacgtcggcaagatcctgcgcaaggacctgcgcggatag

SEQ ID NO: 14289 - protein, 566 aa, Rhizobium meliloti
MAEASTQQAGSSTAKIWLGSYPPGVPAEIGPLTYRSIGEFFDHAVAQYSWRPAFTCMGKALTFSDLNTHSAKIGAWLQSLGLAKGDRVAVMMPNILQNPVIVYGILRAGFTVVNVNPLYTPRELEHQLVDAGAKAIFVLENFAHTVEQVLARTEVKHVVVASMGDMLGAKGAIVNLVVRRVKKLVPAWSIPGHLSFKTVLAKGATLGFKRPNVAPGDVAFLQYTGGTTGVSKGATLTHANLLSNMAQMELWLNTAFLRKPRPESLTFMCALPLYHIFALTVNSLMGLATGGNNILIPNPRDIPAFVKELGRYRTNIFPGLNTLFNALMNNSEFRKLDFSSLILTFGGGMAVQRPVAERWLELTGCPIHEGYGLSETSPVATANRLDTDDFTGTIGIPLPSTEVEIRDEDGRTLPVGEIGEICIRGPQVMAGYWQRPEETARAISPDGFFRTGDVGFMNAEGLTKIVDRKKDMILVSGFNVFPNEIEEVAATHPGILECAAIGVADPHSGEAVKLFVVRKDPNLTEEEVKRHCAASLTNYKRPRYVEFRTELPKSNVGKILRKDLRG

SEQ ID NO: 14290 - DNA, 2358 bp, Babesia bovis
  CDS (225)..(2288)
gacttggaattaacacgtaattaacccacgatccttaatacgtcattaacccaccaagatctcattaagaaaccaaagggcggcctttgtgctttcttattgggacatttatatagatcctttgctgcacacgcagcatattgttatgtagtaaggctgtacgttgccagagtagcacgtacacaacatttcattattgacccttgtctagtacgtgtttgaaaatgtcggcagaattgtttggcgtggtcgatgtggccatgtttgactcggaggctaataaacctctgaatatgttgcagtattctcgtgttatctgccagaaccctaagaaagatgagagtgatgtttactgtgctcttaacaacaagggtgagtgcgttgacatccctccttttcctgagaggttccaaactagctttgatatgctccgtcacatggctgagcaaaaccctaacagggatcatcttggtgttcgtgagaaacatgttaattccaaaggtgagataactttgggtgaatacaagtggtatactatctcatacactgcaactactgctgtcattttgggtagtgcttttgtaagtgaacccggtttattttccgagactgttcttgatgatgccattttgaagaaggccaagttcttgggtatctgggccaccaactgtcctttgtggcttatttccgactatgctgctatcgcttttggttttgtaacagttcctttatacgagaccatgggagatgaggcgatattgacgatttttaaggagacgaagatgaaaacgctatgtattgatgctgccaaattgcctacattgttgaagttgaaggataggcttccggaggtcaagaatttaattttgtttgacaagttgtctgacaaggataagaaggccattgaggaagctggttggaatacctatgacattgaggagttgatggacaagtaccgtgacaacattgtggaggtaccacagggtgaccgcaatgccattgccactgttatttacacctctggtacaagtggtatgcccaagggtgctatccataccaatttgtcgttaatggaaacttcacaccgcatttactttactgccaatcgtcttcgcttctctactaattttacgttattaagtttcctcccactttcccatgtttatgagcgtttcgtggagcattttgctgcgtctaacatgagccgtatcggatactacgggggtaacatcaagaacatcttggatgatatccaagctttgaagcctgatatactagttggtgtgccacgtgtattcactaaggtccttgaccgtattaggaccaatattgagaagaagccaatgccactgaggaagctgatcaacttcgttgttgagaagaaacgcaagatgctttttgaaagcgacgtcttccctacccattggttttatgacaggattttaggcaagatcaggaaggcctttggtggtaacatcaagtccatggttttgggttctgcagctatgactgcgagtgacattgagtatttacaaacatacctcatttcacctgtgtgtgaaggttggggaaccactgaagtgggtatcggttttctccaggaccaccgtgacaaggtcaagggtaccattggtggtcctctaggtgacatcatctttaaacttaaatcaattcccgaaatggagtatgatgcacgtggcaacccaccccgtggtgagcttctggtcaagggtactggcatcatgttgggatatttgcaacgcccagaggaaactgctgaggtccttgactcggagggctggtaccacactggtgacgtcgttgaactgttgccaagtatgggtgtcaagattctagatcgtgctcgcaacttattcaaattaagtcagggtgaatacattgctcccgagaagctagagaacctctacgcgggatcgccctttgttgaacaaatttacatctacggtgacgctaagcgtgaccatatcgtcgccatcgtaaacatcaatgcagaatacgtaatggagtgggccgcttctcacaacctgggtggcaaatcagtgaaggatttgctgactaaccagcagctgattgatgagattcaagcctctttcaacaatatcactgagcagaacaagcttaatgggcttgagcgtctgcagaagttcatcctcagcgatgagcttttcagcgttgacaatgggatgttaactcccaccttcaagactgtccgcaagaaggtgcgcagtcgttacgagaaggagatcaacgcaatgtacggccactgagtcaatcaaactaacgcatctataatggtaattacaattcatgtttaaaaaaaaaaaaaaaaaaaaaaaa

SEQ ID NO: 14291 - protein, 687 aa, Babesia bovis
MSAELFGVVDVAMFDSEANKPLNMLQYSRVICQNPKKDESDVYCALNNKGECVDIPPFPERFQTSFDMLRHMAEQNPNRDHLGVREKHVNSKGEITLGEYKWYTISYTATTAVILGSAFVSEPGLFSETVLDDAILKKAKFLGIWATNCPLWLISDYAAIAFGFVTVPLYETMGDEAILTIFKETKMKTLCIDAAKLPTLLKLKDRLPEVKNLILFDKLSDKDKKAIEEAGWNTYDIEELMDKYRDNIVEVPQGDRNAIATVIYTSGTSGMPKGAIHTNLSLMETSHRIYFTANRLRFSTNFTLLSFLPLSHVYERFVEHFAASNMSRIGYYGGNIKNILDDIQALKPDILVGVPRVFTKVLDRIRTNIEKKPMPLRKLINFVVEKKRKMLFESDVFPTHWFYDRILGKIRKAFGGNIKSMVLGSAAMTASDIEYLQTYLISPVCEGWGTTEVGIGFLQDHRDKVKGTIGGPLGDIIFKLKSIPEMEYDARGNPPRGELLVKGTGIMLGYLQRPEETAEVLDSEGWYHTGDVVELLPSMGVKILDRARNLFKLSQGEYIAPEKLENLYAGSPFVEQIYIYGDAKRDHIVAIVNINAEYVMEWAASHNLGGKSVKDLLTNQQLIDEIQASFNNITEQNKLNGLERLQKFILSDELFSVDNGMLTPTFKTVRKKVRSRYEKEINAMYGH

SEQ ID NO: 14292 - DNA, 1689 bp, Pasteurella multocida
  CDS (1)..(1689)
atggaaaaaccttggtttaaaaattaccctgaacacttaccacgagaattagatacatcaaaatacgattctttgttggatatgtttgataatgctgtacagacacatcctgatcgtgcagcttatgtcaatatggggcaaattttaacctttcgaaaattagaagaacgtagccgggcttttgccgcgtatttacaaaatgaattaaagcttaaacgtggtgatcgtgtcgcgttgatgatgccaaatctattgcaatatccgattgcgctcttcggtattttacgcgcagggatggtggtggtgaatgtcaatccgctttataccccacgtgaattagaacaccaattaaaagacagtggcgccacggcgattgttgtggtttctaattttgcctctacgctcgaaaaagtggtgtttaatacggatgtcaaacatgtgattttaactcgtatgggcgatcaactttcctttggtaaacgcacattagtcaattttgtagtgaaatacatcaaaaaattggtgcctaaatataaattaccgaatgcagtgacttttcgtgaagtgttgagcattggaaaatatcgtcaatatgttcgcccacaaatggagcgtaaagatttagcctttttacaatatactggcgggacaactggtgtcgcaaaaggggcgatgctgtcacacggcaatatcattgtcaatttattccaagccaactggattgccgaaccgtttgtcggtgatcgtacaaaagagcgtaaagccatcattgctttaccgctttatcatgtgtttgccttaactgtaaactgtttactgtttgttgaactggggattacaggggtattaattaccaatccacgtgacattgagggctttgtaaaagagctgaaaaaacaccgctttgttgctattacaggcgtcaatactttattcaatgctttgttaaataatgagaattttaaagaggtggattttactgctttaaaacttaccgtaggcggtgggatgtcgattcaacaatcggtagcaacacgctggcatgacaccactggctgtaatattatcgagggttatggcatgactgaatgttctccattgattgcagcttgtccaattaatatggtgaaacataatggaagcattggtgtgccggtacctaataccgatgtgcgtattatcaaagaagatggtcacgaagccgaattgggtgaaccgggcgagctttgggttaaaggtgagcaagtcatgcaaggctattggcaacgtccagaggctacggcagaggtcctgatggatggttggatggcaacaggtgatgtggttatcatggataaagatcattatttacggatagtcgatcgtaaaaaagatatgatcttagtgtcagggtttaatgtctatccaaatgagatcgaagatgtggtcatgttaaatgacaaagtcgctgaagtggtcgccattggtgtgccaaatgaagtatcaggtgaaacgattaagatttttgtcgtgaaaaaagacgaaagcctgacccgtgatgaattacgtaaacactgtcgtgtccatttaaccggctataaaattccaaaagaaattgaatttcgtgaggaattgccgaaaagtaatgtgggcaaaattttacgccgtgttttacgtgatgaggagctggcaaaacgtccagctgaataa

SEQ ID NO: 14293 - protein, 562 aa, Pasteurella multocida
MEKPWFKNYPEHLPRELDTSKYDSLLDMFDNAVQTHPDRAAYVNMGQILTFRKLEERSRAFAAYLQNELKLKRGDRVALMMPNLLQYPIALFGILRAGMVVVNVNPLYTPRELEHQLKDSGATAIVVVSNFASTLEKVVFNTDVKHVILTRMGDQLSFGKRTLVNFVVKYIKKLVPKYKLPNAVTFREVLSIGKYRQYVRPQMERKDLAFLQYTGGTTGVAKGAMLSHGNIIVNLFQANWIAEPFVGDRTKERKAIIALPLYHVFALTVNCLLFVELGITGVLITNPRDIEGFVKELKKHRFVAITGVNTLFNALLNNENFKEVDFTALKLTVGGGMSIQQSVATRWHDTTGCNIIEGYGMTECSPLIAACPINMVKHNGSIGVPVPNTDVRIIKEDGHEAELGEPGELWVKGEQVMQGYWQRPEATAEVLMDGWMATGDVVIMDKDHYLRIVDRKKDMILVSGFNVYPNEIEDVVMLNDKVAEVVAIGVPNEVSGETIKIFVVKKDESLTRDELRKHCRVHLTGYKIPKEIEFREELPKSNVGKILRRVLRDEELAKRPAE

SEQ ID NO: 14294 - DNA, 2722 bp, Cavia porcellus
  CDS (420)..(2468)
cagggtggattgtactgaagcgagctggcttttgctctcagccctgaggggctggggttagaggcgttgaaagggagccaggaggcttgggcagcttctttcctcgtggtcacagtacttccactttcagttgtgaaagaaaaaccaggaagtgaagtctccgagcacgttagaaagcccggccatggcctgactggggacagcttaaagcagggtgtcggtggaggcactctgagactgcctgtctgcctgcatggacactctgagggcccccaatctctggggaagccacaggtaagaagtgagggacgggactcctgtgtcaggaagaaacgtggagccggaaactctcttcgctggaaacaccaaggcactcggctccctctcagggtctgagcttcctgctactattcacaaagatgctttttatctttaacttcttgttttccccacttccgaccccggcactggtctgcctgctgacatttggagctgctgtcttcctgtggttaatcaacagacctcagccagtcttgcctcccattgacctgaacaagcagtctgtggggattgagggaggagcgcggaaaagttctttcctgaagaacgacctgatagggtgttacttcccagatgccaggacgatgtatgaaattttccagagaggacttgctgtgtctgacaatggtccctgcttgggatacagaaaaccaaaccaaccctacagatggctgtcctacaaagaggtatctgatcgagcagagtacctgggttcctgtctcttacataaaggatgtaagccctcgccagaccagtttattggaatttttgctcagaacaggccagagtgggtcatctctgagtttgcttgttactcatactccatggtagtcgtccctctgtatgacaccttgggagaagatgccatcacatatattgtcaataaggctgatatctccaccatcatctgtgatacaccacaaaaagcattggtcctaatagataatgtggaaaagggccttaccccacacctgaagctggtcattctcatggatcccttcaatgatgacctgaaggaaagaggagagaagtgtggacttgaggtcttatccctcttggatgctgagaatctaggcaaagagaactacagaaaacctgtgcctccaaacccggaagacctgagcatcatctgtttcaccagtgggaccacaggtgaccccaaaggagctatgttaacacataaaaacattgcttcaaatgttactggatttctcaaaagtcttgagcatattttccagcccacctgtaaggatgtgaccatatcctaccttcccttagcgcacatgtttgaaagaattgtgcaggctgtcgtgttttcctgcggagccagggtggggttctttcaaggagatattcggttgctgtctgatgatatgaagactctaaagcccacagttttccccacagtgcctcgcctggttaacaagatctacgataaggtacaaagtgaagccaacacacccttgaagaagttcttgctgaacatagctgttctcagtaaattcagcgaagtgaaaaatgggatcatcaggcgtgacagtctgtgggataagctcattttttcgaagctccagaatagcctgggcgggaggattcacttcgtgatcacttcagctgcccccatctcccttccagtcttgacattcttccgggcagcaatgggatgtgtggtgattgaagcttatggtcaaacagaatgctcaggtggctgtacaattacatctcctggggactggacctcgggtcatgtcggagctcccatgtgttgcagttatgtgaagctggaagatgtacctgacatgaactactttgcagcgaacaacgaaggggagatctgtgtcaagggtctcagtgtgttccaaggatatctgaaagagcccaaaaagacacaggaagtcctggacaaggatggctggttgcacactggagacattggttgctggcttccaaatggaactctgaagatcattgaccggaaaaagaacattttcaagctggcacaaggagagtacattgctccggagaagatagaaaacatctacaccaggagtggtccagtgtcacaaatttttatttatggggagagcttacggtcatccttagtcggagtggtggttcctgacccagacgtgcttccttcatttgcagccaaactaggggttaagggatctcttgaagaactgtgccaatccaaagttgtaaaagaagccattttagaagacttacaaaaaattgggaaagaaaatggccttaaatcctttgaacaggtcagaaacatttttcttcacccagaagcatttcccattgaaaatggactgctgacaccaacactgaaagcaaaacgaggagatctcatcaaatacttccgggcccagattgaccgcctctatgacagtatccaggaataggtttgctgaactggaagctgtgggcaaggagttgaaacttatgtccagttactttttccagtaaatgaagcaagtactgaataaaacctccctgcactaggaacaaagatctggggcaaacatgctgtccatactacaccttatcttctgtgaaggaaccaactgattttttccactggattccagctaccactgtgccttactgccagataatacatgttgcttctacccgtacatgtaaaacccttaaataa

SEQ ID NO: 14295 - protein, 682 aa, Cavia porcellus
MLFIFNFLFSPLPTPALVCLLTFGAAVFLWLINRPQPVLPPIDLNKQSVGIEGGARKSSFLKNDLIGCYFPDARTMYEIFQRGLAVSDNGPCLGYRKPNQPYRWLSYKEVSDRAEYLGSCLLHKGCKPSPDQFIGIFAQNRPEWVISEFACYSYSMVVVPLYDTLGEDAITYIVNKADISTIICDTPQKALVLIDNVEKGLTPHLKLVILMDPFNDDLKERGEKCGLEVLSLLDAENLGKENYRKPVPPNPEDLSIICFTSGTTGDPKGAMLTHKNIASNVTGFLKSLEHIFQPTCKDVTISYLPLAHMFERIVQAVVFSCGARVGFFQGDIRLLSDDMKTLKPTVFPTVPRLVNKIYDKVQSEANTPLKKFLLNIAVLSKFSEVKNGIIRRDSLWDKLIFSKLQNSLGGRIHFVITSAAPISLPVLTFFRAAMGCVVIEAYGQTECSGGCTITSPGDWTSGHVGAPMCCSYVKLEDVPDMNYFAANNEGEICVKGLSVFQGYLKEPKKTQEVLDKDGWLHTGDIGCWLPNGTLKIIDRKKNIFKLAQGEYIAPEKIENIYTRSGPVSQIFIYGESLRSSLVGVVVPDPDVLPSFAAKLGVKGSLEELCQSKVVKEAILEDLQKIGKENGLKSFEQVRNIFLHPEAFPIENGLLTPTLKAKRGDLIKYFRAQIDRLYDSIQE

SEQ ID NO: 14296 - DNA, 2246 bp, Brassica napus
  CDS (14)..(2095)
ctagaagtgaaagatgattccttacgctgctggtgtcattgtccctctagctttaacccttttggtccgcaacgctaagaaagacaagaaacgaggcgtggtcgtcgacgacgtcggtggagagccgggtcataccgttaggaaccacaggttcaaagatcccgtcagctcccactgggaagacatctccactctcccggagctattcgagatctcgtgtaagagccacagcgacaggttcttccttggcaccaggaggttgatcgctagagaggtcgagactagcgaggacgggaaggtctttgagaagcttcatttgggtgattacgagtggaagacgtttggggagacgcttgaagctgtgtgtagttttgcttctggtttggttcagattgggcacaagtctgaggagcgtgtggctatttttgcggatacgagagaagagtggtttattgcgttacagggctgcttcaggcgcaacgtcactgtggttactatctactcgtctttaggagaggaagctctttgtcactcgcttaatgagacagaggtcacaaccgtgatctgtggtaacaaagaactcaagaagctcatggacataagccaacagcttgagactgtcaaacgcgtcatttgcatggatgacgagttcccatctgaagcgagcagtacttggacgacgacttcgctcgctgatgttcagaaacttgggcgtgaaagtcctgttgatcctagcttcccactttcagctgatgttgctgttataatgtacactagtggaagcactggtctccccaagggtgttatgatgacgcatggtaatgtcctagctacagtttcagcagtgatgacaattgttccagacctcgggaagagggacacatacatggcgtatttacctttggctcacatccttgagttagcagctgagagtgtaatggctactattgggagtgctattggatatggatctcccttgacgctcactgatacttcaaacaagattaaaaagggcacaaagggagatgtcacagcgctgaagcctactataatgacagctgttccagccattcttgatcgtgtcagggacggtgtccgcaaaaaggttgatgcaaagggaggagcggcaaagaaactgttcgactttgcatatgcgaggagattatctgcaatcaatggaagctggtttggagcctggggactggagaagctcctatgggatgtgcttgtgtttggtaaaatccgtgcagtattgggaggtcagctccgttacttgctctctggtggagcccctctttctggtgacactcagagattcattaacatatgcgttggggctccgatcggtcagggatatgggctaacagagacttgtgctggtggaactttctcggagtttgatgacacatccgttggccgtgtgggtgctccacttccttgctcctttgttaagctaatagactggccggaaggtggctacttgatcagtgataagccaatgcctcgtggtgaaattgtaattggtggctcaaatattacacttgggtatttcaagaatgaagagaagactaaagaagtctacaaggttgatgaaaaggggatgaggtggttctacacaggagacataggacagtttcaccctgatggttgccttgagataatagacagaaagaaggatattgttaagcttcagcatggggaatatgtctccttgggcaaagtggaagctgctctcagtataagcccctacgttgaaaacataatggttcatgctgatccgttttacagttactgtgtggctcttgtggttgctgcgcaacaaacacttgaaggttgggcatcaaagcaaggaatagagttcaccaacttcgaagagctgtgtgcgaaagaacagcccgtgaaagaagtgtatgcgtctcttgtcaaggcggctaaacaatcacggttggagaagtttgagataccagcaaagatcaaagtgttggcggctccatggacgccggagtcagggttagtgacagcagcactaaagcttaaaagagatgtaattaggaaggagttctctgaagatctcaccaagctatatgcttcctaaatcttcttctttgttttctctaaaacacaacttgtctgtgttgctctttagttggtttgcttgagagtagaaaaagagttgtagacacaaaaacattactggagttcaaacaatctatatgctctcatactataaccaaaaaagcggccgc

SEQ ID NO: 14297 - protein, 693 aa, Brassica napus
MIPYAAGVIVPLALTLLVRNAKKDKKRGVVVDDVGGEPGHTVRNHRFKDPVSSHWEDISTLPELFEISCKSHSDRFFLGTRRLIAREVETSEDGKVFEKLHLGDYEWKTFGETLEAVCSFASGLVQIGHKSEERVAIFADTREEWFIALQGCFRRNVTVVTIYSSLGEEALCHSLNETEVTTVICGNKELKKLMDISQQLETVKRVICMDDEFPSEASSTWTTTSLADVQKLGRESPVDPSFPLSADVAVIMYTSGSTGLPKGVMMTHGNVLATVSAVMTIVPDLGKRDTYMAYLPLAHILELAAESVMATIGSAIGYGSPLTLTDTSNKIKKGTKGDVTALKPTIMTAVPAILDRVRDGVRKKVDAKGGAAKKLFDFAYARRLSAINGSWFGAWGLEKLLWDVLVFGKIRAVLGGQLRYLLSGGAPLSGDTQRFINICVGAPIGQGYGLTETCAGGTFSEFDDTSVGRVGAPLPCSFVKLIDWPEGGYLISDKPMPRGEIVIGGSNITLGYFKNEEKTKEVYKVDEKGMRWFYTGDIGQFHPDGCLEIIDRKKDIVKLQHGEYVSLGKVEAALSISPYVENIMVHADPFYSYCVALVVAAQQTLEGWASKQGIEFTNFEELCAKEQPVKEVYASLVKAAKQSRLEKFEIPAKIKVLAAPWTPESGLVTAALKLKRDVIRKEFSEDLTKLYAS

SEQ ID NO: 14298 - DNA, 2097 bp, Callithrix jacchus
  CDS (1)..(2097)
atgcaagcccatgagctgttccggtactttcgaatgccagagctggttgacttccgacagtacgtgcgcactcttcccaccaacacgctcatgggcttcggagcctttgcggcactcaccactttctggtacgccacgagacccagagccctgaagccaccatgtgacctctccatgcagtcggtggaagtggcgggtagtggtggtgctcgaagatccacgctacttgacagcgatgagcccttggtgtgtttctatgaggatgtcacaacattatacgaaggtttccagaggggaatacatgtgtcaaataatggcccctgtttaggctctcggaaaccagaccaaccctatgaatggctttcatacaagcaggttgcagaattgtcggagtgcataggctcagcgctgctccagaagggcttcaaggccgccccggatcagtttgttggcatctttgctcaaaatagaccggagtgggtgattattgaacaaggatgctttgcttattcgatggtgatcgttccactttatgatacccttggatccgaagccatcacgtacatactcaacaaagctgaactctctctagtttttgttgacaagccagagaaggccaaactcttactagagggcgtagaaaataagttaacaccaggccttaaaatcatagttctcatggatgcctatggcagtgaactggtggaacgaggcaagaagtgtggggtggaagtcatcagcatgaaggcaatggaggatctgggaagagccaacagacagaagcccaagcctcctgcacctgaagatcttgcagtagtttgtttcacaagtgggactacaggcaaccccaaaggagcactgatcactcatcgaaacgtagtgagcgattgttcagcttttgtgaaaatgacagagaaagtacttgccttgaatgccagtgacacacacatttcgtttttaccacttgcacacatgtatgagcagctcatgctgtgtgtaatgctgtgtcacggagctaaaatcggatttttccaaggagatatcaggctgcttatggatgacctcaaggttcttcagcccaccgtcttccctgtggttccgagactgctgaaccggatgtttgaccgaatttttggacaagcaaacaccacactgaagcgatggctcttggacttcgcctccaagaggaaagaagccgaacttcgcagcggtatcatcagaaacaacagcctgtgggacaagctgatcttccgcaaaatacagtcgagcctgggcggaagagttcggctgatggtcacaggagccgcaccagtgtctgccactgtgctgacgttcctcagagcagccctgggctgtcagttttatgaaggctacggacagaccgagtgcactgccgggtgctgcctgaccatgcctggagactggaccgcaggtcatgttggggccccgatgccttgcaatttgataaaacttgttgatgtggaagaaatgaattacatagctgccaagggcgagggcgaggtgtgtgtgaaaggcccaaatgtatttcagggctacttgaaggacccagcaaaaacagcagaagctttggacaaagacggctggttacacacaggggacattggaaaatggttaccaaatggcaccttgaagattattgacaggaaaaagcacatatttaagctggcacaaggagagtacatagcacctgaaaagattgaaaatatctacctgcgaagtgagcctgttgctcaggtgtttgtccacggagagagcttgcaggcatttctcattgcaattgtggtaccagatatcgagacattatgttcctgggcccggaagagaggattggatgggtcctttgaggaactgtgcagaaataaggatgtcaagaaagctatccttgaagacatggtgagacttgggaaggattctggtctaaaaccatttgaacaggtcaaaggcatcgcactgcaccctgaattgttttctatcgacaatggccttctgactccaacaatgaaggcgaaaaggccagagctgcggaactatttcaggtcgcagatagatgaactctattccactatcaaggtttag

SEQ ID NO: 14299 - protein, 698 aa, Callithrix jacchus
MQAHELFRYFRMPELVDFRQYVRTLPTNTLMGFGAFAALTTFWYATRPRALKPPCDLSMQSVEVAGSGGARRSTLLDSDEPLVCFYEDVTTLYEGFQRGIHVSNNGPCLGSRKPDQPYEWLSYKQVAELSECIGSALLQKGFKAAPDQFVGIFAQNRPEWVIIEQGCFAYSMVIVPLYDTLGSEAITYILNKAELSLVFVDKPEKAKLLLEGVENKLTPGLKIIVLMDAYGSELVERGKKCGVEVISMKAMEDLGRANRQKPKPPAPEDLAVVCFTSGTTGNPKGALITHRNVVSDCSAFVKMTEKVLALNASDTHISFLPLAHMYEQLMLCVMLCHGAKIGFFQGDIRLLMDDLKVLQPTVFPVVPRLLNRMFDRIFGQANTTLKRWLLDFASKRKEAELRSGIIRNNSLWDKLIFRKIQSSLGGRVRLMVTGAAPVSATVLTFLRAALGCQFYEGYGQTECTAGCCLTMPGDWTAGHVGAPMPCNLIKLVDVEEMNYIAAKGEGEVCVKGPNVFQGYLKDPAKTAEALDKDGWLHTGDIGKWLPNGTLKIIDRKKHIFKLAQGEYIAPEKIENIYLRSEPVAQVFVHGESLQAFLIAIVVPDIETLCSWARKRGLDGSFEELCRNKDVKKAILEDMVRLGKDSGLKPFEQVKGIALHPELFSIDNGLLTPTMKAKRPELRNYFRSQIDELYSTIKV

SEQ ID NO: 14300 - DNA, 2270 bp, Homo sapiens
  CDS (48)..(2222)
ctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccg

SEQ ID NO: 14301 - protein, 724 aa, Homo sapiens
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 14302 - DNA, 1911 bp, Streptomyces coelicolor
  CDS (1)..(1911)
atgcacgaccccgcactcgctccccggaccgtcccgccgctgaccggctcgctcgccgacagcctcttcgagacggccgcccgcacgccgaccctgccgatgctcgcccggcgccgcggccccggctccacggcgtgggacgaggtgaccgcggtggagttccgcgacacggtggtcgacctggccaagggcctgatcgcgagcgggatatcgccgggcgaccgggtggcgatcctggcccgcacccggtacgagtggacggtcttcagctacgccctgtggacggtgggcgccgaggtggtgccgatctacccgacctcctcgcgcgaccaggtcgagtggatcctgcgggacgcgggctgcgtgggcgtgctggtcgaggacgagcagaacgtgatgaccgtcggctcggtgtgcgcgtcgctgcccgcgctgcgccacgtctggcagctggacgcgggcgcgctggacacgctggtggcgcgcggcgcgttcctcccgtccgccacggtcgactccatgcgccgcatcgtgctgccggacgccacggccgtggtggcctacacctcgggcacctccggccgcgcgctgggctgtgcgctgagccaccgcggcctggccgccccgtgcgacacgctgctcgccggctggggtcacacggtggcgccgccgggagagcagggcgcggtcctcgcctacctgcccttctcgcacgtgtacgggctgatgatccagaacctctgcgtccgcggcgggttcctgatggcccacgagccggcgctgaccggggaggcgctctcctcggccctgcgctccttccggccgacgtatctgtacgccgtcccgtcggtcctggagaagatctacaagaacttcctgcgcaccgcccagcaggcgggacacggtgccctgttcgagcgggccgcggccacggcgcgcgacttcgccacggcgctggagcggcggcgcctgggccggggaaccgggcccggactcgacctgcgcctccagcacgccctgtacgagcggacggtgtaccggcggctgcgctccgcgctgggcggccgggtgacccgggccacgtcgggcggttcgccgctcagccgcgagctctccctcttctacgagggcatcggtgtctacgtccacgacggctacgggctgacggagaccagcggcgggctgacgatgcagccactgggccgggagaagtcgggcaccgtcgggcagccgctgcccggcatggaggtccgggtggccgacgacggggagatcctggtacgcgggccgtcgctgttccaggggtacgtcggcgacgggaccgccacccgcgaggtgctgcgcggcggctggctggccaccggcgacctcgggcacctggacgccgagaactacctggcgatcaccggccgcaagaaggacgtgatcatcaccagcggcggcaagagcgtggccccggccgccctggagcagcggctgcggatgcacccgctggtccaccaggcggtgctggtcggcgacaaccggccctgcgtcggtgcgctgatcacgctcgacccggagttcctgacgcactggcgggcgtccctggccctgcccggcgacgctccggcccgggaggcacgggaggagaacgcgctgcgggaggaggtcgcacgggccgtggccgcggccaacagcgcggtgtcgcgctcggagtccatccgggtcttccgggtccttccgcaccccttcgacgtggcgggcgggctgctcaccccgtcgatgaagctccggcgggacgagatcgtacggacctactccctggagatcgacgccatgtacgaggcgcggtcccaccgccggccgacgacaccgccgccccaggagccggccggctgggaggacgccgacaacgtgttcctccgctga

SEQ ID NO: 14303 - protein, 636 aa, Streptomyces coelicolor
MHDPALAPRTVPPLTGSLADSLFETAARTPTLPMLARRRGPGSTAWDEVTAVEFRDTVVDLAKGLIASGISPGDRVAILARTRYEWTVFSYALWTVGAEVVPIYPTSSRDQVEWILRDAGCVGVLVEDEQNVMTVGSVCASLPALRHVWQLDAGALDTLVARGAFLPSATVDSMRRIVLPDATAVVAYTSGTSGRALGCALSHRGLAAPCDTLLAGWGHTVAPPGEQGAVLAYLPFSHVYGLMIQNLCVRGGFLMAHEPALTGEALSSALRSFRPTYLYAVPSVLEKIYKNFLRTAQQAGHGALFERAAATARDFATALERRRLGRGTGPGLDLRLQHALYERTVYRRLRSALGGRVTRATSGGSPLSRELSLFYEGIGVYVHDGYGLTETSGGLTMQPLGREKSGTVGQPLPGMEVRVADDGEILVRGPSLFQGYVGDGTATREVLRGGWLATGDLGHLDAENYLAITGRKKDVIITSGGKSVAPAALEQRLRMHPLVHQAVLVGDNRPCVGALITLDPEFLTHWRASLALPGDAPAREAREENALREEVARAVAAANSAVSRSESIRVFRVLPHPFDVAGGLLTPSMKLRRDEIVRTYSLEIDAMYEARSHRRPTTPPPQEPAGWEDADNVFLR

SEQ ID NO: 14304 - DNA, 1929 bp, Streptomyces coelicolor
  CDS (1)..(1929)
atgtccaccccgcttccgtccttcgccgcatccgccgcctacgccgactcgcccggccccaccctggtggcgcccgagacgcggatgctggacggggccgtacgggaggcgtacgtaccgccgttcgcgccgccggtgcgccgcgggtccctcgccgacctgcccttcgacaacgcggcggcggtcccgggccaggtcgtcctcagccgcaggtcgccggagggcgactggtccgacgtgacggccgccgagttcgccgggcaggtgctggccgtggccaagggcatgatcgccgaggggctggtgccgggcgaccgcatcgcgatcatggcccggacgacgtacgagtggacgctgctggacttcgccgcatgggcggcgggactggtcaccgtcccgatctaccccacctcctcgctcttccagacccgctggatcctccaggactccggcgccgtcaccctggtcaccgagaccaccgcgcaggccgcggcgctcggccccgagctggaccgcatccccgacctggggcacctgtgggtcatggagaagggccacgtggagcggctcgcggagctgggcgcgcgggtgccggacgcggaggtggaggtgcgccgcggcatgctcggcccgggcacactggccaccctcatctacacctccggcaccaccggccgccccaagggctgcgtgctcacccacggcaacttcttcgccgaggtcgacaacgccatcgagctgctctaccccgtcttcaaggcggagaccggcgaggagccctcgatcctgctcttcctgccgatgtcccacgtcttcggccgcatggtcgccgtcgcctgcgtccgtgcccgggtccgcctcggccacgcgcccagcctgaaacccgaggacctgctccccgacctggcggccttccgcccgacctgcctgctgaccatcccgtacatgctggagaaggtcttcaacagcgcccgcgccaaggccgagtccggcggccgggccgccgtcttcgaccgggccgtctcggtggcggtgcgctacggcgaggccaaggaggcccgccagaccggcaccggtggcggccccggccgcggcctgaagaccgcccgctccttctacgacccgctcgtctaccggaagatccgcaacgccatgggcggccgggtcaagtacgccatctgcggcggctccccgctcggccgccgcctggccgccttctacgccggtgccggcatcgagatcttcgagggctacggcctcaccgagacgaccgccgcggccaccgtcacgcccccgctcaagccgcgcctcggcacggtcggctggccgctgcccggcacccgcatccgcatcgccgccgacggcgagatcctcgtcgccggggagcaggtcctgcacggctactgggacccgcaggccgggggcgtcgtccaggccgcacccgacggctggttcgccaccggtgacatcggcagcctggacgacgagggctatctgacgatcaccggccgcaagaaggagctgctgatcaccgcgggcggcaagagcgtcgccccggccccgctggagaactggctgcgctcccaccccctgatctcccagtgcatcgtgctgggcgaccgccggccctacgtctccgccctgttcaccctcgacccggacggcgtcacccactggcgccggatgaacggcaagcacccggtgccgccggagctgctggtggacgacgaggaggtccgcgcggtgctccagcgcgccgtcgacgaggccaacagactggtctcccgcccggagtccatccgccgcttcgccgtcctgccccgggacttcaccgagtgggagggccacctgaccccctccatgaagctccgccgcgaggtgatcatgcgggacttcgcgggggcggtggaggggctgtacgaggggtag

SEQ ID NO: 14305 - protein, 642 aa, Streptomyces coelicolor
MSTPLPSFAASAAYADSPGPTLVAPETRMLDGAVREAYVPPFAPPVRRGSLADLPFDNAAAVPGQVVLSRRSPEGDWSDVTAAEFAGQVLAVAKGMIAEGLVPGDRIAIMARTTYEWTLLDFAAWAAGLVTVPIYPTSSLFQTRWILQDSGAVTLVTETTAQAAALGPELDRIPDLGHLWVMEKGHVERLAELGARVPDAEVEVRRGMLGPGTLATLIYTSGTTGRPKGCVLTHGNFFAEVDNAIELLYPVFKAETGEEPSILLFLPMSHVFGRMVAVACVRARVRLGHAPSLKPEDLLPDLAAFRPTCLLTIPYMLEKVFNSARAKAESGGRAAVFDRAVSVAVRYGEAKEARQTGTGGGPGRGLKTARSFYDPLVYRKIRNAMGGRVKYAICGGSPLGRRLAAFYAGAGIEIFEGYGLTETTAAATVTPPLKPRLGTVGWPLPGTRIRIAADGEILVAGEQVLHGYWDPQAGGVVQAAPDGWFATGDIGSLDDEGYLTITGRKKELLITAGGKSVAPAPLENWLRSHPLISQCIVLGDRRPYVSALFTLDPDGVTHWRRMNGKHPVPPELLVDDEEVRAVLQRAVDEANRLVSRPESIRRFAVLPRDFTEWEGHLTPSMKLRREVIMRDFAGAVEGLYEG

SEQ ID NO: 14306 - DNA, 2051 bp, Rubus idaeus
  CDS (93)..(1727)
tctgtgcacactgcaagaaagttcaaaccaacccaatccccaccttctccaaacgctattcccattttccgtccgactaaacaaacagagcaatggagaacaaacatcaagacgaccatgaattcattttccggtcaaagctgccggacatctacatcccgaaccacctccctctccacacctactgcttcgaaaacatctcccaatttcacgaccgcccctgcctgatcaacggaaacaccggcgagaccttcacctacgccgaggtcgagctcacctcccgcagagtcgccgccgggctcgacaagctaggcattcagcagaacgacgtcgtcatgctcctcctccagaactgtcccgaattcgccttcgcattcctcggcgcctcgtacatcggagccatgagcacaacagccaaccctttctacactccggccgaggtggccaagcaagccaaagcctccaacgccaagctcatcataactcagtcggcctacgtggacaaggttaaggacttcgcgaagctcaacgacgtgaaagtcatgtgcgtggacgaaacatcgtctgaggatgtcttgcatttttcggagttgatgtccgctgacgagagcgaaaccccggccgtcaaaatcaacccggacgacgtcgtcgcgctcccgtattcttcgggcaccacggggctgccgaaaggcgttatgctgacgcacaaggggctggtgacaagcgtggcgcagcaggtcgacggtgaaaacccaaatctgtactttcacaaggaggacgtgatcctctgcgtgctgcctctgttccacatctactccctcaactcggtcttcctctgcggactgcgcgtcggtgcggccatcctgatcatgcagaagttcgagatcaacaagttgctggagttggtggagaaagaaaaggtgacgattgcaccgtttgtgcctcccatcgttttgtctattgccaagtgtcccgacctgcaccgatacgacttgtcgtccattcggatggtcatgtccggcgctgctccgatggggaaggagctcgaggacactgtcagagctaaactgcctaatgccaaactcggacagggttatgggatgactgaggctggaccagttctatccatgtgtctggcatttgcaaaagagccatacgagataaaatcaggtgcatgcgggaccgtggtaagaaatgctgagatgaagatcatcgaccctgacaccaatgaatcccttccccgaaaccaatcaggggagatttgcatcagaggtagccaaatcatgaaaggttaccttaatgaccctgaggcgactgagaataccatagacaaagaaggatggttgcacactggtgatatagggtacattgacgacgacgatgagctcttcatcgttgacagattaaaagaactcatcaagtacaaaggtttccaagtcgccccggctgagctcgaagccatgttgatctcgcatcccaatctctccgatgctgccgttgtatcgatgaaggatgaggctgcaggagaggttcctgttgcatttgttgtaagatcaaacggttccaagatttctgaggatgatatcaagcaatacatctctaaacaggtggtgttctacaagagaataagtaaggttttcttcacagataaaatcccgaaagctccttctggaaaaatattgagaaaagacttgagagcaaggctggctgcaggtctacccaattagacttccagcaagtgaaaaattattacagacgcagtaagatcagacaatcagtgtgatgaagatcaaacgcctatatatcaatgttatcggctactttcccaaatcgataagggaaaatcaggattggaaggcaaaactagtagtcataattgtttctataatggccggggtgatttttcaagcgtttgtatgtacctaagttcttcctctctgggaccaatgaaggacccaacaaagaaagagagaggaagaagatgtaggctttatacaaagttcttttatgtatagggtgttggatcaataaatggactgagatatgtttgc

SEQ ID NO: 14307 - protein, 544 aa, Rubus idaeus
MENKHQDDHEFIFRSKLPDIYIPNHLPLHTYCFENISQFHDRPCLINGNTGETFTYAEVELTSRRVAAGLDKLGIQQNDVVMLLLQNCPEFAFAFLGASYIGAMSTTANPFYTPAEVAKQAKASNAKLIITQSAYVDKVKDFAKLNDVKVMCVDETSSEDVLHFSELMSADESETPAVKINPDDVVALPYSSGTTGLPKGVMLTHKGLVTSVAQQVDGENPNLYFHKEDVILCVLPLFHIYSLNSVFLCGLRVGAAILIMQKFEINKLLELVEKEKVTIAPFVPPIVLSIAKCPDLHRYDLSSIRMVMSGAAPMGKELEDTVRAKLPNAKLGQGYGMTEAGPVLSMCLAFAKEPYEIKSGACGTVVRNAEMKIIDPDTNESLPRNQSGEICIRGSQIMKGYLNDPEATENTIDKEGWLHTGDIGYIDDDDELFIVDRLKELIKYKGFQVAPAELEAMLISHPNLSDAAVVSMKDEAAGEVPVAFVVRSNGSKISEDDIKQYISKQVVFYKRISKVFFTDKIPKAPSGKILRKDLRARLAAGLPN

SEQ ID NO: 14308 - DNA, 2160 bp, Caenorhabditis elegans
  CDS (1)..(2160)
atggttatcacagacacggctgcgtgggtacagtctcaatcgagaagtattgtcgatttcatttcggcaccaaactcgaactcttcccttccaccgtacgttcaaatcggagccgccgccgcagtcaccatgggcctcggatactacttgtcgaagagctcgtcatcgacgtcgggatcctactcgttcagtggggtcacctattcgggaaatgtcaagccactggtggatccgatgaatcagagtcgcattttgccggatggttcccgcatcagcgcctacctgaaggacgacgaactccaggctttcctgttcgaagacgcgcgcaccctctaccagggtgttcgccgtggagcccgtctctcgaacaacgggccgatgctcggacgtcgagtcaaacagtcggatggttcaatcccgtacgtgtgggagtcgtacaatacgattctcgagcgagccgacaacgtgtccgtcgcgttccgtgagctcggcgttccgactggcaacgcggagaacattgggatctactcgaagaatcgcgccgaatggatcatcaccgaattcgccacctacaactattcgaatgtgattgtgccgatctacgagacccttggatcagaagcgtcgatattcattttgaatcaggcagagatcaagattgttgtctgtgatgatatttcaaaggccactggtctcttaaagttcaaggagcaatgcccaagtttgagcacacttgttgtgatggaaccagtcaccgatgagctcaaaacgactgcgtcatcgctcggagtcgaggtgctcacgttcgaggatctcgagaagattggaaagaacgccaagactcgtccagcacacattccaccaacaccagaggatcttgcgaccatatgctacacgtcaggaacgactggaacaccgaaaggtgtgatgctcactcacgcgaacgtgatcgccgacggtgtctgtatggacttcttcaagcacagtggcatcgcggcgaccgattcgatgatcagcttccttccgttggctcacatgctcgagagagtcatcgagagtgtgtgcttctgtgtcggcgcgaaagtcggattctatcgtggtgacatacgtgtgttggccgaggatatcaaagagttgaagccgactgtggtgccagtggtgccacgtgtcttgaatcggctttacgataaagtgatgtctgaagtgaacaagtcgactttgaagaagatgttgtttgatttcgctatctcatacaaggccagagatatggcaaacttcaatatcagaaatgacggattcttcgacaatttggtattcaaaaagattcgcgaaggattcggagggcgtgtgcgtctgatgatcaccggatcggctccactttcgacgaatgtgctcaccttcgttcgtgccgctatgggatgtgtcgtcgtcgagggttacggtcaaacggaatgtgtcgccgcttgcactgtctcgatggaaggagattcgctagccggacacgtcggaatggtgatcccatcgtgtcagatcaagttggtcgacgtgcccgagttgaactattacgcgaaggatcaagccggcgaggtgtgtgtcaagggacacatcatcttcaagggatactataagaatgagcaacaaacgaaggagacgatcgatgaggatggatggttgcacactggagacattggacgatggactcctgagggaacgctgaaaattgtggatcgcaagaagcacattttcaagctctcgcagggagaatacgtggcaccggagaagattgagaacatctatgtccgctcgaaatatgtcgctcaatcatttgttcatggagaatcactgaagacgtgtctcattgctattgttgtacctgatgctgaggttctcgtcccagcgatggccgaccaaggaatcaagggaacattcgaagagctgtgcaacaacgacgccgtcaaaaaggcgatcctcgatgacatggtcgctgttggcaagaaagccgggctcttctcgttcgagcaagtgcgcgatatcagtctctccgccgagcaattcagcgtcgagaatgatcttctcacgccaacgttgaagagcaagcgtccgaagctgaaggctcactactcgaagcaactcgatgcgatgtattcgaaacttccatag

SEQ ID NO: 14309 - protein, 719 aa, Caenorhabditis elegans
MVITDTAAWVQSQSRSIVDFISAPNSNSSLPPYVQIGAAAAVTMGLGYYLSKSSSSTSGSYSFSGVTYSGNVKPLVDPMNQSRILPDGSRISAYLKDDELQAFLFEDARTLYQGVRRGARLSNNGPMLGRRVKQSDGSIPYVWESYNTILERADNVSVAFRELGVPTGNAENIGIYSKNRAEWIITEFATYNYSNVIVPIYETLGSEASIFILNQAEIKIVVCDDISKATGLLKFKEQCPSLSTLVVMEPVTDELKTTASSLGVEVLTFEDLEKIGKNAKTRPAHIPPTPEDLATICYTSGTTGTPKGVMLTHANVIADGVCMDFFKHSGIAATDSMISFLPLAHMLERVIESVCFCVGAKVGFYRGDIRVLAEDIKELKPTVVPVVPRVLNRLYDKVMSEVNKSTLKKMLFDFAISYKARDMANFNIRNDGFFDNLVFKKIREGFGGRVRLMITGSAPLSTNVLTFVRAAMGCVVVEGYGQTECVAACTVSMEGDSLAGHVGMVIPSCQIKLVDVPELNYYAKDQAGEVCVKGHIIFKGYYKNEQQTKETIDEDGWLHTGDIGRWTPEGTLKIVDRKKHIFKLSQGEYVAPEKIENIYVRSKYVAQSFVHGESLKTCLIAIVVPDAEVLVPAMADQGIKGTFEELCNNDAVKKAILDDMVAVGKKAGLFSFEQVRDISLSAEQFSVENDLLTPTLKSKRPKLKAHYSKQLDAMYSKLP

SEQ ID NO: 14310 - DNA, 2115 bp, Leishmania major
  CDS (1)..(2115)
atgggaggcgctgtgtcattctgcctccagaagctcaacaaggtgagcgaggtggagtacaggccctacaaggagtatgccagctatggcgagcagagtgtcccggtgaaaggcagcgatgattctggccgctccatgatctaccgtatgtcgaacacaagcgaagaggagttgaaacgcctgcgcgacgagtggtacgcgggtggctcttgcctctccgttctcgaaagactctgcaaggagcgcggcaagcgcacatgcctggcctaccggaagctgaagaccatcgagaagaacgagaccaccaccagtgacggccgcaagaaagtgctggagacgtacgtctttgagccggagcggaggacgatgagctacaccctcttctggcagaatatcgtcgacttcggccgcggtctccacgagatcggcctcacgaagggcaacaccgtctccatctacgaggagacccgctggcagtggctgtgcaccatgtacagctgctggtcgcagggcctcctcgtgtccactgtgtacgccaacctcggtgaagacgctctccagtacgccttggacgaagctcagtgcaacgcgattgtgtgcaacggctccaaggtgaaggacgtgctcgcgatgttcaaggtgatcgaggcgcccaagggcaccaaagtcatctacctcgatgagttgccgccctcggtgacgtccgaggagtacgatctgtacgcgtggagcgacgtggtggcgcgcggcaagaagagcgaggccagctgccgcatcccgagtggcgccgagagcaaggatgagctcgcgctcatcatgtacacgagcggcaccaccggcaacccgaagggcgtcatgcacacgcacggcagcctctactgcggctgcatgacgatcagtcagcggatcaacgacctgctagggaagatgaaggagcaggagtggtactgctcgtacctccccctcgcccacatcatggaactcgccgtcacatcggtgctcatgatgcgcggcgtcatcatcggctacggcagcccgcgcacattgttggacaccttcgccaagccgtgcggcgacctgaccacgtaccggccgctcgtctttgtcgctgtcccacgtgtatttgatagcatgaagagggccgtagaggagaagctgccgcctccggggtcgctcaagcgcaagatcttcgacaaggcctatgaggcgcgcctcaaggcgctcaagaagggctgcgacacgccgttctttaacaagagggttttcgccaatgcccgtaaggtgatgggcggccgcgtgtacgcgatgctcagcggcggcggcccgctctcggagtccacgcaggagttcattaacgttgtctttggcatggtgatccagggttggggcatgacagagagtgttgcctgcggcggcatccagcgcacgggcaaccttgaatacaactgcgttggccaggtcctcaagacagcggaggtgcagctgttggacacggatgagttcaagcacacggatcagccagagccgcgcggtgaggtgctgctgcgcggccccttcctcttcaagggctactacaagcaaccggagcagaccagggaggcactggacaatgatggatggctccacaccggcgacgtggcctccgtaactccgagcggcaccatgcgcatcgttggccgcgtcaaggcgctcgccaagaatgccaacggggagtatttggcgcttgagatgctggagagcatctacggcactaacgagatcaccgtcccaaacggtgtctgcgtgcttgtccacccgcaccgcacctacatcgccatcattgccgtgaccaatgagaagctggtgaaggcgttcatgaaaaagcataaaatcgaaaacggtgggtttcctgcaatcctggacgacgcggagttcttgagagtggtgcttcaaagcctccagaagactgcccgtgacgcgaaccgctgctcgttcgaagttgtgcagggcgtgaagctgctgaacgaggagtggacaccagagaatggcgtgctgacggccgccatgaagctcaagcgccgcgtcatcagcgaaaactatgcggatttcatcaacaagctcttcgagaaacaatag

SEQ ID NO: 14311 - protein, 704 aa, Leishmania major
MGGAVSFCLQKLNKVSEVEYRPYKEYASYGEQSVPVKGSDDSGRSMIYRMSNTSEEELKRLRDEWYAGGSCLSVLERLCKERGKRTCLAYRKLKTIEKNETTTSDGRKKVLETYVFEPERRTMSYTLFWQNIVDFGRGLHEIGLTKGNTVSIYEETRWQWLCTMYSCWSQGLLVSTVYANLGEDALQYALDEAQCNAIVCNGSKVKDVLAMFKVIEAPKGTKVIYLDELPPSVTSEEYDLYAWSDVVARGKKSEASCRIPSGAESKDELALIMYTSGTTGNPKGVMHTHGSLYCGCMTISQRINDLLGKMKEQEWYCSYLPLAHIMELAVTSVLMMRGVIIGYGSPRTLLDTFAKPCGDLTTYRPLVFVAVPRVFDSMKRAVEEKLPPPGSLKRKIFDKAYEARLKALKKGCDTPFFNKRVFANARKVMGGRVYAMLSGGGPLSESTQEFINVVFGMVIQGWGMTESVACGGIQRTGNLEYNCVGQVLKTAEVQLLDTDEFKHTDQPEPRGEVLLRGPFLFKGYYKQPEQTREALDNDGWLHTGDVASVTPSGTMRIVGRVKALAKNANGEYLALEMLESIYGTNEITVPNGVCVLVHPHRTYIAIIAVTNEKLVKAFMKKHKIENGGFPAILDDAEFLRVVLQSLQKTARDANRCSFEVVQGVKLLNEEWTPENGVLTAAMKLKRRVISENYADFINKLFEKQ

SEQ ID NO: 14312 - DNA, 2070 bp, Schizosaccharomyces pombe
  CDS (1)..(2070)
atggatattaaggactattactgcgtcgaaacaaaggattctaagcaacccggcgaatcctacatatatcgctctatccactcggcgggaaagcttttagatactccagaagacggtgtcagcaccgtttatgacttactgtgtactgcggctaaaaaccatggcgagaaacaagctatgggcagtcgtaaactcatcaaagagaacagagaggagcgagaaattattaggaaagttgacaacgaagaggttgttgagaaaaagttgtggactacctacgagctgggtccttacgaatatatttcttttaataaggtctatgagattgctcttgcacttggttctggtcttgtagcctcgggaataacttcagagactacaatgctattttttgctgccaccagtgccaaatggttcacgactgctcaaggttgcagttcacaagccattcctattgtaactgcttatgaaacccttggtgaagatggtatatacacgtccctcgacgagtgtaagtctagggctattttcaccgatcccaacttaattcccaaattacttggtcccttgaaacaatcaacttgggtaaagcttattgtttgcagctctactcctagtgaagatttagttgaattggttaagtctaccgctcctgatgttgaaatcatcacttatgataatttactttctttaggtaaagaaaaaccccaacctcctcatcctcctaaagccgatgacatttgctgttatatgtatacatctggctcaaccggtaaacccaaaggtgttgttttgttacatcgcaacatcattgccgcattgggcggtatcaatcgcattttgagccaacatattaatgtcaaagattatgtccttgcttatcttcctttagcccatatttttgagtttatttttgagatgtgctgcctttactggggcggagttttgggttatgcgtctcctcgcaccttgacggatgctagtgttgttaattgcaaaggtgaccttactgaatttaggcctactgttttaattggcgttcccgccgtgtatgaacttatcaagaagggaattttagctaaagtctcttccatgcctgcacatagacaaaaggtattttctggttcccttagcttgaagcaatatttaatcgaaagaaatcttcctggttcagccgctcttgatgccattgtcttcaacaaggtcaaggcagctactggaggtagacttcgatactgcatttctggtggtgctgcattagcagctagtacacaagcttttttaagttcctgcatttgccctgtgcttcctggttacggacttactgaaacttgtgctggaagttttgtactttctccagaacagtggcatttatatgctaatacagttggtttccctattccttctatcgaatttaaactagtagacattccagatttaggatactataccgattcctccccacctcgtggtgaagtttggattcgtggacctgctgtttgcaatggatatctcaatcgtcctgaagataacaaggccgcatttactgaagatggatggttcaagactggtgacgttggtgaaattgcaaaaggcaatactctgcgtttgatcgatcggaaaaagaatattgtgaaatctctcaatggtgaatatattgcacttgagaaaatcgaagcacaattttttacaagtcctttagtttcaaatgtttgtgcttatgcagatgtcaatcatgctaagccagtcgttattgtcaaccccgatgaaaatggtttacgcacctacctgactaaaaacagtggttcttcatttaacggcaatcctaatgatacactgactaatctctgtaaggacagtggtgttcaacatcttatccttaaggaattgattaacattggaaagcaacaacgtcttgcttcaattgaaattcctgaaggcgttgttctcagtgactttgaatggactgcggaaaataatttcttgactgcatctcgtaaagtgaaacgtcaagttattgtagcacactactcagacgaaattcagaaggcttatagtaaaaaacattga

SEQ ID NO: 14313 - protein, 689 aa, Schizosaccharomyces pombe
MDIKDYYCVETKDSKQPGESYIYRSIHSAGKLLDTPEDGVSTVYDLLCTAAKNHGEKQAMGSRKLIKENREEREIIRKVDNEEVVEKKLWTTYELGPYEYISFNKVYEIALALGSGLVASGITSETTMLFFAATSAKWFTTAQGCSSQAIPIVTAYETLGEDGIYTSLDECKSRAIFTDPNLIPKLLGPLKQSTWVKLIVCSSTPSEDLVELVKSTAPDVEIITYDNLLSLGKEKPQPPHPPKADDICCYMYTSGSTGKPKGVVLLHRNIIAALGGINRILSQHINVKDYVLAYLPLAHIFEFIFEMCCLYWGGVLGYASPRTLTDASVVNCKGDLTEFRPTVLIGVPAVYELIKKGILAKVSSMPAHRQKVFSGSLSLKQYLIERNLPGSAALDAIVFNKVKAATGGRLRYCISGGAALAASTQAFLSSCICPVLPGYGLTETCAGSFVLSPEQWHLYANTVGFPIPSIEFKLVDIPDLGYYTDSSPPRGEVWIRGPAVCNGYLNRPEDNKAAFTEDGWFKTGDVGEIAKGNTLRLIDRKKNIVKSLNGEYIALEKIEAQFFTSPLVSNVCAYADVNHAKPVVIVNPDENGLRTYLTKNSGSSFNGNPNDTLTNLCKDSGVQHLILKELINIGKQQRLASIEIPEGVVLSDFEWTAENNFLTASRKVKRQVIVAHYSDEIQKAYSKKH

SEQ ID NO: 14314 - DNA, 1920 bp, Pseudomonas putida
  CDS (193)..(1890)
tgacctgtattgttcattgagtcatttttgtgactgcaaggcctgttttggcctctaggggaccccaggcaaagctgttactctcggcccgctttcagacgatccggtttgcaacgaaccgccgtctcatatcaataataagcgcatcgacgcgccaatcgaacttcgctgttgctgaaggagtgggcttccatgatcgaaaatttttggaaggataagtacccagccgggattacggcggaaatcaatcctgacgaattccccaatatccaggcagtactcaagcaatcctgccaacgctttgccgacaaaccggcctttagcaacctgggcaagactatcacttatggcgagctgtatgcgctgtcgggggcgtttgccgcctggctgcagcagcataccgacctcaagcccggtgaccgcattgccgtgcaactgcccaacgtcatgcaatacccggtcgcggtcttcggtgccatgcgtgccgggttgatcgtggtcaacaccaacccgctgtataccgcgcgggagatggaacaccagttcaacgactccggcgccaaggccttggtgtgcctggcgaacatggctcacctggccgagaaggtggtacccaagactcaggtcaggcacgtcatcgtcaccgaagtggccgacctgctgccgccgctcaaacgcctgctgatcaatagcgtgatcaagtacgtgaagaagatggtgccggcctacagcctgccgcaggccgtgcgcttcaacgacgccctggccctgggcaagggccagccggtgaccgaggccaacccgcaggccaacgacgtggccgtgctgcagtacactggtggcaccaccggcgtggccaagggcgccatgctgacccaccgcaacctggtggccaacatgctgcagtgccgtgcactgatgggctcgaacctgcatgaaggctgtgaaatcctcatcaccccgctgccgctgtaccacatctacgccttcaccttccattgcatggccatgatgctgatcggcaaccacaacgtgcttatcagcaacccgcgtgacctgccggccatggtcaaggaactgggcaagtggaagttcagcggctttgtcggcctcaacaccctgttcgttgccctgtgcaacaacgaggcgttccgtgcgctggacttctcgtcgttgaaaatcaccctgtcgggcggcatggccctgcaattgagcgtggccgagcgctggaaggccgttaccggctgcgccatatgcgaagggtacggtatgaccgaaaccagcccggtggcagcggtgaacccggcagaagcgaaccaggtgggtaccattggcattccggtgccatcgaccttgtgcaagatcatcgacgacgccggcaacgagctaccgctgggcgaggtgggcgagttgtgcgtcaagggcccgcaggtgatgaagggctactggcagcgcgaagacgccaccgccgagatcctcgacagcgaaggctggttgaagaccggcgatatcgccctgatccaggccgacggttacatgcgcatcgtagaccgcaagaaggacatgatcctggtctcgggcttcaacgtgtaccccaatgagctggaagacgtgttggcggccttgccgggtgtgctgcagtgcgcagccattggtgtgcccgacgagaagtcgggtgaagtgatcaaggtgttcatcgtggtcaagccgggcatgaccgtgaccaaggagcaggtgatggagcatatgcgtgccaacgttaccggctacaaggtaccgcgcctgatcgagttccgcgattcgctgccgaccaccaacgtgggcaagatcctgcgccgcgagctgcgcgatgaagagctcaagaagcaaggcttgaagaagatcgcctgacgccccgccagcgcggtccctgtaggagca

SEQ ID NO: 14315 - protein, 565 aa, Pseudomonas putida
MIENFWKDKYPAGITAEINPDEFPNIQAVLKQSCQRFADKPAFSNLGKTITYGELYALSGAFAAWLQQHTDLKPGDRIAVQLPNVMQYPVAVFGAMRAGLIVVNTNPLYTAREMEHQFNDSGAKALVCLANMAHLAEKVVPKTQVRHVIVTEVADLLPPLKRLLINSVIKYVKKMVPAYSLPQAVRFNDALALGKGQPVTEANPQANDVAVLQYTGGTTGVAKGAMLTHRNLVANMLQCRALMGSNLHEGCEILITPLPLYHIYAFTFHCMAMMLIGNHNVLISNPRDLPAMVKELGKWKFSGFVGLNTLFVALCNNEAFRALDFSSLKITLSGGMALQLSVAERWKAVTGCAICEGYGMTETSPVAAVNPAEANQVGTIGIPVPSTLCKIIDDAGNELPLGEVGELCVKGPQVMKGYWQREDATAEILDSEGWLKTGDIALIQADGYMRIVDRKKDMILVSGFNVYPNELEDVLAALPGVLQCAAIGVPDEKSGEVIKVFIVVKPGMTVTKEQVMEHMRANVTGYKVPRLIEFRDSLPTTNVGKILRRELRDEELKKQGLKKIA

SEQ ID NO: 14316 - DNA, 1944 bp, Streptomyces coelicolor
  CDS (1)..(1944)
atgaaccagccacacctgagccagccgcaacgagccagccgcaccgtcgcgggcccggaggatgtcgtgagcgacacacagacactgatcgagaaccgtccgccctccgtggcgggactcttcctggagcgggtggccgccacgccggacgccgaggcgtaccgctacccggtgccgccggccgcgggcgagggccccgacgactggaagtcgctgacctgggcgcaggccgccgagcgggtctacgcgatcgcggccggcctggtcgagctgggcgtgcagccggagcagcgggtggcgctggcctcctccacccgcttggagtggatcctcgccgacctcggcatcatgtgcgcgggcgcggcgacgaccaccgtctacccgcagaccaacgccggcgaatcggcgtacatcctctccgactccgagagccgggtgctgatcgcggaggacgccgcgcagctcgccaaggcgaaggagaagaaggcggagctgcccgacctcacccacgtggtcgtggtcgacgcgaccggcgcggacacctccgaggactgggtcctcaccctcgacgagctggagcgccggggcgcggcccgcctggagaaggacccgcagctcatcaaggagcgggtcggcgcgctcaccaaggaccagctcgccaccctcatctacacctccggcaccaccggccggcccaagggcgtccggctcccgcacgactgctggtcgtacatggccaaggcgatcgccgcgaccggcctggtcaccaaggacgacgtgcagtacctgtggctgccgctcgcccacgtcttcggcaaggtgctgacctccggccagatcgaggccggtcacgtcaccgccgtcgacggccgcgtcgacaagatcatcgagaacctgccggtcgtgcagccgacctacatggcggccgtcccccgcatcttcgagaaggtctacaacggcgtcgccgccaaggcccgcgcgggcggcggggccaagtacaagatcttccagtgggccgccgggatcgcccgcgagtacgccaaggtcacccaggacaacttcaagcgcaccggcaccgcgagcgcccccgccggcctgcgcaccaagcacgccgtcgccgaccggctcgtctacgccaagatccgcgaggccttcggcggccgcctgcgcgcctgcgtctcggggtcggccgccctcgcgcccgagatcggctacttcttcgccggtgccggcatccacatcctggagggctacggcctcaccgagtcctccgccgcctccttcgtcaaccccggcgaggcctaccgcaccggcaccgtcggcaagccgctgcccggcaccgaggtgcgcatcgcggacgacggcgagatcctgctgcgcggccccggcatcatggagggctaccacaagctgcccgagaagacggccgaggtcctggaggccgacggctggttccacaccggcgacatcggcgagctgtcgcccgacggctacctgcgcatcaccgaccgcaagaaggacctcatcaagacgtccggcggcaagtacatcgcgccggccgaggtcgagggccagttcaaggcggtctgcccctacgtctccaacatcctggtgcacggcgccgaccggaacttctgcaccgcgctcatcgccctcgacgagatcgcgatcacggagtgggccagggagaacggcctggcgggcaagccgtacgccgagatcgtcgcggcgcccgcgaccgtcgagatggtggacggctacgtcaggcagctcaacgagggtctccagcgctggcagaccatcaagaagttccgcctgctgccccgcgacctcgacgtcgagcacggcgagatcaccccgagcctgaagctgaagcggccggtggtggagcgggagtacaagaacctgatcgaggagatgtacgagggctcgcgcgaggcgtag

SEQ ID NO: 14317 - protein, 647 aa, Streptomyces coelicolor
MNQPHLSQPQRASRTVAGPEDVVSDTQTLIENRPPSVAGLFLERVAATPDAEAYRYPVPPAAGEGPDDWKSLTWAQAAERVYAIAAGLVELGVQPEQRVALASSTRLEWILADLGIMCAGAATTTVYPQTNAGESAYILSDSESRVLIAEDAAQLAKAKEKKAELPDLTHVVVVDATGADTSEDWVLTLDELERRGAARLEKDPQLIKERVGALTKDQLATLIYTSGTTGRPKGVRLPHDCWSYMAKAIAATGLVTKDDVQYLWLPLAHVFGKVLTSGQIEAGHVTAVDGRVDKIIENLPVVQPTYMAAVPRIFEKVYNGVAAKARAGGGAKYKIFQWAAGIAREYAKVTQDNFKRTGTASAPAGLRTKHAVADRLVYAKIREAFGGRLRACVSGSAALAPEIGYFFAGAGIHILEGYGLTESSAASFVNPGEAYRTGTVGKPLPGTEVRIADDGEILLRGPGIMEGYHKLPEKTAEVLEADGWFHTGDIGELSPDGYLRITDRKKDLIKTSGGKYIAPAEVEGQFKAVCPYVSNILVHGADRNFCTALIALDEIAITEWARENGLAGKPYAEIVAAPATVEMVDGYVRQLNEGLQRWQTIKKFRLLPRDLDVEHGEITPSLKLKRPVVEREYKNLIEEMYEGSREA

SEQ ID NO: 14318 - DNA, 2463 bp, Plasmodium falciparum
  CDS (1)..(2463)
atgggtatcattttaaatatatatattctctttatttatctaatttatgtaagatcacattttagccaacctactagtagtgaatatgaagggtactctgaaacatgtgaaaaggcaaggaatgcaaatgaatcgagcgtatactgcatgaaagattataagaggaatagttcaaaatatatgtataaacatattatgagaatgtttattgaaaaacataatttaaatgataataaaatagcattaatagaacatgaatgtggggaacctcaaaattatatgacatatgatacatttttaagaaagatattatcgtttaataattctttgaataaatatgatggaattaacattccagaaaaaatatataacgaagaaatgaataatgggaaatttaaactattaggtttatatggtagtaattctataaattggttagttgctgatttgggtgctatgcttagtggcgttactacattagtgatgcattcgaaatttagtatggatgtaatagtaggtatattaaatgaaacaaaattagaatggttatgtttagatttagatttggtggaaggtttaatggaacgtataaatgaattgccacacttgaagaatcttatcatattagatactgtagctaaacaaggtataataaattcaactattgaaaaaaataaaaacattaatttaaaagggaatggaaatttaaacaataagaataataaaaaaggaaatgatttatcgaaaaatttggaggatgtacgtttgggtcctataaaatatgataaagaaaaattagaaaagtttaaatctttaaaagaaagatatcataaatatttggaaaaatttttattacttgatgatgtgatgaataatgaaaatacgaattttaaaattaaaaatgaggatcctaattttgttacttctattgtgtatacatctggatcatctggaatgccaaagggagctatgttgagcaataaaaatttatataatcagttatattctttatataatcatagtgtaagaaaaacatataatcttcaatatcatttatcttatttaccaatatcacatgtatttgaaagaacaattgcatatagcattatatttcttcgtggaacagtgcatatatggagtaagaatcttaattatttttcgaaagatatacttaattcaaacagtgttataatgacaggagtacctaaggtttttagtagaatttatacgaatattatgacagaaattaataatttgtcaccttttaagagatacattataaaaaaaattatatccctaaaaaaatctaataaaaaaagatggttagttaattttcttgaaaatctgtttcatatatcgagcaaaataaaagagaaagttaacccgaatttagaaattatattaaatggtggtggaaaattatcaccagatgttgccagtgaattatgtaatttactaaatataaaatattgtcaaggttatggtttaaccgaaactggtggtgctatttttggtaaacatgtagaagatttaaattttgaatgtataggagggcctatttgtccaaatacaaaatataaagtaagatcatgggaaacgtataaagctacggatacattaccaaaaggtgaattgttaattaaaagtgactctatatttagaggatactttttagaaaaagaatataccaaaaatgcctttacaaatgatggttattttaaaacaggagatgttgttcaaattaataaaaatggtactttaacatttttagacagatcaaagggtttggttaaattgtctcaaggtgaatacatagaaacagatttattgaataatctctattcgcaaattagttttataaataattgtgttgtatatggtgacgattcaatggatggtccactagccataatttcagtggataaatatttactttttttaagtttaaaagatgataatatgttagaaatgactggagttaatgaacaaaattatttagataaactaactgatgataatataaataataatatttttcttgattatgttaaagaaaaaatgttagaagtttataaggaaacaaatttaaatagatacaatattattaataacatatatttaacttcaaaagtttgggacacaaataattacctaactccaacatttaaggttaaaagattttatgtatttaaagattatgcatttttcattagtcaggttaaagaaatatataataataaattaaaaggatgtgctcctattagtgtgaatagtgaaaacaaggacgaagaaaaaaaaaatgatagcaaaaaaaaggaagaaaaagattcagaaaaattatcaaatgagtctacttcaaatcaaaataaaaacgatatgggaaaacatgaaaaatatgttgaaaataaaaaggtcaaattgggagctacatatggaacacgtcaaaaagaaatgaataaatga

SEQ ID NO: 14319 - protein, 820 aa, Plasmodium falciparum
MGIILNIYILFIYLIYVRSHFSQPTSSEYEGYSETCEKARNANESSVYCMKDYKRNSSKYMYKHIMRMFIEKHNLNDNKIALIEHECGEPQNYMTYDTFLRKILSFNNSLNKYDGINIPEKIYNEEMNNGKFKLLGLYGSNSINWLVADLGAMLSGVTTLVMHSKFSMDVIVGILNETKLEWLCLDLDLVEGLMERINELPHLKNLIILDTVAKQGIINSTIEKNKNINLKGNGNLNNKNNKKGNDLSKNLEDVRLGPIKYDKEKLEKFKSLKERYHKYLEKFLLLDDVMNNENTNFKIKNEDPNFVTSIVYTSGSSGMPKGAMLSNKNLYNQLYSLYNHSVRKTYNLQYHLSYLPISHVFERTIAYSIIFLRGTVHIWSKNLNYFSKDILNSNSVIMTGVPKVFSRIYTNIMTEINNLSPFKRYIIKKIISLKKSNKKRWLVNFLENLFHISSKIKEKVNPNLEIILNGGGKLSPDVASELCNLLNIKYCQGYGLTETGGAIFGKHVEDLNFECIGGPICPNTKYKVRSWETYKATDTLPKGELLIKSDSIFRGYFLEKEYTKNAFTNDGYFKTGDVVQINKNGTLTFLDRSKGLVKLSQGEYIETDLLNNLYSQISFINNCVVYGDDSMDGPLAIISVDKYLLFLSLKDDNMLEMTGVNEQNYLDKLTDDNINNNIFLDYVKEKMLEVYKETNLNRYNIINNIYLTSKVWDTNNYLTPTFKVKRFYVFKDYAFFISQVKEIYNNKLKGCAPISVNSENKDEEKKNDSKKKEEKDSEKLSNESTSNQNKNDMGKHEKYVENKKVKLGATYGTRQKEMNK

SEQ ID NO: 14320 - DNA, 2127 bp, Trypanosoma brucei
  CDS (1)..(2127)
atgaacaccgcttctgcgctgaacgaaatcgaggtggcggtcctccagcttatggatgaggccaacagccgagaatcggcaccaaacgaagacattgtgcagcttcggagcaaaggctcacagaacgaggcgattccacagacagaaacggagaatatgtcggccatctaccgtcgtgccggagtcagtggcgaagagcacacacgactctgtcgagagtggtactacggtgtgaacatgccacagaagttcatggcaatatgcaagaaagggggaagtcgcagggctttcgcgtaccgggttctgtcaaacatatcgaaagaagtgctaagggaccaaaatgggcttgaacgttcatacgatataacatactttaaggaaacgtgttatattaactaccgtgtcctctgggaaaatatcgagtcgtttgggcgaggtcttgtggagttgggtatttcaccaaactcccgagtcgccatatacgaggagacgcggtgggagtggttggcaacaatttacggtatctggtcgcagaatatggttgccaccacagtgtacgccaatcttggggaagatgcgctcgcgtatgccctccgggaaacaggatcccgtgcaattatatgcaacgcaacaaatgtgccaacactggtccggttggtgcagagcaaccgcattccgcccttggtgatcatttacattggtcagctacctccggatacaaaaagcacacattgccgcatcatctcttggcttcatgtcgtggacaatggtcgcctctcagatgaaccacttcgaatccccactgacaatgaccaagttgctttcatcatgtatacgagtggtacgacgggggaccccaaaggtgtcattcacacacatggctcactgatctcgggtgttactgcttgtgccgactacgtgaatgaactgattggtccttacgaagagggtgagtcgtactgcgcttacctgcctcttgcccacatatttgaatttggtgtcgtcaacatctttcttgctcgcggttcttttgttgggtttggaaaccccagaacacttctcgacacgtacactcgtccacacggtgattacagggagtacaaaccggttttcacaattggcgtgccgcgagtgtacgacacgataaagaaaacggtcgagtcacagctggcaccccgagggacactacagcgccgtatattcgaacacgccttccaaacgagacttcgagccctcaagaagggtgaggagaccccgtactggaacaggttaattttttctccatttcggtccatgcttggaggtaagatgaaaacgatgctttccgccggagggcccctcagcgcaccaacgcaaacatttcttcatgttgtatttggcatcatgccacaaggttggggcctcacggagacggtgtgtgttggcacaaagcaagtcgcaggtgatatggaaccggccgctgcaggcaagcaagagcgcacatgtgaaatgcgactactggacgtggaaggatacaagcacaccgatgagcccgatcctcgtggggaaattcttctgcgtggtccattcctcttcaaagggtactacaagcaggaagaactaaccaaggaggtgcttgatgaagatggttggtttcatacgggtgacgttggcagcatcggccccaatggaacccttcgcatcattggccgcgtgaaggccttggcaaagaatgttcttggagagtatgttgccatggaagctttggaatccatgtatgcacacaactcgctgagcatgcccaacggtgtttgtgtcctcgtgcatcctgacagaccgtacatttgtgcgcttgttcttactgatgaagcgaaggttgttgcgttcacgagggagcatggattgaaaggtaaataccctgaagttctgcaggaccccgagtttcagaagaaggctacagcatcatttcaggagacggctcgtgcatctgatcgacagaagtttgagattgtacgtcacgtacgcctactgagtgatgagtggactcctgaaaatggtgtgctgacggccgcaggcaaactgaagcgacgcgtcatcgatgagaagtacactgatactattgtgtcacttttcgtggaggagtgctga

SEQ ID NO: 14321 - protein, 708 aa, Trypanosoma brucei
MNTASALNEIEVAVLQLMDEANSRESAPNEDIVQLRSKGSQNEAIPQTETENMSAIYRRAGVSGEEHTRLCREWYYGVNMPQKFMAICKKGGSRRAFAYRVLSNISKEVLRDQNGLERSYDITYFKETCYINYRVLWENIESFGRGLVELGISPNSRVAIYEETRWEWLATIYGIWSQNMVATTVYANLGEDALAYALRETGSRAIICNATNVPTLVRLVQSNRIPPLVIIYIGQLPPDTKSTHCRIISWLHVVDNGRLSDEPLRIPTDNDQVAFIMYTSGTTGDPKGVIHTHGSLISGVTACADYVNELIGPYEEGESYCAYLPLAHIFEFGVVNIFLARGSFVGFGNPRTLLDTYTRPHGDYREYKPVFTIGVPRVYDTIKKTVESQLAPRGTLQRRIFEHAFQTRLRALKKGEETPYWNRLIFSPFRSMLGGKMKTMLSAGGPLSAPTQTFLHVVFGIMPQGWGLTETVCVGTKQVAGDMEPAAAGKQERTCEMRLLDVEGYKHTDEPDPRGEILLRGPFLFKGYYKQEELTKEVLDEDGWFHTGDVGSIGPNGTLRIIGRVKALAKNVLGEYVAMEALESMYAHNSLSMPNGVCVLVHPDRPYICALVLTDEAKVVAFTREHGLKGKYPEVLQDPEFQKKATASFQETARASDRQKFEIVRHVRLLSDEWTPENGVLTAAGKLKRRVIDEKYTDTIVSLFVEEC

SEQ ID NO: 14322 - DNA, 2097 bp, Trypanosoma brucei
  CDS (1)..(2097)
atgggaatgtacgtcactaagcttctctccctctggagtcactggtttgaggtggatgacgaggtgatcattgcgagacaaaagtttgggccacttgctcacatttgtggaccagcggagggcgaaaactgttcacctgtttaccgctccataggagtcacagatgaggagcaggcgcgcattacgagggaatggtattacggcgagcactttctgaaacagttggagcaaacatgcacgagcagaagagatactctggcagttgcttaccgcacaattaacaaggttgaaaaggagtggcgcgaggaccataatgggaagaggcgcgaatggcaggttacacatctcaacgatccggtctacatgacatatggtgaattatgggagaactctgtggcctttggaaagggtttaagggagtatggagcaaaggaaggggaccgtgttgccatttacgaggatacgcgatgggagtggcttgcctctgctattggggtttggacgcagttgatggttactgtaacagtttacgctaacctctgccgggaggggctgatgcacgcgctcaaggagacggagtgtgccgctattatttgcaacggccaaaacataaaggatctcattaccttactgaaggaggtcaatctcaccaacaccacgttggtctatctcgactctctaccagatgggttaaatgatgaaggcatgcgcttaataccatggaaacaggtgctggagacgggaatgaagagtaacctgggctataccattcctggaaattgtgacacaacggctttgatcatgtacacaagtggcacagtggcggcacccaagggtgtcatgcacacctttggttctctcaccgccagtaaaaatgggctggcggaccgcttccttgagtgtattggacccaaggaggagggtgagacatatgtatcttacctcccccttgctcacattttggagtttattgctgatgtggtgatgcttagccgcggtaccttggtgtgttttggttcgccacgaacactcacggatgatacggcgcgaccacgaggtgacttgaaggagtttaagccagtgtttatcgttggagtcccacggatctttgagacaatacggaaggttgtggaaagtcggctaccacctgtgggtagttttaagaggaccctctttgatactgcctatgctgaccgactccgtgctctcaaggaggggaaagatacgcctttctggaatgaaaaggtttttaaggtcccacgcgacatgttcggtggcaggctgcgtggagtggtatgtggtggcgcacctctcgctgacaggacacaagagttcatgcgggttgtcttcggccttccgctgggacaaggctacggattgacagaaacgtgctgcaacggaagcatacaacgtttgggtgagttatatccatcagttggtcaactcctgaaaggggttgaagggaggctattggatacagatgagtacaagcacactgataagccattcccgcgaggggagctctgccttcgtgggtcgtttatgttcaagggctactacaagcaggaggccatgagcaaagaagtgttgattccagggggttggttccgcacgggggacgttgtggaaattggtgaagataatgccctgcgagtcattggccgtgttaaggcactggtgaagaacctactcggagaatacattcagctggagtacctggaagtgatttactcacagcatccattgtctgcccctaatggcgtctgcattcttgtaaatcagcggcgggcatacatatgtgcccttgtaatcaccgacgaggaaagggctaagaagtttgcccaagaaaatggaattggtggaacgtggcccgagatacttaaggacccgactttccaccaacgtgccgccaagtcgttgtcgaatttcggcgcttcaattggtagaaaaccctttgaactgctccgtcaggtacgtgtgatcgccgatgagtggacggcaaagaatgggatgctcactgtctcgatgaaaatccgtcgcaacaaggtggaagaaaggtacggcgatgtcattgaacaacttttcaagtatgagtaa

SEQ ID NO: 14323 - protein, 698 aa, Trypanosoma brucei
MGMYVTKLLSLWSHWFEVDDEVIIARQKFGPLAHICGPAEGENCSPVYRSIGVTDEEQARITREWYYGEHFLKQLEQTCTSRRDTLAVAYRTINKVEKEWREDHNGKRREWQVTHLNDPVYMTYGELWENSVAFGKGLREYGAKEGDRVAIYEDTRWEWLASAIGVWTQLMVTVTVYANLCREGLMHALKETECAAIICNGQNIKDLITLLKEVNLTNTTLVYLDSLPDGLNDEGMRLIPWKQVLETGMKSNLGYTIPGNCDTTALIMYTSGTVAAPKGVMHTFGSLTASKNGLADRFLECIGPKEEGETYVSYLPLAHILEFIADVVMLSRGTLVCFGSPRTLTDDTARPRGDLKEFKPVFIVGVPRIFETIRKVVESRLPPVGSFKRTLFDTAYADRLRALKEGKDTPFWNEKVFKVPRDMFGGRLRGVVCGGAPLADRTQEFMRVVFGLPLGQGYGLTETCCNGSIQRLGELYPSVGQLLKGVEGRLLDTDEYKHTDKPFPRGELCLRGSFMFKGYYKQEAMSKEVLIPGGWFRTGDVVEIGEDNALRVIGRVKALVKNLLGEYIQLEYLEVIYSQHPLSAPNGVCILVNQRRAYICALVITDEERAKKFAQENGIGGTWPEILKDPTFHQRAAKSLSNFGASIGRKPFELLRQVRVIADEWTAKNGMLTVSMKIRRNKVEERYGDVIEQLFKYE

SEQ ID NO: 14324 - DNA, 1760 bp, Phrixothrix hirtus
  CDS (41)..(1681)
gtgacagtttagttcagtagaagatttttttgagatcaaaatggaagaagaaaacgttgtgaatggagatcgtcctcgtgatctagtttttcctggcacagcaggactacaattatatcaatcattatataaatattcatatattactgacggaataatcgatgcccataccaatgaagtaatatcatatgctcaaatatttgaaaccagctgccgcttggcagttagtctagaaaaatatggcttggatcataacaatgttgtggcaatatgcagtgaaaacaacatacacttttttggccctttaattgctgctttataccaaggaataccaatggcaacatcaaatgatatgtacacagaaagggagatgattggccatttgaatatatcgaaaccatgccttatgttttgttcaaagaaatcactcccatttattctgaaagtacaaaaacatctagatttccttaaaagagtcatagtcattgatagtatgtacgatatcaatggcgttgaatgcgtatttagctttgattcacgtaatactgatcacgcctttgatccagtgaaatttaacccaaaagagtttgatcccttggaaagaaccgcattaattatgacatcatctggaacaactggattgcctaaaggggtagtaataagccatagaagtataactataagattcgtccatagcagtgatcccatctatggtactcgtattgctccagatacatcaattcttgctatagcaccgttccatcatgcctttggactgtttactgcactagcttactttccagtaggacttaagattgtaatggtgaagaaatttgagggcgaattcttcttaaaaaccatacaaaattacaaaatcgcttctattgtagttcctcctccaattatggtatatttggctaaaagtccattagtcgatgaatacaattgctcgagcttaacggaaattgctagtggaggctctcctttaggaagagatatcgcagataaagtagcaaagagattgaaagtacatggaatcctacaaggatatggattaaccgaaacctgcagcgctctaatacttagccccaatgatcgagaacttaaaaaaggtgcaattggaacgcctatgccatatgttcaagttaaagttatagatatcaatactgggaaggcgctaggaccaagagaaaaaggcgaaatatgcttcaaaagtcaaatgcttatgaaaggatatcacaacaatccgcaagcaactcgtgatgctcttgacaaagatggttggcttcatactggggatcttggatattacgacgaagacagatttatctatgtagttgatcgattgaaagaacttattaaatataaaggatatcaggttgcgcctgctgaactggaaaatctgcttttacaacatccaaatatttctgatgcgggtgttattgaattccggacgaatttgctggtcaattacctttccgcgtgtgttgtgttagagcctggtaagacaatgaccgaaaaggaagttcaggattatattgcagagctagtcactacaactaaacatcttcgaggcggtgtcgtatttatagatagtattccaaaaggcccaacaggaaaactcatgagaaacgaactccgagcaatatttgcccgggaacaggcaaaatcaaaattataagctcaatatattgctttagttataaaatgtatgtaatcaaattttagaacctaatacattcattgagagcctaaaaaaa

SEQ ID NO: 14325 - protein, 546 aa, Phrixothrix hirtus
MEEENVVNGDRPRDLVFPGTAGLQLYQSLYKYSYITDGIIDAHTNEVISYAQIFETSCRLAVSLEKYGLDHNNVVAICSENNIHFFGPLIAALYQGIPMATSNDMYTEREMIGHLNISKPCLMFCSKKSLPFILKVQKHLDFLKRVIVIDSMYDINGVECVFSFDSRNTDHAFDPVKFNPKEFDPLERTALIMTSSGTTGLPKGVVISHRSITIRFVHSSDPIYGTRIAPDTSILAIAPFHHAFGLFTALAYFPVGLKIVMVKKFEGEFFLKTIQNYKIASIVVPPPIMVYLAKSPLVDEYNCSSLTEIASGGSPLGRDIADKVAKRLKVHGILQGYGLTETCSALILSPNDRELKKGAIGTPMPYVQVKVIDINTGKALGPREKGEICFKSQMLMKGYHNNPQATRDALDKDGWLHTGDLGYYDEDRFIYVVDRLKELIKYKGYQVAPAELENLLLQHPNISDAGVIEFRTNLLVNYLSACVVLEPGKTMTEKEVQDYIAELVTTTKHLRGGVVFIDSIPKGPTGKLMRNELRAIFAREQAKSKL

SEQ ID NO: 14326 - DNA, 1765 bp, Phrixothrix vivianii
  CDS (26)..(1663)
tcagtgcaagactttagggatcaaaatggaagaagaaaacattaggcatggagagcgtcctcgtgatatagtccatcctggctcggcaggacaacaattataccaatcattgtataaatttgcatcttttcctgaagcaataatcgatgctcatacaaatgaagtaatatcatatgctcaaatatttgaaaccagctgccgcttagctgttagtatagaacaatatggcttgaatgaaaacaatgttgtgggtgtatgcagtgaaaacaatataaacttttttaatcctgtccttgctgctttatacttaggaataccagtagcaacatcaaatgatatgtacacagatggagagttaactggtcatttgaatatatcaaaaccaactatcatgtttagttcaaagaaagcactcccgcttattctgagagtacagcaaaatctaagtttcattaaaaaagtcgtagttatcgatagcatgtacgacattaatggcgttgaatgcgtatctacctttgttgcacgttatactgaccacacctttgatccattgtcatttacaccaaaagattttgatccccttgaaaaaatcgcattaattatgtcatcatctggaacaactggattgcctaagggtgtagtactgagccatagaagtctaactataagattcgttcatagcagggatcccatttatggcactcgtacggttccacaaacatcaattctttccttagtaccgttccatcatgcctttggaatgtttactacattatcttactttgtagtaggacttaaggttgtaatgttgaagaaatttgagggcgcacttttcttaaaaaccatacagaattacaaaatccccactattgtagtggcccctccagttatggtgtttttggctaaaagcccattagtcgatcaatacgatttatcgagcttaacggaagttgctactggaggagctcctttaggaaaagatgtcgcagaagcagtagcaaagaggttgaaattacctggaatcatacaaggatatggattaactgaaacttgctgcgctgtaatgattacccctcataatgctgtgaagacaggttcaactggaagacccttgccatacattaaagctaaagttttagataacgctactgggaaggcgctaggaccaggagaaagaggcgaaatatgctttcaaagtgaaatgattatgaaaggatattacaacaatccggaagcaactattgatactattgacaaagatggttggcttcattctggagatattggatattacgacgaagatggaaatttctttatagttgatcgattgaaagaacttattaaatacaagggatatcaggttgcgcctgctgaactggaaaatctgcttttacaacatccaagtattgctgatgcgggtgttactggagttccggacgaatttggtggacaattacctgctgcttgtgttgtgttagaatctggcaagacgctgactgaaaaggaagttcaagattttattgcagcacaagtcactccaacaaagcatcttcgaggcggtgtcgtatttgtagacagtattccgaaaggccctactggaaaactcatcagaaaggagctccgagaaatatttgcccagcgagcaccaaaatcaaaattataagttcaatgtattgctttagttctaaaatgtatataaacaagttttagaacctaatacattcattcaaatactaaacaaaaaaaaaaaaaaaaaaaaaaaaaa

SEQ ID NO: 14327 - protein, 545 aa, Phrixothrix vivianii
MEEENIRHGERPRDIVHPGSAGQQLYQSLYKFASFPEAIIDAHTNEVISYAQIFETSCRLAVSIEQYGLNENNVVGVCSENNINFFNPVLAALYLGIPVATSNDMYTDGELTGHLNISKPTIMFSSKKALPLILRVQQNLSFIKKVVVIDSMYDINGVECVSTFVARYTDHTFDPLSFTPKDFDPLEKIALIMSSSGTTGLPKGVVLSHRSLTIRFVHSRDPIYGTRTVPQTSILSLVPFHHAFGMFTTLSYFVVGLKVVMLKKFEGALFLKTIQNYKIPTIVVAPPVMVFLAKSPLVDQYDLSSLTEVATGGAPLGKDVAEAVAKRLKLPGIIQGYGLTETCCAVMITPHNAVKTGSTGRPLPYIKAKVLDNATGKALGPGERGEICFQSEMIMKGYYNNPEATIDTIDKDGWLHSGDIGYYDEDGNFFIVDRLKELIKYKGYQVAPAELENLLLQHPSIADAGVTGVPDEFGGQLPAACVVLESGKTLTEKEVQDFIAAQVTPTKHLRGGVVFVDSIPKGPTGKLIRKELREIFAQRAPKSKL

SEQ ID NO: 14328 - DNA, 2480 bp, Drosophila melanogaster
  CDS (161)..(2161)
ctgaattcggtcgtgtttgctgtcgtggttctcgagcgaaagaaagagtgggagtatagaaaatagacggcaatcgatttgcgtgaccaaagaacaaatatatacatacatatatcgagaacgccgtagaaacaccaaactagttaattatccttgcaacatgtccacgatagacgcgctctacaatcgtcctgggcccaaccgcctgcggcaggcggatgcctatcgcaccaccaatcgtcaggatgccgtcaagattcgtatggccaaggatggaatcggcgcagaggagcccatctccgtgcccggcctgctgaagcgtacggtcaacaattatggcgactatcctgcgctgcgcaccaagaacggcaagaacggatatcacactgtcacctacaaacaatatgagcagaaggtgcaccaggtggccaaggcgttcattaagctcggtctggaggagcaccattcggtgggtgtgctggccttcaattgcgccgaatggttctactcggccatgggcgccattcacgcacgaggcatcatcgccggaatctacaccaccaattccgccgatgcagtgcagcacgttctggagagctcacatgcccaaatcgtggtcgtcgacgacgccaagcaaatggacaagattcacgccattcgcgacaagctgcccaagctcaaggccgccattcagatccaggagccctattccccctacttgaagaaggaggatggctactacaggtggtcggagatcgagtcgatgaacgttagcgacgtggaggatcagtacatgacccgtttggagaatgtggcgatcaacgagtgctgctgcctggtctacacctccggaacggtgggcatgcccaagggcgtgatgctctcccacgacaacatcaccttcgatgtgcgcggcatcgtcaaggccatggaccgtgtggtggttggggcggagtcgatcgtctcctacctgccactttcgcacgtggccgcccagaccgtggacatttacacctgcgcctttgtggcgggctgcatttggttcgccgacaaggatgcgctgaagggaacgctggtgaagtcgttgcaggatgcgcgacccacgcgattcatgggcgtgccgcgtgtgtacgagaagttccaggagcgaatggtcgccgtggccagctccagcggcagcctgaagaagatgctcgccagctgggccaagggcatcacgctgaagcactacatggtgagtcaaggcaagagctccgggggattccggtacaagattgccaagtcgctcatcatgtccaaggtgaagcaggccctgggcttcgatcgcgtccttacactggccagtgcggcagctcccatgtcgccggagacgaagaagtacttcctcagtctggacctaaagattgtcgatgccttcggcatgtcagaaacggccggttgtcacaccatctgccttcccgattccgtgggtctgaacacaatcggcaaaactttgcccggctgcgagtccaagttcatcaacaaggatgccaacggtcacggagagctgtgcatccgaggacgtcacgttttcatgggctacatcgacaacaaggagaagaccgaggagtcgctggatgacgactgctggctgcattccggtgatttgggatttgtggatgacaagggttatgtttcactgacgggacgatccaaggagatcatcattaccgccggcggcgagaacataccgccagtgcacatcgagaacacgatcaagaaggagctggatgccatttccaatgcctttttggtgggcgagcagcgcaaatatctcactgttctgatcaccctaaagaccgaagtggacaaggattccggtgagccgctggacgagcttagccacgagtcctccgtgtgggtgaaatcgctgggagtggagcacaagaccgtatcggatatcctggccgcaggtccctgccccaaggtgtggaagtccatcgaggatgccattaagcgggccaacaagcagtccatttccaatgcccaaaaggttcagaagttcaccattctgccgcacgacttctccattcccaccggcgaacttggacccaccctaaaggttaagcgcaacgttgtgtccaagatgtatgccgatgagatcgagaaactatatgcctagatttctcactgcaagatcgaaaccgatgatagccgcggaacttgagctttaatgtgaatttgaatttaacggacttccaagccaattgagtgccacttttaatttgatttaggctgatgttaactgttggatattaaactaagaacaactatggccctatgcctaggtagacacgagcttgccaacgattaggtccagagatcatttaattagtaactaagttttattttttatatactatttggttgtaccaactgaacaaacgaaaattgtttattgtctgaagagcaacaataaatttgtaattagattaactacc

SEQ ID NO: 14329 - protein, 666 aa, Drosophila melanogaster
MSTIDALYNRPGPNRLRQADAYRTTNRQDAVKIRMAKDGIGAEEPISVPGLLKRTVNNYGDYPALRTKNGKNGYHTVTYKQYEQKVHQVAKAFIKLGLEEHHSVGVLAFNCAEWFYSAMGAIHARGIIAGIYTTNSADAVQHVLESSHAQIVVVDDAKQMDKIHAIRDKLPKLKAAIQIQEPYSPYLKKEDGYYRWSEIESMNVSDVEDQYMTRLENVAINECCCLVYTSGTVGMPKGVMLSHDNITFDVRGIVKAMDRVVVGAESIVSYLPLSHVAAQTVDIYTCAFVAGCIWFADKDALKGTLVKSLQDARPTRFMGVPRVYEKFQERMVAVASSSGSLKKMLASWAKGITLKHYMVSQGKSSGGFRYKIAKSLIMSKVKQALGFDRVLTLASAAAPMSPETKKYFLSLDLKIVDAFGMSETAGCHTICLPDSVGLNTIGKTLPGCESKFINKDANGHGELCIRGRHVFMGYIDNKEKTEESLDDDCWLHSGDLGFVDDKGYVSLTGRSKEIIITAGGENIPPVHIENTIKKELDAISNAFLVGEQRKYLTVLITLKTEVDKDSGEPLDELSHESSVWVKSLGVEHKTVSDILAAGPCPKVWKSIEDAIKRANKQSISNAQKVQKFTILPHDFSIPTGELGPTLKVKRNVVSKMYADEIEKLYA

SEQ ID NO: 14330 - DNA, 2759 bp, Drosophila melanogaster
  CDS (402)..(2516)
gaccgtttagcagtaatttttccggcattcgctttttcggtattccatgctcggttctagggctttttctctctgttttcgccccgcgcctacataaacgcccccccaaagcgacccggtaaaaaatacgataggcggaatcagcgagtgccgaaacgtaaaattttcattgattttcccaggctaatttagctgtataaatagtcggcccgtgcccaaatctataaataagcccgacaaatgtgtttcatcttcaagtagtccagaatcgtaggctatcttctgtaggcaatcattaagctaaacacgtaacattcactcaggttgaaaagaaaaacaactattaactactactgtaataccacaaaaaaaaaaaacaataatatattaaggaaaaaacgatgacgccagagaaatcggttatggcctacgtcaatcatttgattgtcagcaatttttcatatttctgggacgagatcgatgggtatctgtactacctgggaggcactttgggaacattaaccctaggaagcctggcagctagtgtggcatactactttgcaacgaggcccgttccggaacgaccgttagtgcctctggagaaccaatcgccattgctagagggtccagaacaaatacacgtctccaagttctacaaggagtcgaagaacggcaagttcgtgtcctacatcacagagaatgtccgcaccctgtaccagacgttccgcgagggcgcctacgcctccaacaatggaccatgtcttggctggcgcgagaccctgacctccccctaccagtggatcaactacgacgaggccctgctgcgtgccaagaactttggagccggaatgctggcgctaggagccaggccaaagcagttgattgggatctactcgcagaaccgcccggaatggatcctgtacgagcagggctgctactccttctccttggtggtggtgccgctgtacgacaccctgggccccgatgcctgcgccttcatcatacgccagacggatatgcaggtggtgattgtggaggacgatggcaaggcggccatgctgttggagaaggcgccgcgcagtctgaagatcatagtggctatcaagcccatccggcagacgaccctggagcgggcacgcagccgaggcatacagatattctcatttatcgatgtggagaaactaggtgccaaaggcaaccatccggaggtgccgccgacggcggaggatctttgcacggtgtgctacacgtccgggacgacgggcaatccgaagggcgtgatgctcacccacggcaacgtggtggccggcgtctgttctgtgatcctgcagatgggcgaccatcgcatccgggcgggcgatgtgatggtgtcattcctgcccctggcccacatgttcgagcgttgctgcgagaatggaatgtactatgtgggcggctgtgtgggcttctattccggcgacatcaaggaattaaccaatgacctcaagatgctgaaaccaaccgtaatgccggcagtgcctcgtcttttgaaccgcgtctacgacaagattcagaatgatatctcagcgtctggactgaagaggggtctcttcaatatggctatgcgagcgaaggagaaggagatcgccaggggtgtcctgcggaggaacggctgctgggacaagttggtcttcaagaaggtgcatcaggcctttggcggaaatcttcgtttaatggtcgtgggctccgccccattggccggaaatgtcctgaccttcatgcgctgtgctctgggctgcctggttctcgagggatatggccaaacggagtgcacgggggccattacccttaccgttcagggagatcatgtgcccaaccatgtgggaccacccgtgtcctgcaatgctgtgaaactggtggatgtgccggagatggagtactttgccaatcaaaatactggcgaggtgtgtgtgcgcggatcgaatgtgttccatggttactataaggatcccgaaaagacggcggaggccatcgattcggagggctggcatcatacgggcgatgtgggcatgtggctgccaaatggaacactacggatcatcgatcgccgcaagcacatcttcaagcttagccagggcgagtacatagtgcccgagaagatcgagaatatctacacgctcagtcaatacgtaaatcaagtttatgtctatggagagagcttaaagagctgcattatcgctgttgttgtacctgataccgatgtactgaagcaatgggccacggagaacaatgtacgcggcacactctccgtcctgtgcaataataagaatgtcaaggaactgatcatgaacgacatgctcaactggggcaagcagagtggactcaagtcattcgaacaggttaaagatatctatctgcatccggatcccttctcggtgcaaaacggactgctgacgcccacattcaaagccaagagaccgcagcttaagagctattttaagccccagctggaggatatgtataaacacctggattaaagcaatgcctatatgcatacatagacatcaacaacgaatcgaactcaagaaactgggaagcattcattcaaatatgcctataccattttaaactgatgataacaaagactacagatacagatacgaaagcgaactgtctaattttgtagtatcgtcaattcttagcacgtaagaggagcgcaagatacaccagatacagatacaatacacataaaatatacacaacttcaaactgacaaggag

SEQ ID NO: 14331 - protein, 704 aa, Drosophila melanogaster
MTPEKSVMAYVNHLIVSNFSYFWDEIDGYLYYLGGTLGTLTLGSLAASVAYYFATRPVPERPLVPLENQSPLLEGPEQIHVSKFYKESKNGKFVSYITENVRTLYQTFREGAYASNNGPCLGWRETLTSPYQWINYDEALLRAKNFGAGMLALGARPKQLIGIYSQNRPEWILYEQGCYSFSLVVVPLYDTLGPDACAFIIRQTDMQVVIVEDDGKAAMLLEKAPRSLKIIVAIKPIRQTTLERARSRGIQIFSFIDVEKLGAKGNHPEVPPTAEDLCTVCYTSGTTGNPKGVMLTHGNVVAGVCSVILQMGDHRIRAGDVMVSFLPLAHMFERCCENGMYYVGGCVGFYSGDIKELTNDLKMLKPTVMPAVPRLLNRVYDKIQNDISASGLKRGLFNMAMRAKEKEIARGVLRRNGCWDKLVFKKVHQAFGGNLRLMVVGSAPLAGNVLTFMRCALGCLVLEGYGQTECTGAITLTVQGDHVPNHVGPPVSCNAVKLVDVPEMEYFANQNTGEVCVRGSNVFHGYYKDPEKTAEAIDSEGWHHTGDVGMWLPNGTLRIIDRRKHIFKLSQGEYIVPEKIENIYTLSQYVNQVYVYGESLKSCIIAVVVPDTDVLKQWATENNVRGTLSVLCNNKNVKELIMNDMLNWGKQSGLKSFEQVKDIYLHPDPFSVQNGLLTPTFKAKRPQLKSYFKPQLEDMYKHLD

SEQ ID NO: 14332 - DNA, 3188 bp, Homo sapiens
  CDS (74)..(2173)
cgggcagtgacagccggcgcggatcgcgcgtccacggaggagaatcagcttagagaactatcaacacaggacaatgcaagcccatgagctgttccggtattttcgaatgccagagctggttgacttccgacagtgcgtgactcttccgaccaacacgcttatgggcttcggagctttttccagacgactcaccaccttctggcggccacgccacccaaaacccctgaagccgccatggcacctctccatgcagtcagtggaagtggcgggtagtggtggtgcacgaagatccgcactacttgacagcgacgagcccttggtgtatttctatgatgatgttacaacattatacgaaggtttccagagagggatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggactcgtacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccaccgtgaagcgatggctcttggactttgcctccaagaggaaagaagcagacgttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccacaggccatgttggggccccgatgccgtgcaatttgataaaacttggttggcagttggaagaaatgaattacatggcgtccgagggcgagggcgaggtgtgtgtgaaagggccaaatgtatttcagggctacttgaaggacccagcgaaaacagcagaagctttggacaaagacggctggttacacacaggggacatcggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccatcatcaaggtttagtgtgaagaagaaagctcagaggaaatggcacagttccacaatctcttctcctgctgatggccttcatgttgttaattttgaatacagcaagtgtagggaaggaagcgttctgtgtttgacttgtccattcggggttcttctcataggaatgctagaggaaacagaacactgccttacagtcacctcagtgttcagaccatgtttatggtaatacacacttccaaaagtagccttaaaaattgtaaagggatactataaatgtgctaattatttgagacttcctcagtttaaaaagtgggttttaaatcttctgtctccctgtttttctaatcaaggggttaggactttgctatctctgagatgtctgctacttcgtcgaaattctgcagctgtctgctgctctaaagagtacagtgctctagagggaagtgttccctttaaaaataagaacaactgtcctggctggagatctcacaagcggaccagagatctttttaaatccctgctactgtcccttctcacaggcattcacagaacccttctgattcgaagggttacgaaactcatgttcttctccagtcccctgtggtttctgttggagcataaggtttccagtaagcgggagggcagatccaactcagaaccatgcagataaggagcctctggcaaatgggtgctgcatcagaacgcgtggattctctttcatggcagatgctcttggactcggttctccaggcctgattccccgactccatcctttttcagggttatttaaaaatctgccttagattctatagtgaagacaagcatttcaagaaagagttacctggatcagccatgctcagctgtgacgcctgataactgtctactttatcttcactgaaccactcactctgtgtaaaggccaacggatttttaatgtggttttcatatcaaaagatcatgttgggattaacttgcctttttccccaaaaaataaactctcaggcaaggcatttcttttaaagctattccg

SEQ ID NO: 14333 - protein, 699 aa, Homo sapiens
MQAHELFRYFRMPELVDFRQCVTLPTNTLMGFGAFSRRLTTFWRPRHPKPLKPPWHLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDSYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTVKRWLLDFASKRKEADVRSGIIRNNSLWDRLIFHKVQSSLGGRVRLMVTGAAPVSATVLTFLRAALGCQFYEGYGQTECTAGCCLTMPGDWTTGHVGAPMPCNLIKLGWQLEEMNYMASEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSIIKV

SEQ ID NO: 14334 - DNA, 1889 bp, Nicotiana tabacum
  CDS (67)..(1710)
tttccttttagcgtgttccaactttttctcttttgtctctctaaatctacttaaaccatagccacaatgccaatggagactactacagaaacaaagcaatcaggagatttaattttccgatcaaaactccctgatatttacatccctaaacatttacctttacattcttattgttttgaaaacatttcggagtttagttctcgtccctgtttgattaatggagccaacgatcaaatttatacttatgctgaggttgagctcacttgcagaaaagttgcagttggtcttaacaagttagggatccaacaaaaggacacgattatgatccttttgccgaattcccctgaatttgtgtttgcttttatgggcgcttcatatttaggagccatttctacaatggccaatcctctgtttacacctgcagaggttgtaaaacaagccaaagcctcaagtgctaagattattataactcaatcgtgctttgtgggcaaagtgaaggattacgcaagtgaaaatgatgtgaaggtcatttgtattgactctgcaccggaaggttgtcttcatttctcagaattgacacaatccgatgagcatgaaattcctgaggtgaaaatccagccagacgacgtcgttgcgctgccgtattcctctggtactacagggctgccgaaaggtgtgatgttgacgcacaagggattagtcacgagcgttgcacaacaagttgacggtgaaaatgcgaatttgtatatgcacagtgaggatgtattgatgtgtgtgttgcctttgttccatatatactcactcaattccattttgctttgtggattgagagtcggtgcagcgattttgattatgcagaaatttgacattgctccgttcctggagttaatacagaagtataaggtgtcaattgggccatttgtgccgcctattgttctggctattgctaagagtccaattgttgatagctatgatctttcctcagtaaggactgtcatgtctggggctgcaccattaggaaaagaactcgaagacgctgtgagaaccaaattccctaacgctaaacttggccagggttatggaatgacggaagctgggccggtgttggcaatgtgtttggcatttgcaaaagaaccctttgatattaaatcaggggcatgtggtactgttgtgaggaacgccgagatgaaaattgtagatccggatacgggttgctctcttcctcgtaaccaacccggtgagatttgcattagaggtgaccagatcatgaaaggttacctgaatgatcccgaggccacaacgagaacaatagacaaagaaggatggttacacactggcgacattgggttcattgacgaggatgacgagcttttcattgtggatcgattgaaggaattgatcaaatacaaaggatttcaagtggcacctgcagaaattgaagcccttcttctcaaccatcccaacatttctgatgctgctgttgtccccatgaaagatgagcaagcaggagaagttccagtggcttttgttgttaggtcaaatggatctgccatcactgaggatgaagtcaaggatttcatctctaaacaggtgatattttataagagagtaaagcgtgtatttttcgtggagacggtacccaaatctccgtcgggaaaaattcttagaaaggacttgagagctagactggctgctggtgttccaaattaattccttttggcttggtatttgatggtggtaacaaactaaacaagtccaccattgaagatattatatgttctttaaattttaccttcacctaacggtataatttccagtttggcaacgggcgaaatgtctgtaaattaatttataagacttctttattcatctttaaaaaaaaaaaaaaa

SEQ ID NO: 14335 - protein, 547 aa, Nicotiana tabacum
MPMETTTETKQSGDLIFRSKLPDIYIPKHLPLHSYCFENISEFSSRPCLINGANDQIYTYAEVELTCRKVAVGLNKLGIQQKDTIMILLPNSPEFVFAFMGASYLGAISTMANPLFTPAEVVKQAKASSAKIIITQSCFVGKVKDYASENDVKVICIDSAPEGCLHFSELTQSDEHEIPEVKIQPDDVVALPYSSGTTGLPKGVMLTHKGLVTSVAQQVDGENANLYMHSEDVLMCVLPLFHIYSLNSILLCGLRVGAAILIMQKFDIAPFLELIQKYKVSIGPFVPPIVLAIAKSPIVDSYDLSSVRTVMSGAAPLGKELEDAVRTKFPNAKLGQGYGMTEAGPVLAMCLAFAKEPFDIKSGACGTVVRNAEMKIVDPDTGCSLPRNQPGEICIRGDQIMKGYLNDPEATTRTIDKEGWLHTGDIGFIDEDDELFIVDRLKELIKYKGFQVAPAEIEALLLNHPNISDAAVVPMKDEQAGEVPVAFVVRSNGSAITEDEVKDFISKQVIFYKRVKRVFFVETVPKSPSGKILRKDLRARLAAGVPN

SEQ ID NO: 14336 - DNA, 1662 bp, Vanilla planifolia
  CDS (1)..(1662)
atggcggcggcggtggcaatcgaggaacagaagaaggatataattttccgatcaaaacttcccgatatttacattccaaaaaatcttcctttacattcttattgtttcgaaaatatttccaaattcagttctcgtccttgtttaatcaatggcgccactgacgaaatcttcacgtatgctgacgtggaacttatttcacgaagagtcgggtcaggtctttccaagctcggaatcaaacaaggagacacaataatgatattacttccgaattcacccgaattcgtattcgcatttctgggagcttcttttatcggatccatttccacaatggctaatccgtttttcacttcaaccgaagtcatcaaacaagctaaagcctcaaatgcgaagttgataatcacacaaggctgttacgtagataaagtgaaagactacgcatgcgaaaacggcgttaaaatcatctccatcgatacgacgacgacggcagacgacgctgcaaatattttacatttctccgaactaacgggagccgacgaaaacgaaatgccaaaagtcgaaattagccccgacggcgtcgtagcgttaccttattcatccggtacgacgggattacctaaaggggtaatgttgacacataaaggattagtaaccagcgtagcacaacaagttgacggagaaaatccgaatttatacatgcacagcgacgacgtattactgtgtgttctgccattatttcatatttattcgctaaattcggtattgctctgcgggttgagagcgggttcgggtattttgataatgcagaaattcgaaatagttccatttttggaattaatacaaaaatataaggttacgattggtccatttgtgccgccgattgtattggctatagctaaaagcacggttgtagataattatgacctttcttctgtacggacagttatgtccggcgccgcccctcttggtaaggagcttgaagacgctgttagagctaaatttcctaatgctaagcttggacagggttacgggatgacagaagcaggacccgttttggctatgtgtttagcatttgctaaggaaccattcgatatcaaatcgggtgcatgtggtaccgttgtccgaaatgctgagatgaaaattgtcgacccggaaaccggttcttccttgccccgcaaccaccccggagaaatctgcattcgtggtgaccaaatcatgaaaggctatttgaatgatccggaggcgacggcaagaaccatagacaaagaagggtggctacacactggtgatattggctacattgatgatgatgatgaactcttcattgttgataggttaaaggagttaataaaatacaaaggtttccaagtagcacctgctgaacttgaagctctcttactcactcatccttgtatctctgatgctgctgttgtcccaatgaaagatgaggcagcaggagaagttccagttgcttttgttgtgaaatccaatggacataacatcaccgaggatgaaatcaagcaatttatatccaaacaggtaatattttacaagagaataaaccgtgtgttctttgtggaagccattccaaaagcaccatctggaaagatattgagaaaggatttaagagcaagattagctgctgctgctctccctactaactaa

SEQ ID NO: 14337 - protein, 553 aa, Vanilla planifolia
MAAAVAIEEQKKDIIFRSKLPDIYIPKNLPLHSYCFENISKFSSRPCLINGATDEIFTYADVELISRRVGSGLSKLGIKQGDTIMILLPNSPEFVFAFLGASFIGSISTMANPFFTSTEVIKQAKASNAKLIITQGCYVDKVKDYACENGVKIISIDTTTTADDAANILHFSELTGADENEMPKVEISPDGVVALPYSSGTTGLPKGVMLTHKGLVTSVAQQVDGENPNLYMHSDDVLLCVLPLFHIYSLNSVLLCGLRAGSGILIMQKFEIVPFLELIQKYKVTIGPFVPPIVLAIAKSTVVDNYDLSSVRTVMSGAAPLGKELEDAVRAKFPNAKLGQGYGMTEAGPVLAMCLAFAKEPFDIKSGACGTVVRNAEMKIVDPETGSSLPRNHPGEICIRGDQIMKGYLNDPEATARTIDKEGWLHTGDIGYIDDDDELFIVDRLKELIKYKGFQVAPAELEALLLTHPCISDAAVVPMKDEAAGEVPVAFVVKSNGHNITEDEIKQFISKQVIFYKRINRVFFVEAIPKAPSGKILRKDLRARLAAAALPTN

SEQ ID NO: 14338 - DNA, 3698 bp, Cavia porcellus
  CDS (87)..(2183)
actgagcggactgctgtgacagcccgcagcggagcggctgggccagcgcaggagaattcatcctcgggagccttcaggacaggaccatgcaagcgcatgaattattgcagtattttcggttgccagagctggtggacattcggcagtacgtgcgcacccttcctaccaacacacttatgggcttcggagcttttgccgcgctcactaccttctggtacgccaccaggcccaaggccctgaagccaccatgtgacctctccatgcagtccgtggaagtggcgggtagtgatggtgctcgaaggtccacgcttcttgatagtgatgagcccctcgtgtacttctacgatgatgtcagaacattatatgatgttttccaaaggggcattcaggtgtcaaataatggcccttgtttaggctctcggaaaccagaccaaccctatgagtggctttcctacaaacaggtggaggatctgtcggaatgcatcggctcagcgctgcttcagaagggcttccaggcctccccagatcagttcattggcatctttgctcaaaacagacctgagtgggtgataattgaacaagcatgctttgcttattcaatggtggtggttccgctttacgatacccttggagcagatgccatcacgtacatagtcaacaaagctgagctctcggtgatttttgctgacaaaccagagaaggccagaatcttgttagagagtgtagaaaataagttaacaccaggccttaaaatcatagttgtcatggacagctatggcagtgaactcgtggaacaaggcaagaaatgtggggtggaagtcatcagcctgaaggcgatggagggccttggaagagccaacagaagaaagcccaagcctccagaacctgacgatcttgcagtaatttgtttcacaagtggaactactggcaaccccaaaggagcaatgatcacgcacaaaaatgtagtgagtgattgttcagcttttgtgaaagcaacagagaaagcacttgtcttgaatgccagtgacatacatatttcattcttaccacttgcacacatgtatgagcaactactgcagtgtgtgatgctgtgtcatggagctaaaataggatttttccaaggagatatcaggctgcttatggatgatctcaaggcgcttcagcctactatctttcctgtggttccaagactgctgaaccgcatgtttgaccgaatttttgcacaagcaaacaccacagtgaagagatggctgttggactttgcctccaagagaaaagaagcagagcttcgcagtggcatcatcagaaacaatagtgtgtgggataaacttatcttccacaaaatacagtcaagcctgggtggaaaagtccggttgatggtcacaggagctgcacctgtctctgccactgtgctgacgttcctaagagcagcccttggctgtcagttctatgaaggctacggacagacagagtgcacagccggctgctccctgagtgtgcctggagactggacagcaggtcacgttggtgccccaatgccttgcaatttcataaaacttgttgatgtggaagaaatgaattacatggctgcaatgggtgagggcgaggtatgtgtgaaagggccaaatgtatttaagggctacttgaaggacccagcaaaaacagcagaagctttggataaagatggctggttacacacaggggacattggaaaatggctgccaaatggtacactgaagattattgacaggaaaaagcatatattcaaactggcgcaaggagaatacatagcacctgagaagattgaaaacatctatgtgcggagtgaacctgtggcccaggtgtttgtccacggagaaagcttgcaggcatttctcatagcaattgtggtaccagatgctgagagcttagcttcctgggccagaaagagaggctttgaaggatcctttgaggagctgtgcagaaacaaggatgtcaaaaaagctatcctagaagatatggtgagaattgggaaggattctggtctgaaatcatttgaacaggtcagaggcattgctctgcaccctgaattattttctgttgacaatggccttctgaccccaacgatgaaggcaaaaaggccagagctacggaactatttcaggtcacagatagatgaactgtactctaccatcaaggtgtaatgtgaggaagaaagctccgaagagatgacacacctccacggccccttctcctactgatggccttcatgttgggaattttgactgcagcaagcatagggaaggaaaagtccatgtttgacttgtccattcgaggtcttgtcataggattattagaggaaatggaacactgccttacagtcacctcgtattgcagaccatattcatggtgatacacaattttcaaaatgagccttaaaattgtaaaggggaaactatagaagtgctaagttatttgagacttcctcagtaataaggtgggtgttaaaacttctgtctccctgtttttctaaccaaggggttaggactctgctgtttcttagatgtctgctacttgctgcaaattttgcagctgtctgctgctctgaagagtacaatgcactggagggaagctgttcctttagaagcaagaacatctgtcccagctggagaatatcacaagtggaccagagattttttttaaatccctgccgtcttccctttaccatctcatatgcactcaataaacccttctgatgtaagggttcaaaacaatcccctcctgttcctcatggggcataaggttcccgataaaccaaaggactggtctaccttggagcaatgcgggtgctgagtctcggaagaatggcggctcatcagagcgaatggcttctcgttgcacagcaggctgctgtcatactctcctcctcacctggttcctccatccttcccaggggttatgaaaaaacctgccttagactctgcagtgaagacagcattgcaagaaagaattacctggaatcaaccaaccatgctcaactgtgatgcctgaagagctgtccacttgatcttccctgaaccactcactgtttataacggccaatggacttttcatgtggttttcatatcagttgataatgtggtgattaacttgcttttttgcccctcaaataaactctcaggcaaagcatgtcttcatatatattaagggaatagttgtacttgggtaattattgaaatggagggtaacaaacaaatgttcttatatcacgatactacctgatctttgtgaaacagatttgacaagccaaaattctaggatgtagaaatctggaaaaatcatttcctgagattaacttcttaaaggatttttttaaaagttaatttgggaaattaacagcatttcactttattgcaggtctttgccacatttgactgaatcgagctgtcatttacacatttaaagccactgtggtgggctatgtgagagtatgtgtgatatacaagcacaacagggtttgcactaagaattgtcattgtaacaacactatttggtagcctaacttcatatatgtattcttaattgcacaaaaagtcagtaatttgtcacattggggttttgaatgtttgctttgtgttgctgtttctatgttttataaaccaaaagagaatttccaaaaacaatgaaggaaaccaaaataaatatttctgcatttggat

SEQ ID NO: 14339 - protein, 698 aa, Cavia porcellus
MQAHELLQYFRLPELVDIRQYVRTLPTNTLMGFGAFAALTTFWYATRPKALKPPCDLSMQSVEVAGSDGARRSTLLDSDEPLVYFYDDVRTLYDVFQRGIQVSNNGPCLGSRKPDQPYEWLSYKQVEDLSECIGSALLQKGFQASPDQFIGIFAQNRPEWVIIEQACFAYSMVVVPLYDTLGADAITYIVNKAELSVIFADKPEKARILLESVENKLTPGLKIIVVMDSYGSELVEQGKKCGVEVISLKAMEGLGRANRRKPKPPEPDDLAVICFTSGTTGNPKGAMITHKNVVSDCSAFVKATEKALVLNASDIHISFLPLAHMYEQLLQCVMLCHGAKIGFFQGDIRLLMDDLKALQPTIFPVVPRLLNRMFDRIFAQANTTVKRWLLDFASKRKEAELRSGIIRNNSVWDKLIFHKIQSSLGGKVRLMVTGAAPVSATVLTFLRAALGCQFYEGYGQTECTAGCSLSVPGDWTAGHVGAPMPCNFIKLVDVEEMNYMAAMGEGEVCVKGPNVFKGYLKDPAKTAEALDKDGWLHTGDIGKWLPNGTLKIIDRKKHIFKLAQGEYIAPEKIENIYVRSEPVAQVFVHGESLQAFLIAIVVPDAESLASWARKRGFEGSFEELCRNKDVKKAILEDMVRIGKDSGLKSFEQVRGIALHPELFSVDNGLLTPTMKAKRPELRNYFRSQIDELYSTIKV

SEQ ID NO: 14340 - DNA, 2597 bp, Mus musculus
  CDS (262)..(2313)
tgcatgtcagaaagcccggctatggcctggctgggacagatcagggcagggcagaagtggggccactagccaggctgcctgcctgcctgcctgcatggacgctctgaagtcaccctgcccgcggagaagcccggggtgaggaagggaggaccggggctctcctgccagcaagaagccggagccagaaagcctcactcggaagctccaaggcgtgcgtgcggcccttcccagggtctgaatttcctgttggtattcacaaagatgctttttatttttaacttcttgttttccccacttccaactccggccctgatctgcctcctgacgtttggaacggccatcttcctgtggctgatcaacagacctcagccagttttacctctcattgacttggacaaccagtctgtggggattgagggaggagcacggaggggcgctttccagaagaacaatgacctaatcctttattacttctcagacgccaagacgttgtatgaaaatttccaaagaggacttgctgtgtctgacaatgggccttgcttgggatacagaaagccaaaccagccctacaaatggatctcctacaaacaggtgtctgatcgagcagagtacctgggctcctgtcttttgcataaaggatataagtcatcacaggaccaatttgttggcatctttgctcaaaataggccagagtgggtcatctctgagttagcctgttacacatattccatggtagctgtccccctgtatgacacgctgggtacagaagccatcatctttgtcatcaacagggctgatatccctgtggtcatctgtgatacaccccaaaaggcaacaatgctagtagaaaatgtggaaaagggcctcacaccaggcctgaagacgatcatcctcatggacccttttgatgacgacctgatgaaaagaggagaaaagtgtggagttgagatgttatccctgcatgatgcggagaatataggcaaagagaacttcaaaaaaccagtgcctccgaagccagaggatctgagcgtcatctgtttcaccagtggaactacaggtgaccccaaaggagctatgctaacccatgaaaatgttgtttcaaacatggctgctttcctcaaatttctggagcctatcttccagcccacctctgatgatgtgaccatatcctaccttcccttggctcatatgtttgagaggcttgtccagggtatcttattttcctgtggaggcaaaattgggttcttccaaggagatatccggttgctacctgatgacatgaaggctttgaaacccacagtgtttcctacagtgcctcgactccttaacagggtctatgataaggtacaaaatgaagccaagacacctttgaagaagttcttgttgaacttggctatcatcagtaaattcaatgaagtgaaaaatggcatcattcggcgggacagtttgtgggacaagctcgtgttttcaaagattcaaggaagcctgggggggaaggttcgcctcatgatcactggagccgcccccatctccactccagtcttgacattcttcagggctgcaatgggatgttgggtgtttgaagcttatggccaaacagaatgcacaggtggatgttcaattacatcacctggggactggacagcaggtcatgttgggactccagtggcttgcaattttgtaaagctggaagatgtggctgacatgaactacttttcagtaaacaacgaaggcgagatctgcatcaaaggtaacaatgtgttcaaaggctacctaaaggacccagagaaaacacaggaagtactggacaaggatggatggcttcacactggggacattggtcgctggcttccaaatggaactctgaaaattgttgaccggaagaagaatattttcaagttggcacaaggagaatacattgccccagagaagattgaaaatgtttattccaggagcagaccagtattgcaagtttttgtccatggggagagcttacggtcattcctgatcggagtggtggttcccgacccagattcacttccctcatttgcagccaagatcggggtaaagggatcatttgaagaactgtgcaaaaaccaatgtgtaaaggaagccattttagaagacttgcagaaaattgggaaagagggtggcctgaaatcctttgagcaggtcaaaagtatctttgtgcatccagagcccttcactattgaaaacggacttctgacaccgacactgaaagccaaacgagtagagcttgccaagttcttccagacacaaatcaagagcctctatgagagcatcgaggagtagtagcttaagtttgctgagctggaagctgtgggggaagaagtggaaactatgtccagtgaacttttccagtaaatgaagcaagcactaaagtactgtcctgagttgggaacaaagcactgtgggcaaggtcgatgcaatgcctgcactacaggcctgtcttctgtggatctctctccttggccttcagtccctgcagtattttactgtcagatagcatgtggtgcctctacttgtaaatgtcaaatctttgaaataaactattacagataaaaaaaaaaaaaaaa

SEQ ID NO: 14341 - protein, 683 aa, Mus musculus
MLFIFNFLFSPLPTPALICLLTFGTAIFLWLINRPQPVLPLIDLDNQSVGIEGGARRGAFQKNNDLILYYFSDAKTLYENFQRGLAVSDNGPCLGYRKPNQPYKWISYKQVSDRAEYLGSCLLHKGYKSSQDQFVGIFAQNRPEWVISELACYTYSMVAVPLYDTLGTEAIIFVINRADIPVVICDTPQKATMLVENVEKGLTPGLKTIILMDPFDDDLMKRGEKCGVEMLSLHDAENIGKENFKKPVPPKPEDLSVICFTSGTTGDPKGAMLTHENVVSNMAAFLKFLEPIFQPTSDDVTISYLPLAHMFERLVQGILFSCGGKIGFFQGDIRLLPDDMKALKPTVFPTVPRLLNRVYDKVQNEAKTPLKKFLLNLAIISKFNEVKNGIIRRDSLWDKLVFSKIQGSLGGKVRLMITGAAPISTPVLTFFRAAMGCWVFEAYGQTECTGGCSITSPGDWTAGHVGTPVACNFVKLEDVADMNYFSVNNEGEICIKGNNVFKGYLKDPEKTQEVLDKDGWLHTGDIGRWLPNGTLKIVDRKKNIFKLAQGEYIAPEKIENVYSRSRPVLQVFVHGESLRSFLIGVVVPDPDSLPSFAAKIGVKGSFEELCKNQCVKEAILEDLQKIGKEGGLKSFEQVKSIFVHPEPFTIENGLLTPTLKAKRVELAKFFQTQIKSLYESIEE

SEQ ID NO: 14342 - DNA, 2513 bp, Mus musculus
  CDS (83)..(2176)
cccgctgccatttgagcctgcctagccataaaaccttggaggccggtcgtgtggagagattgctctctcacttctggagaagatgcagacccaggagatcctgaggatcctgcggctgcccgagctatcggacttgggccagtttttccgcagcctctcagctaccaccctcgtgagtgtgggtgcactggctgccgtccttgcctactggctcactcaccggccaaaggccttgcaaccaccatgcaacctcctgaagcagtcggaagaagtggaggacggtggtggagcccggcgatctgtgattgggggttgcactcaattgcttacccattactatgacgatgcccggaccatgtaccaggtgttccgccgtgggcttagcatctcagggaatggaccctgtcttggcttccggaagccagagcaaccttaccagtggctgtcctaccaagaggtggccaaaagggctgaatttctggggtcggggcttctccagcacgactgtaaagtgggcacagagcagttcgttggtgtttttgcacaaaatcggccggagtggatcattgccgagctggcctgctacacgtattccatggtggtggtaccgctctacgacaccctgggcccagggtctatcagctacatcatcaatactgcggacatttgcacggtaatcgtcgataaaccccacaaggcaacacttctgctggaacacgtggagaggaaggagactccgggcctcaagctggtcatcctcatggagccgtttgaggacgccctgagagagagaggaaagaagtgcggggtggacatcaagtccatgcaggctatagaggactgtggccgagagaatcatcatgcccccgtgcccccacggcctgatgacctctccatcgtgtgtttcacaagtggtacaacagggaaccccaaaggtgcaatgctcacccacgggaacgtggtggccgatttctcgggctttctgaaagtgacagagaaagtgatctttccgagacaggacgatgtgctcatctccttcctgcctctggctcacatgtttgagagagtgatccagtctgttgtctactgccacggagggcgcgtgggcttcttccagggagacatccgcctcctctcagatgacatgaaggctctccgccctaccatcttccctgtggtcccacggctgctgaatcggatgtatgacaagatcttccaccaggcagacacctcactaaagcgctggctcctggagtttgcagcaaagcgcaagcaggcagaggtccggagcggaatcatcagaaacaatagtatctgggatgaactcttctttaataagattcaggccagtcttggtgggcatgtgaggatgattgtcactggagcagcccccgcgtcaccaacggttctgggattcctacgagcagctctggggtgccaggtctatgaaggttatgggcaaactgaatgcacagctgggtgtaccttcacaacgccaggggactggacatcagggcatgtaggggcacctctgccctgcaaccacatcaagctggtcgatgcagaggaactcaactactggacctgcaaaggagaaggagagatatgtgtgaaaggaccaaatgtgttcaaaggctacttaaaagacgaggacaggacaaaggaggccctggacagcgacggctggcttcacactggagacattgggaaatggctgccggagggaacactcaaaatcattgatcggaaaaagcacatatttaaacttgctcagggggaatatgttgcgccagagaagatcgagaacatctacatccggagtgagcctgtggcacaaatctacgtccacggggacagcttaaaggcctttttggttggcattgtcgtgcctgaccctgaagtcatgccttcctgggctcagaagaaaggaatcgaagggacctatcaggaactctgcatgaaaaaggaattgaagaaagccattctggatgacatggtgatgctggggaaagaaagcggactgcattcttttgaacaggttaaagccatttacatccattgtgacatgttctctgttcaaaatggtctgctgacaccaacactaaaggctaagagaccggagctgagagagtacttcaaaaagcaaatagaagagctttacttagtctccgtgtgaagctccaggagggcccgtctcagtccgatgaactttgcagcaatattatagttattcgtgagagaaaggaatcagaatgccacagctcaaagtgaacaagcacctgatttttgcaactgagcctttcctgacccaagaagtctctaacaatattttctctaccatcaccaagtacactttatttttattaaatgatattgtagcaagctgctaaaaaaaaattatcgcaaacggtaatgtaaaaacaaatcaagacactttctgaagaactgtgtaccactaaaagtaatatattcgcaatgttcacagaattccattaaacaaaaaaaaaaaaaaa

SEQ ID NO: 14343 - protein, 697 aa, Mus musculus
MQTQEILRILRLPELSDLGQFFRSLSATTLVSVGALAAVLAYWLTHRPKALQPPCNLLKQSEEVEDGGGARRSVIGGCTQLLTHYYDDARTMYQVFRRGLSISGNGPCLGFRKPEQPYQWLSYQEVAKRAEFLGSGLLQHDCKVGTEQFVGVFAQNRPEWIIAELACYTYSMVVVPLYDTLGPGSISYIINTADICTVIVDKPHKATLLLEHVERKETPGLKLVILMEPFEDALRERGKKCGVDIKSMQAIEDCGRENHHAPVPPRPDDLSIVCFTSGTTGNPKGAMLTHGNVVADFSGFLKVTEKVIFPRQDDVLISFLPLAHMFERVIQSVVYCHGGRVGFFQGDIRLLSDDMKALRPTIFPVVPRLLNRMYDKIFHQADTSLKRWLLEFAAKRKQAEVRSGIIRNNSIWDELFFNKIQASLGGHVRMIVTGAAPASPTVLGFLRAALGCQVYEGYGQTECTAGCTFTTPGDWTSGHVGAPLPCNHIKLVDAEELNYWTCKGEGEICVKGPNVFKGYLKDEDRTKEALDSDGWLHTGDIGKWLPEGTLKIIDRKKHIFKLAQGEYVAPEKIENIYIRSEPVAQIYVHGDSLKAFLVGIVVPDPEVMPSWAQKKGIEGTYQELCMKKELKKAILDDMVMLGKESGLHSFEQVKAIYIHCDMFSVQNGLLTPTLKAKRPELREYFKKQIEELYLVSV

SEQ ID NO: 14344 - DNA, 2271 bp, Photuris pennsylvanica
  CDS (634)..(2271)
atggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctgaattcggtggtggcggttctggtggcggtggctcttctagaatggaagataaaaatattttatatggacctgaaccatttcatcccttggctgatgggacggctggagaacagatgttttacgcattatctcggtatgcagatatttcaggatgcattgcattgacaaatgctcatacaaaagaaaatgttttatatgaagaatttttaaaattgtcgtgtcgtttagcggaaagttttaaaaagtatggattaaaacaaaacgacacaatagcggtgtgtagtgaaaatggtttgcaatttttccttcctttaattgcatcattgtatcttggaataattgcagcacctgttagtgataaatacattgaacgtgaattaatacacagtcttggtattgtaaaaccacgcataattttttgttccaagaatacttttcaaaaagtactgaatgtaaaatctaaattaaaatatgtagaaactattattatattagacttaaatgaagacttaggaggttatcaatgcctcaacaactttatttctcaaaattccgatattaatcttgacgtaaagaaatttaaaccaaattcttttaatcgagacgatcaggttgcgttggtaatgttttcttctggtacaactggtgtttctaagggagtcatgctaactcacaagaatattgttgcacgattttctcattgcaaagatcctacttttggtaacgcaattaatccaacgacagcaattttaacagtaataccattccaccatggttttggtatgactaccacattaggatactttacttgtggattccgagttgctctaatgcacacgtttgaagaaaaactatttttacaatcattacaagattataaagtggaaagtactttacttgtaccaacattaatggcattttttccaaaaagtgcgttagttgaaaagtacgatttatcgcacttaaaagaaattgcatctggtggcgcacctttatcaaaagaaattggggagatggtgaaaaaacggtttaaattaaactttgtcaggcaagggtatggattaacagaaaccacttcggctgttttaattacaccggacactgacgtcagaccgggatcaactggtaaaatagtaccatttcacgctgttaaagttgtggatcctacaacaggaaaaattttggggccaaatgaaactggagaattgtattttaaaggcgacatgataatgaaaagttattataataatgaagaagctactaaagcaattattaacaaagacggatggttgcgctctggtgatattgcttattatgacaatgatggccatttttatattgtggacaggctgaagtcattaattaaatataaaggttatcaggttgcacctgctgaaattgagggaatactcttacaacacccgtatattgttgatgccggcgttactggtataccggatgaagccgcgggcgagcttccagctgcaggtgttgtagtacagactggaaaatatctaaacgaacaaatcgtacaaaattttgtttccagtcaagtttcaacagccaaatggctacgtggtggggtgaaatttttggatgaaattcccaaaggatcaactggaaaaattgacagaaaagtgttaagacaaatgtttgaaaaacacaaatctaagctgtag

SEQ ID NO: 14345 - protein, 545 aa, Photuris pennsylvanica [sequence omitted]

SEQ ID NO: 14346 - DNA, 2854 bp, Mus musculus
  CDS (72)..(2171)
gtgacagccgcctgtggagcagcccgggcagcggaggagaattctgcatagagaaccaccaacccagaaccatggaagtccatgaattgttccggtattttcgaatgccagagctgattgacattcggcagtacgtgcgcacccttccaaccaacaccctcatggggtttggggcttttgcagcgctcaccaccttctggtatgccaccaggcctaaggccctgaagccaccatgtgacctctccatgcagtcagtggaaatagcgggtaccactgatggtattcgaagatcagcagtccttgaagatgacaagctcttggtgtactactacgacgatgtcagaaccatgtacgatggcttccagagggggattcaggtgtcaaataatggtccttgtttaggttctcggaagccaaaccagccctatgagtggatttcctacaaagaggtggcagaactggctgagtgcataggctccgggctgatccagaaggggttcaagccttgctccgagcagttcatcggcctcttctctcaaaacagacccgagtgggtgatcgtcgagcaaggatgcttctcttactcaatggtggtcgtcccgctctatgacacccttggagctgacgccatcacctacatagtgaacaaagctgaactctctgtgatttttgctgacaagccagaaaaagccaaactcttattagaaggtgtagaaaacaagttaacaccatgccttaaaatcatagtcatcatggactcctacggcagtgatctggtggaacgaggcaagaagtgtggggtggaaatcatcagcctcaaagctctggaggaccttggaagagtgaacagagtgaagcccaagcctccagaacccgaagatcttgcgataatttgtttcacaagtggaactacaggcaaccccaaaggagcaatgatcactcaccaaaacattataaacgactgctcaggttttataaaagcaacagagagtgcattcatcgcttccacagatgatgtgctgatatctttcttgcctctcgcccatatgtttgagaccgttgtagagtgtgtaatgctgtgtcatggagctaagataggatttttccaaggagatatcaggctgcttatggacgacctcaaggtgcttcagcccaccatcttccctgtggttcccaggctgctgaaccggatgttcgacagaatttttggacaagcaaacacttccttgaagcgatggctgttggactttgcctccaaaaggaaagaggcggagcttcgcagtggcatcgtcagaaacaacagcctgtgggataaactcatcttccacaagatacagtcgagcctgggtgggaaagtccggctgatgatcacaggagcagccccggtgtctgccacagtgctgacgtttctgaggacagcgctcggctgccagttctatgaaggctacggacagaccgagtgcactgctggttgctgcctgagcttgcccggagactggacggcaggccatgttggagcccccatgccttgcaattatgtaaagcttgtggatgtggaagaaatgaattacctggcatccaagggcgagggtgaggtgtgtgtgaaaggggcaaatgtgttcaaaggctacttgaaagacccagcaagaacagctgaagccctggataaagatggctggttacacacgggggacattggaaaatggctgccaaatggcaccttgaagattatcgacaggaaaaagcacatatttaaactagcccaaggagagtacatagcaccagaaaagattgaaaatatctacctgcggagtgaagccgtggcccaggtgtttgtccacggagaaagcttgcaggcctttctcatagcagttgtggtacccgacgttgagagcctaccgtcctgggcacagaagagaggcttacaagggtccttcgaagaactgtgcaggaacaaggatatcaataaagctatcctggacgacttgttgaaacttgggaaggaagccggtctgaagccatttgaacaggtcaaaggcattgctgtgcacccggaattattttctattgacaacggccttctgactccaacactgaaggcgaagaggccagagctacggaactatttcaggtcgcagatagatgaactgtacgccaccatcaagatctaacgtgaggaaggatacttagaagaaatggcgcatctccacaatcctcctcgtaccaatggccttcgagttggtaactttgcctgcagcgagtgtgggaaaggaaatgccctgccgccggacttgtccacggggtcttaccatagggatagtcgagggcacggaacactgccttacttacagtcacctgtgttgcagcccatgatcccggggacacacaatttccaaaacgagccttaaacattgtaaaggggaacccataaaagtgctaagttatttaagacttcttcaaccaataaggtggatgctacaagttctgtctcctgtttttctaactgaggggttaggacttattctttctgatatgtctgctgcttgctgcgcgttttgcagctgtctgctgctctgaagagcaccgtacactggaggaaagctgtccctttaagaacaactgtccaggctgaagaaagtcacagtggaccagaggttttccttttgaacccctcctcccccttgcccctttccctcaccacctcacatacagtacactcacatgacctttctggtttgtaagggttccacacggtccctgtttgcgcctgctggaacatgaggttttcagtaaactaaagagcagaccctcttcagaacatgtgggtgtccagtctcagaaaaaaaaaaaaaaa

SEQ ID NO: 14347 - protein, 699 aa, Mus musculus
MEVHELFRYFRMPELIDIRQYVRTLPTNTLMGFGAFAALTTFWYATRPKALKPPCDLSMQSVEIAGTTDGIRRSAVLEDDKLLVYYYDDVRTMYDGFQRGIQVSNNGPCLGSRKPNQPYEWISYKEVAELAECIGSGLIQKGFKPCSEQFIGLFSQNRPEWVIVEQGCFSYSMVVVPLYDTLGADAITYIVNKAELSVIFADKPEKAKLLLEGVENKLTPCLKIIVIMDSYGSDLVERGKKCGVEIISLKALEDLGRVNRVKPKPPEPEDLAIICFTSGTTGNPKGAMITHQNIINDCSGFIKATESAFIASTDDVLISFLPLAHMFETVVECVMLCHGAKIGFFQGDIRLLMDDLKVLQPTIFPVVPRLLNRMFDRIFGQANTSLKRWLLDFASKRKEAELRSGIVRNNSLWDKLIFHKIQSSLGGKVRLMITGAAPVSATVLTFLRTALGCQFYEGYGQTECTAGCCLSLPGDWTAGHVGAPMPCNYVKLVDVEEMNYLASKGEGEVCVKGANVFKGYLKDPARTAEALDKDGWLHTGDIGKWLPNGTLKIIDRKKHIFKLAQGEYIAPEKIENIYLRSEAVAQVFVHGESLQAFLIAVVVPDVESLPSWAQKRGLQGSFEELCRNKDINKAILDDLLKLGKEAGLKPFEQVKGIAVHPELFSIDNGLLTPTLKAKRPELRNYFRSQIDELYATIKI

SEQ ID NO: 14348 - DNA, 3863 bp, Brachydanio rerio
  CDS (211)..(2331)
attgcgcttggcaagcagagacacgaatgcccgatccggctgaggaggaaagagactaaaagccggttgcacattttggagtcgcatattagacacttctagaatctttttgaactttgacccaaggcaacaatcttagtgtatctcaggctctgcctgacccttcatccttcagtcccctccagcttctcagcagacgtgcgtctgaacatggacctcagtgccgttctcttgtttccagtacatgcagtagtgtggctctactccctcttgagctttctgccatggtactttctgacaggagcccaggaaaagaaagccttggcaaagaggctcaaatccaagtcaaccagcgatcaaccggatggaccatatcgctccacggatcgcttcgagtccctggtcacagtggacttccctggaaaagacacccttgataagctgtttgactatgcagtagagcgttttggtaaattagactgccttggaacccgagaagttctgagtggagacaatgagactcagccaaatggaaaagtcttcaaaaagttgattcttggtgaatataaatggaagtcctatgaggagttagacattgaagtcagtcattttgggagcggactggcagcactaggacaacagccaaaaagcaccattgccattttctgtgagacgcgggctgaatggatgatcaccgctcaagcctgcttcagacgcaacttccccttggtcaccttttatgcgactcttggagaagacgcagtggcttatggattgaatgagtctggagttacacacctggtcaccagtatagaattgctggaaacaaaactaaagagtgttcttcttcaaattcccaatttaaagcacatcatctatgtggacagtaagagcatgaacacagcaggatttccacagggcatccagatccacagcatgcactcagttgaagagctgggagccaagccagaaaacttgaatagaccaatagtgaagcccgtcccatcagatcttgctgttattatgtacaccagcggctccaccgggagacctaaaggggtgatgatcatccacagtaacctgattggaggcatggcaggccagtgtgagaggatacctgggttgggaccgaaggatacatatattgcttatcttcctcttgctcatgtgctggaaatgacggctgagatctcatgtgtgacatacggctgcagaatcggctattcttcaccacaaaccctgtctgatcaatcaaccaaaattaaaaagggaagtaaaggggactgcagcgtactgaaaccttcccttatggccgctgtacctgaaataatggaccgcatcaataaaaacgtgatgagtaaagtgcaagagatgagctgtgtgcagagaaccttgttcaagccggcctacgactataagctcgagcagatcaagaagggttacgatgcgccgctctgcaatatcttgtttaagaaagtccgagctctgctgggtggaaatgtgcgaatgatgttgtctggaggagctcctctgtctcctgctactcagcgcttcatgaacatctgtttctgctgtcctgttggtcagggatatggtttaacggagacctgtggagcaggcactatcaccgaagttgcagactacagcacaggacgagtaggagctcctctgatctgctgtgaggtcaaactcaaagactgggcagaaggtggttatacaaagcgtgacaagcctcatccgcgtggcgagatcctcatcggtggccctaatgtgactatgggctactacaggactgaaggctgtaataatgacgacttctttgtcgatcagaatggccagcggtggttctgcactggcgatataggagagatgcatgctgacggctgtctacagattgttgaccgcaagaaggatcttgtaaaacttcaagctggagagtacgtctctttgggcaaagttgagtcagcgctgaagaactgctctttcgttgacaacatctgcgcttacgcaaacagtgaccagaactacgttatcagcttcattgttcctaatcagaagaaactgactgctcttgccaatcagaaaggcattgaaggcacgtgggaagaaatctgtaaccacccagttatggaaagggaagttctgagagaaattaaagaagtcgcaaattcaattaaactccagcgcttcgagattcctgtcatggtccatttgagtccggagccgtggacacctgaaaccggcctggtgacagatgcattcaaactgaagaggaaagagctaaagaaccactatctcaacgacatcgaaagaatgtatggccacaagtaggacccctataacagcagccaaagacatcttcatcagctcctcgccatgcaacattgctgtatatcaataaatgtaaaacaaacatttgccacaattttcaccaccgcccactgcttagtgacgcacacagctctcaattgctgttgatctgtgtacattttttactcctgagcattgtgggcttcgtagtctctctgctgtgaaatagtttacaattaaagttgtagctgattagatggggatgttgttgggtaagggatgattttaatgagtcgtttttccttttagcacactcttgtaaaaagaatttcaaccatacaacagcgatgtactgccatcacctgtgctcatttcaatacgtgtgaatctttcgttcacttgctttgtttgatagcatttgtacactgaatccgctagccgaggtgaagtctttgcactgcaaaactaatatatagtgatgtttctgtgccttctgattggtcactgtattaaacgttaattccctactgactataagttagaagtagattcctgtgcttcacccatgcagtgcattaatagtcgttatttacttgagatttctttttaaagcaagtttttctcactgaactacaatgttctgagttctagttttaggaattcacacatttactagtcagtcttactcttactcatggagtgactcaggatgtttcagatgactggcaggtggtttgtttgctagtatttttgatgtcagttagattgaaattgaatgaagggaacattttttatgaacaaattccttcttaagccacagatgtaaagtttgtattacatctgtctaatctcttcacgtctgatcttttttaaaaccactcagtttagcgattgtcacaagctttttttatgttgaatattccacttttgcaggcttttaataatatttggtaatacgtcaacatgtcagattgcaatgctttgtgtatgaagttgaaaagacaggaaaaaaaagtaattgtttgaaaaaagaaacattagaaaatgaatttttctccctctataaatgtaaaggaagtgaggttgagcttttgtccgtcagtttatattgtatactgtattttaatttatttggtcaaaactacatttcatttgaacccttgtttaatttatttgattctaaaggggtgtgatctgtataaacactgtaatttcttacattttggattaccaaatgtttcattctgggatgtgcgttttatttatgatgattttgtcatttgcactattatttgtgttcagggatttttagccattgttaaattaacagccatcaaattcaaacaattcagcagatattttcccctcacgaccctcagggttaccgtcaccataagcaagaatatacagcagtcaagtgtttgcgttgagaaattgtgaatttgcttgtagaatgttctatgatgcttatttattatttttattgtgtgttgctgtatgtattatgtgctgaggacaagtaaaataattttgtactcaaaaaaaaaaaaaaa

SEQ ID NO: 14349 - protein, 706 aa, Brachydanio rerio
MDLSAVLLFPVHAVVWLYSLLSFLPWYFLTGAQEKKALAKRLKSKSTSDQPDGPYRSTDRFESLVTVDFPGKDTLDKLFDYAVERFGKLDCLGTREVLSGDNETQPNGKVFKKLILGEYKWKSYEELDIEVSHFGSGLAALGQQPKSTIAIFCETRAEWMITAQACFRRNFPLVTFYATLGEDAVAYGLNESGVTHLVTSIELLETKLKSVLLQIPNLKHIIYVDSKSMNTAGFPQGIQIHSMHSVEELGAKPENLNRPIVKPVPSDLAVIMYTSGSTGRPKGVMIIHSNLIGGMAGQCERIPGLGPKDTYIAYLPLAHVLEMTAEISCVTYGCRIGYSSPQTLSDQSTKIKKGSKGDCSVLKPSLMAAVPEIMDRINKNVMSKVQEMSCVQRTLFKPAYDYKLEQIKKGYDAPLCNILFKKVRALLGGNVRMMLSGGAPLSPATQRFMNICFCCPVGQGYGLTETCGAGTITEVADYSTGRVGAPLICCEVKLKDWAEGGYTKRDKPHPRGEILIGGPNVTMGYYRTEGCNNDDFFVDQNGQRWFCTGDIGEMHADGCLQIVDRKKDLVKLQAGEYVSLGKVESALKNCSFVDNICAYANSDQNYVISFIVPNQKKLTALANQKGIEGTWEEICNHPVMEREVLREIKEVANSIKLQRFEIPVMVHLSPEPWTPETGLVTDAFKLKRKELKNHYLNDIERMYGHK

SEQ ID NO: 14350 - DNA, 2136 bp, Mus musculus
  CDS (1)..(2136)
atgaaccttaagctaaatgtgctcaccattatattgctgcctgtccacttgttaataacaatatacagtgcccttatatttattccatggtattttcttaccaatgccaagaagaaaaacgctatggcaaagagaataaaagctaagcccacttcagacaaacctggaagtccatatcgctctgtcacacacttcgactcactagctgtcatagacatccctggagcagatactctggataaattatttgaccatgctgtagccaaatttgggaagaaggacagccttggaacccgggagatcctgagtgaagaaaatgaaatgcagccaaatggaaaggtttttaagaagttaattcttgggaattataaatggataaactatcttgaagtgaactgcagagtgaataactttggaagtggcctcactgcattgggactgaaaccaaagaacaccattgccattttctgtgagaccagggcagagtggatgattgcagcacagacttgctttaagtacaactttccacttgtgactttatatgccacacttggcagagaagctgtagttcatggattaaatgaatctgaggcttcctatctgattactagtgttgagcttctggaaagcaaactgaaggcggccttagtagatatcaattgtgttaaacatatcatttatgtggataataagactatcaatagagcagagtaccctgaggggcttgaaattcacagcatgcaatcagtagaggagctgggagccaagccagaaaacttgagcgttcctccaagtagaccaaccccttcagacatggccattgtcatgtacaccagtggttctacgggccgccccaagggagtgatgatgcatcatagcaatttgattgctggaatgacaggccagtgtgaacgtatccctggactaggaccgaaggacacatatattggctacttacctttggctcatgtgctggaactgacagcagagatatcatgctttacctatggctgtaggattggatactcttcaccccttacactgtctgaccagtccagcaaaatcaagaagggaagcaagggtgattgtactgtactgaaacccacacttatggccgctgttccggaaatcatggatagaatttataagaatgttatgagcaaggttcaagagatgaattatgttcagaaaactctatttaaaatcgggtatgattacaaattagagcaaatcaagaaaggctatgacgcccctctttgtaatctgatactgtttaaaaaggtgaaggctctgctgggagggaatgtccgcatgatgctgtctggcggcgcgccactgtcccctcagacacaccgattcatgaatgtctgcttctgctgccccattggtcagggatatgggctgacagaatcatgtggtgctggaacagttactgaagttactgactacactactggaagagttggagctcctcttatttgctgtgaaattaaactgaaagactggcaggaaggtggttatacagttcatgataagccgaaccccagaggtgagattgtgatcggtggccagaatatctccatgggatattttaaaaacgaagagaaaacagcagaagattattgtgttgatgaaaatggacaaaggtggttttgcactggcgatattggagaattccatcctgatggatgcttacagattatagatcgtaagaaagatctggtaaagttacaagcaggagaatatgtatctcttgggaaagtagaagctgcactgaagaattgtccactgatcgacaacatctgtgcttttgccaaaagtgaccagtcctatgtgatcagttttgtggttcctaaccagaaaaagttgactcttttggcacaacagaagggggtagaaggatcttgggttgatatttgcaataatcccgccatggaagctgaaatactgaaagaaattcgagaagctgcaaatgccatgaaattggagcgatttgaaattccgatcaaggttcggttaagcccagagccatggacccccgagactggtttggtaacagatgccttcaagctgaaaaggaaggagttgaagaaccattatctcaaagacattgagcgaatgtatgggggcaaataa

SEQ ID NO: 14351 - protein, 711 aa, Mus musculus
MNLKLNVLTIILLPVHLLITIYSALIFIPWYFLTNAKKKNAMAKRIKAKPTSDKPGSPYRSVTHFDSLAVIDIPGADTLDKLFDHAVAKFGKKDSLGTREILSEENEMQPNGKVFKKLILGNYKWINYLEVNCRVNNFGSGLTALGLKPKNTIAIFCETRAEWMIAAQTCFKYNFPLVTLYATLGREAVVHGLNESEASYLITSVELLESKLKAALVDINCVKHIIYVDNKTINRAEYPEGLEIHSMQSVEELGAKPENLSVPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYVQKTLFKIGYDYKLEQIKKGYDAPLCNLILFKKVKALLGGNVRMMLSGGAPLSPQTHRFMNVCFCCPIGQGYGLTESCGAGTVTEVTDYTTGRVGAPLICCEIKLKDWQEGGYTVHDKPNPRGEIVIGGQNISMGYFKNEEKTAEDYCVDENGQRWFCTGDIGEFHPDGCLQIIDRKKDLVKLQAGEYVSLGKVEAALKNCPLIDNICAFAKSDQSYVISFVVPNQKKLTLLAQQKGVEGSWVDICNNPAMEAEILKEIREAANAMKLERFEIPIKVRLSPEPWTPETGLVTDAFKLKRKELKNHYLKDIERMYGGK

SEQ ID NO: 14352 - DNA, 24 bp, Primer
atggttgctcaatataccgttcca

SEQ ID NO: 14353 - DNA, 25 bp, Primer
ttaagacgaactataaacggcgtca

SEQ ID NO: 14354 - DNA, 354 bp, Saccharomyces cerevisiae
  CDS (1)..(354)
atgggtgtgggtggaacgaggattgtatcgtttagacagccgaattattacccggttactcaacaaaaaggggcaagccagacaggtgcagtggctcagccgtacagctcgtactgtggtttgctaatgcgctgggcggttgttgagataagaagaagagggaaagggaaaggaagaaagaggaagagagagagagagaaagggcacacgaaattcaggatacggcggaggagttatctttattttatacggtcttgccttgtaaggccctactcaagcgggaacaagaaaaacagttgtagcttccacaagatgttggctatagagattgttctgtgcttaaaggctcgctaa

SEQ ID NO: 14355 - protein, 117 aa, Saccharomyces cerevisiae
MGVGGTRIVSFRQPNYYPVTQQKGASQTGAVAQPYSSYCGLLMRWAVVEIRRRGKGKGRKRKREREKGHTKFRIRRRSYLYFIRSCLVRPYSSGNKKNSCSFHKMLAIEIVLCLKAR

SEQ ID NO: 14356 - DNA, 23 bp, Primer
atggcggttgcgatcaaaaagga

SEQ ID NO: 14357 - DNA, 28 bp, Primer
tcaattgataaatgtactttcaatgatg

SEQ ID NO: 14358 - DNA, 1110 bp, Saccharomyces cerevisiae
  CDS (1)..(1110)
atgaatcagagcgatagcagcttgatggatttaccactggagatacatttatcattactagagtacgtgcctaatgaacttcgtgctgtcaataaatacttctacgttttgcataaccacagctataaggagaagagtttggcgtggatagctgaggacaactatatatgggccgttgtcaaacattcattatgtttatatgtcaagagtttggacccacttcgacagcatgccagagaaatcattcaagaaacgaaggaaccaggttttaatgtgccactgtgcatgactaaatacatcgcagattcttggtatattgtatacaatgcgctgcaatatcctggaaagataattaatatgggatgggacaaatataccaaaagtcaagattcaaatggttctgattctaccagtaactttaatagtcggcccaaggaaagaactcttatgcagtcgttgacagctttacctgttaacttttggtccaggaggaaggacgagcctacaccggtaaacgtttggttttatgtaaaaaatgcgcacgttgccagatacataccgaaaattattacggaaataggcatatgcaactatgggccgaagcagatcgtggcaagtgcaggatatatcaacgaattgataacatctgaaggaatatactgtgttaacctaggccaccttcccaggctatacgatgagcaaatttttgaaggcactggaacgacacatcttcccctggaactgaaagctatcgacaggacagattcagatgtttgtatcaatggtgatttagttctactcggttatgactttattccatatcagatatcgaagccgtggttactctttagaatcgaacccgtaaatagcattgaagcaatcttcaactatagtgaatgttctttttcataccagtttgcatggagtttggcctgcttacaatctgaagagaaaatttcatttcctagagacacgataattgggcacggtttaccttacaagccatccaaattgataagaattttcgtctacaagcatccggaacaaaagcaagatcttggtcaagaaatagcattgcccaactggaataccccttatcttcgaagatga

SEQ ID NO: 14359 - protein, 369 aa, Saccharomyces cerevisiae
MNQSDSSLMDLPLEIHLSLLEYVPNELRAVNKYFYVLHNHSYKEKSLAWIAEDNYIWAVVKHSLCLYVKSLDPLRQHAREIIQETKEPGFNVPLCMTKYIADSWYIVYNALQYPGKIINMGWDKYTKSQDSNGSDSTSNFNSRPKERTLMQSLTALPVNFWSRRKDEPTPVNVWFYVKNAHVARYIPKIITEIGICNYGPKQIVASAGYINELITSEGIYCVNLGHLPRLYDEQIFEGTGTTHLPLELKAIDRTDSDVCINGDLVLLGYDFIPYQISKPWLLFRIEPVNSIEAIFNYSECSFSYQFAWSLACLQSEEKISFPRDTIIGHGLPYKPSKLIRIFVYKHPEQKQDLGQEIALPNWNTPYLRR

SEQ ID NO: 14360 - DNA, 948 bp, Candida glabrata
  CDS (1)..(948)
atgaatctcccaatagaaattacactgcgaattatagatcaatatccctgccaaataagaactcttaacacatattaccataggctagtcaatgatatttactattccaaatgtgagccctatctagttcgattgtcttatgaaactaaaaatgcattaatatcatatgtgagaagtatggatagctggaggaaggagagtagaaagcttctagccactgaccgccttccacttggcaatcatgaatatctcaatgactcttggttcatcatatacaatatcctgatatgtggtattgtaaagccagtcaactattgcattgctagttcgggatcaatacaattaatcagtcctctttcacataaactttcattgtctgtggccgcaatactacccgggagttatacagtttatgcctatttcaaaatacggcaaagaacctcattaagatatatcccaaaagtttgtactgcaattgataaaaaccatacactttcagcacctattaatattcatgaactgatatattctgattatggagatgaagttaatggcatattccttgtcagactaggccagcataaagtgagtgagcttgatacacctgcgataatacttgagtcatatttcgaagatacccatcttcagaacaagattctagaaaacaaggagatcgagatactaggatacaagctctgtttattcaagcatggatctggtttactagcaaggaaagtatgcttgtcagaagaaatgatcccttttaattactgggaacaaatatactgcttatctttaatgagaaaaaggttacaaaacgagtcacatagagatcacatatcctatgaatataataaggaagtactttctgtattaagaaaaaggctgcgctgtggggtgtatggcattagttttactgaacggagacctacaaaagatttggattag

SEQ ID NO: 14361 - protein, 315 aa, Candida glabrata
MNLPIEITLRIIDQYPCQIRTLNTYYHRLVNDIYYSKCEPYLVRLSYETKNALISYVRSMDSWRKESRKLLATDRLPLGNHEYLNDSWFIIYNILICGIVKPVNYCIASSGSIQLISPLSHKLSLSVAAILPGSYTVYAYFKIRQRTSLRYIPKVCTAIDKNHTLSAPINIHELIYSDYGDEVNGIFLVRLGQHKVSELDTPAIILESYFEDTHLQNKILENKEIEILGYKLCLFKHGSGLLARKVCLSEEMIPFNYWEQIYCLSLMRKRLQNESHRDHISYEYNKEVLSVLRKRLRCGVYGISFTERRPTKDLD

SEQ ID NO: 14362 - DNA, 24 bp, Primer
atgaatcagagcgatagcagcttg

SEQ ID NO: 14363 - DNA, 25 bp, Primer
tcatcttcgaagataaggggtattc

SEQ ID NO: 14364 - DNA, 1098 bp, Saccharomyces cerevisiae
  CDS (1)..(1098)
atggctcaaaattttggaaagattccttctcacaagtcttacgtattgagcttatatcggaccgttctcagaaacattccaaagtgttgccactcatatgcgtttcaatatgaaataaaaaaaacactttcaatacaattgttcaaacacaagcatgacaagtcaagttggagtgtttatactttactcaatgaattcagtttgttgaacaattgccttttggaaggtaaattacaagaaatcaaaaacttaatgaagccattaaaaaagatgaaaaaacaactgaaaacaacgaaaatcctcaactctttgacttcattaggggatgtaaagaccaacgacccagaagaagtaagaagatttcatgttctaagtgcttacattaagcgaaaacaagatttgggccttttacctgcatacataccaaaaacgtatcagcacaaactcctattaccattagcattgaacgaacatgcgtgcctgaaactatttcatattcagcaaaaattgaaaaatggcccaccttctgctgggctgtcatatacaaaagaaggaaggaatcaaatatggtttgttcggtcaccaattaacaagggcagacaacaatcgaaaaagctgggaatattgatacgaaaagaaaggaaggattctcagaaaaatatcgataatctcaatttttgcgaaattaatgctgcttgggcattacatgaggccatttgggaggaatatctagagtcgaaaaagattattaaagtaaacttaccgaaatacttggaatacgctgcaaatatcccaaagtctactaaatgtaatccttcgagtcaatatcagaaagttaaagaatgggtagatcccgtgagagaaataatgttcgaattacattccaaaagttttcaaagagtggagtactttaacaaatataaggaaaagcttttaaagaacggtggccaactagcatattttgataaaaagtcaaaagaaatgtacgccaaacggttgacactattcagaaaaatgagcaaagaaacattaccatatgtgacactctttatagaagggagggacttgccaagtgttttggcgaaatacggtttttaa

SEQ ID NO: 14365 - protein, 365 aa, Saccharomyces cerevisiae
MAQNFGKIPSHKSYVLSLYRTVLRNIPKCCHSYAFQYEIKKTLSIQLFKHKHDKSSWSVYTLLNEFSLLNNCLLEGKLQEIKNLMKPLKKMKKQLKTTKILNSLTSLGDVKTNDPEEVRRFHVLSAYIKRKQDLGLLPAYIPKTYQHKLLLPLALNEHACLKLFHIQQKLKNGPPSAGLSYTKEGRNQIWFVRSPINKGRQQSKKLGILIRKERKDSQKNIDNLNFCEINAAWALHEAIWEEYLESKKIIKVNLPKYLEYAANIPKSTKCNPSSQYQKVKEWVDPVREIMFELHSKSFQRVEYFNKYKEKLLKNGGQLAYFDKKSKEMYAKRLTLFRKMSKETLPYVTLFIEGRDLPSVLAKYGF

SEQ ID NO: 14366 - DNA, 1134 bp, Candida glabrata
  CDS (1)..(1134)
atgattacacatttctgtgagttagcagctcatagaaactatgtgttggccctgtatagacactctttgcggaatgtctccagaataaattccggttttgtgaagcataaaatgaagaaggttataactaatgaagcccgaaaacacaagaatgataagtccagctggtctatatacagaagacttaaggagctaaagttattaagtgacaagctagaggatgatcaagtaaatgacgcctataatttgctggatagcttcatgaaatctgttaagaagcccaaaaatgagttgaaaggccatttaatgaagataagaactgagattgaaactaacaaaaacatacaagataagaccaggttgacaaggttaaatttattacatcgatatatcgcaaagaaacaacaaaatcaattgctaactaagcatattccagatgaatacaaagaaaagttacttctaccgttagccttgcatgaaaaaggtatacttcgattggcagctataaggaaccagttcaagaagggaggatatcacgcaaagctttcattcacgatggcgggcaaaaccaggatttggtttattagatcaatgctcaacaagaggaagaaacagtccttgcgcctacgaaatctaattacctcggaaaagaggaggtacttggaagtgtgtaaaatagtagaatcattgaatgaaaatgcaaattgggctcttcatgaagctatatgggaacgttatttagatgatggctatctacatgcaacatcttcaaaaggctatttgaaaatggtggaaatcgaagataatagcgttaaattgcaaaaccaaaacgattccaaagtggtaaaatgtcaacgtctccaacaatggctaagtccaatacagtcttctatactaagtttggaaaactatttgaaccaaagacagatgaaatatgctaagctaaagacaaaaatcctggaacctaaaggtgtctatgactactatcaaaaaaaatccaagcgtgtcttccaaaatcatatgaaaacatataaaagaatggttaaaaacgagctcccgtttgtcaatcccttcattgaaaggctgtcaataggctcaatactgaaaagaaatgggattaatgtaaaatactga

SEQ ID NO: 14367 - protein, 377 aa, Candida glabrata
MITHFCELAAHRNYVLALYRHSLRNVSRINSGFVKHKMKKVITNEARKHKNDKSSWSIYRRLKELKLLSDKLEDDQVNDAYNLLDSFMKSVKKPKNELKGHLMKIRTEIETNKNIQDKTRLTRLNLLHRYIAKKQQNQLLTKHIPDEYKEKLLLPLALHEKGILRLAAIRNQFKKGGYHAKLSFTMAGKTRIWFIRSMLNKRKKQSLRLRNLITSEKRRYLEVCKIVESLNENANWALHEAIWERYLDDGYLHATSSKGYLKMVEIEDNSVKLQNQNDSKVVKCQRLQQWLSPIQSSILSLENYLNQRQMKYAKLKTKILEPKGVYDYYQKKSKRVFQNHMKTYKRMVKNELPFVNPFIERLSIGSILKRNGINVKY

SEQ ID NO: 14368 - DNA, 1095 bp, Ashbya gossypii
  CDS (1)..(1095)
atgtcatctttatatgaaaaagcttctgacttcgacacagcgactcttcagacacgcatggtccaaccttttactcgctatgccgcccataggcatctagtgttgagttggtatcgatatacactccgaattacaaattatgtaccgatatccaatctcttgagaagacagacccgtgaagtagttagggaaacgatactcaaacatcgaggtacacagtctagctggaaggttttacagcttttggaggatatgaagcagttaaatagtcacctcgcagtagcgaaggcggtaggcgcatggcagataatccagaagtacgctgcaaaaccgacaccacaggaagagcggctgcccatgccagcaaagcattacaatgatccctctaaggataaagaagcacattactactggcgctaccatcgagacctaacgagaaaacatctcctaccagcagtcataccaaatgactacatggagaagctcattgcccctcttgcgcggcatgcctccgacctcaggacacttggcatcgtccagcgcaacatccagcgctctcctaaagcataccttagctacactatggtgggcagtgatcgactgtggttcgtgcgttcagctgtcaacaggaagaagcggcagtcccgaaggctcacggctatgatcgtcgcgttgcgcagggctgcccaacgaagccttgacatgtcaaaccgcttgaaagaagaggtgatatgggccacccacgaggccaagtgggagcaactgctcgctactgggacccttcccccagatggggccaaaagcgactggaagcctggccgagcatggctggaaccatatgaggccgcgtttcggaaccagcttgcaaatcgcaagcgcacgagccagaagctcaagcgctatagtgcccaaatcagcaaggtacacctcccgtattacattaagtgcagtgctgctatgcatacccgtcgcgccaaacgcttcgagtgtttccagaaagagctccacaccgttaatccattcgttccaggcagagatctcggttccctactctccaagtggcgaatggtgaacggtaaaaactactatcgctga

SEQ ID NO: 14369 - protein, 364 aa, Ashbya gossypii
MSSLYEKASDFDTATLQTRMVQPFTRYAAHRHLVLSWYRYTLRITNYVPISNLLRRQTREVVRETILKHRGTQSSWKVLQLLEDMKQLNSHLAVAKAVGAWQIIQKYAAKPTPQEERLPMPAKHYNDPSKDKEAHYYWRYHRDLTRKHLLPAVIPNDYMEKLIAPLARHASDLRTLGIVQRNIQRSPKAYLSYTMVGSDRLWFVRSAVNRKKRQSRRLTAMIVALRRAAQRSLDMSNRLKEEVIWATHEAKWEQLLATGTLPPDGAKSDWKPGRAWLEPYEAAFRNQLANRKRTSQKLKRYSAQISKVHLPYYIKCSAAMHTRRAKRFECFQKELHTVNPFVPGRDLGSLLSKWRMVNGKNYYR

SEQ ID NO: 14370 - DNA, 26 bp, Primer
atggctcaaaattttggaaagattcc

SEQ ID NO: 14371 - DNA, 26 bp, Primer
ttaaaaaccgtatttcgccaaaacac

SEQ ID NO: 14372 - DNA, 1296 bp, Escherichia coli K12
  CDS (1)..(1296)
atggttagtttagagaagaacgatcacttaatgttggcgcgccagctgccattgaaatctgttgccctgatactggcgggaggacgtggtacccgcctgaaggatttaaccaataagcgagcaaaaccggccgtacacttcggcggtaagttccgcattatcgactttgcgctgtctaactgcatcaactccgggatccgtcgtatgggcgtgatcacccagtaccagtcccacactctggtgcagcacattcagcgcggctggtcattcttcaatgaagaaatgaacgagtttgtcgatctgctgccagcacagcagagaatgaaaggggaaaactggtatcgcggcaccgcagatgcggtcacccaaaacctcgacattatccgccgttataaagcggaatacgtggtgatcctggcgggcgaccatatctacaagcaagactactcgcgtatgcttatcgatcacgtcgaaaaaggcgcacgttgcaccgttgcttgtatgccagtaccgattgaagaagcctccgcatttggcgttatggcggttgatgagaacgataaaattatcgaattcgttgaaaaacctgctaacccgccgtcaatgccgaacgatccgagcaaatctctggcgagtatgggtatctacgtctttgacgccgactatctgtatgaactgctggaagaagacgatcgcgatgagaactccagccacgactttggcaaagatttgattcccaagatcaccgaagccggtctggcctatgcgcacccgttcccgctctcttgcgtacaatccgacccggatgccgagccgtactggcgcgatgtgggtacgctggaagcttactggaaagcgaacctcgatctggcctctgtggtgccggaactggatatgtacgatcgcaattggccaattcgcacctacaatgaatcattaccgccagcgaaattcgtgcaggatcgctccggtagccacgggatgacccttaactcactggtttccggcggttgtgtgatctccggttcggtggtggtgcagtccgttctgttctcgcgcgttcgcgtgaattcattctgcaacattgattccgccgtattgttaccggaagtatgggtaggtcgctcgtgccgtctgcgccgctgcgtcatcgatcgtgcttgtgttattccggaaggcatggtgattggtgaaaacgcagaggaagatgcacgtcgtttctatcgttcagaagaaggcatcgtgctggtaacgcgcgaaatgctacggaagttagggcataaacaggagcgataa

SEQ ID NO: 14373 - protein, 431 aa, Escherichia coli K12
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 14374 - DNA, 1664 bp, Oryza sativa (rice)
  CDS (28)..(1479)
tttgtaattctttaatttgttgcaaccatgaatgtgttggcatctaagatcttcccttcccgctccaatgttgttagcgagcaacaacaatcgaagcgcgagaaagcaactattgatgacgctaagaactcgtccaagaacaaaaatcttgaccgcagtgtcgatgagagtgtgcttggaatcattcttggaggtggtgcagggactagattgtatcccctcaccaagaagcgtgccaagcctgccgtgcctctgggtgccaactacaggcttattgatatccctgtcagcaactgtttgaacagcaacatatccaagatctatgtgctgacacaattcaactctgcctctccgaaccgtcacctgtcaagagcctatgggaacaacattggcgggtacaagaatgaagggttcgttgaagtcctcgctgcacagcagagcccagataatcctaactggtttcagggtactgcagatgctgtaagacagtacttatggctatttgaggagcataatgttatggagtttctaattctggctggagatcacctttaccgcatggactatgaaaagttcattcaggcacacagagaaacagattctgatattactgttgctgccctgccaatggatgagaaacgtgcaactgcattcggcctcatgaaaattgacgaggaagggagaatagttgaatttgcagagaaaccaaaaggagaacaattgaaagcaatgatggttgacactaccatactcggccttgacgacgtgagggcaaaggaaatgccttatattgctagcatgggtatctatgtgattagtaaaaatgtaatgcttcagctcctccgtgaacaatttcctggagctaatgactttggaagtgaagtcattccaggtgcaacaaacatcggaatgagggtacaagcttacttgtatgatggttactgggaagacattggtaccattgaggcattctataatgcaaatctgggaataacgaaaaagcctgtaccagatttcagtttctatgaccggtctgctccaatttatacacaacctcgacacttgcctccttcgaaggttcttgatgctgatgtgacagacagtgtcattggtgaagggtgtgttattaaaaactgtaagatacaccattcagtagttggactccggtcctgcatttctgaaggcgcaataatagaggactcattactcatgggagctgactactacgagactgaagcagacaagaaactccttggtgaaaaaggtggcattcccattggtattgggaagaattgccacattagaagggcaatcatcgacaagaatgctcgtattggagataatgtgaagataatcaatgttgacaatgtccaagaagctgcaagagagactgatggatacttcatcaaaagtggcattgttaccgtgatcaaggatgctttgctcctagcggaacagttatatgaagtagctgcgtaatatatgatggggcatcggcgacgagcaccaggcgggcattataagaagaataaaagcagttcaaggctctttattccctttttttttcttctgttcttcctctattgttttaggataaatgtaatggtagaagcaactgcttttcagatgttttgggagtgaatgataccgtgcttgaattttcc

SEQ ID NO: 14375 - protein, 483 aa, Oryza sativa (rice)
MNVLASKIFPSRSNVVSEQQQSKREKATIDDAKNSSKNKNLDRSVDESVLGIILGGGAGTRLYPLTKKRAKPAVPLGANYRLIDIPVSNCLNSNISKIYVLTQFNSASPNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLLAEQLYEVAA

SEQ ID NO: 14376 - DNA, 2496 bp, Aquifex aeolicus
  CDS (1)..(2496)
atgaaaggtgtaatccttgcgggaggatttggaactaggattcaaccccttacaaacagcattcccaaacccatgcttcccgtcgcaaacagacccataatggaacatgtagtacacaggctaaaggaggcgggaatagaagaaatagtcgttctcctttactatcaggctgaagttataaagaactactttaaggacggaagtgattttggagtaaagataacctacgtccaacccgaagcagactacggaacggcgggggcggtaaagcaggcacaaaattaccttaacgagacattcataatagtaagcggtgacgtaataacggacttcaacctttccgagttaatagcctttcataaaagcaagtcttcaaagtttaccttggcactttacagtgttgagaatccccttcagtttggagttgtgataactaacaaagaagggaaagttttgaaattccttgaaaaacccggctggggtgaggtgtttagcgataccgtaaacacgggcatatacgtagtggaacccgaaatcctgaactacatacccgaagacaaaccctttgactttgccatggacctcttccccaagctaatgaagagcgggattgatttgtgggctttaaagatgaggggatactggagggacatagggaatatagattcatacagggatgtccacaaggatatatttgcgggactcgtaaagataagaattcctggaaggataattacgacgaaagaagcgaggatttacgtagaagaaggaacggaaattcccgaaaatgttagcttaaagggaacggtaattttaggcaaaaacgtaaaagtaggggagggttcagaactcaagaactgcgttataggaaacaatacggttatagggagaaatgtgaaactctttgattccgttctgtggtggaacgtaagtatagacgaagagagtgaaataagaaacggagttatatgtaacgacgtgaagataggaaaaagggtaaaagcaaaggagggagtagtaatagccgaagactgcgaggttgaggacgaagttctattcctcaaagacgtggttgtatggccagagaaggtaatagaaaagggttcggttgtaacaaagaacatcgtatgtgaatctaagtgggaaaagggaatatttaagggaaacaaggttatcggaaggataaacgtggaattgaccccggacaacgccacaaaactcggcatggctctcgggagtgtgcttcctcccaaaagtacggtaatacttgcgagggattatcacagggcttcaaggacgattaaacgctcctttctcggaggcatactttccacaggtataaacgtgatagaccttcacctttctcccctgccagttatgaggtttaccttaacggaagataaaaaggcggtttgcggggtttacttttccatatctcaggaattccccggtagcgtagaaatatgcgtatttgacgaaaacggactgccgatagacacgaatttccagaagaagattgaaagggtgttcttcagggaagcttacaggtttgaaacttttaccgatttaggattgataaaggaaaagccttacttctcagaaaactacgtcactaaactcctgagcagtattgacggagacagtataaagctttccagcaataaagtcgtttatgacgcactccactctcccatttctccctttatttccgaggttttgggaaaacttgaaatagaaaacgtaatactgaacgccctctacgatgagagaaaactttcaaggatatcaacctacgcgagcagttccgaaggaaacgtttctaaagttctgaaggctttatcctacgacgtaggatttgtaatggagcccagcgccactaagttaaagctcgtggacgacagggggaggactataagcggtgataggctccttctggtagtcttaatgcttcttgacaaaagtgcggaaaagcaattgagggtttaccttcccgtatgggctcccgaggttctggatgcgattttaaacaacgtaatcgttgaaaggggaaagtttacgaacctgagaaaatcctttattgaagacttttacatgctggcggacacggacgggagttttacctttacggagttctcatactctcccgacgcactttacgcctccctcaagataatggaaatgctaaccaaacttaaagtgaaagtgagcgaaatttacgattccctccccgagtattacttcctgcatgaagttgtaagctgcagttccgaaaagaagggcactgttctgagaaaaatatccgaaatggctgaaggaaaggaagcttccttcatagaaggggtaaagatatacgaggattacggaaattgggttttagtccttcccgattcttacaaggatttaatacacgtgtacgttcaatcaacggagagggaaagagcggaagaactaattaagaattacatggaaatagtgagggggatttgcaaaaaatga

SEQ ID NO: 14377 - protein, 831 aa, Aquifex aeolicus
MKGVILAGGFGTRIQPLTNSIPKPMLPVANRPIMEHVVHRLKEAGIEEIVVLLYYQAEVIKNYFKDGSDFGVKITYVQPEADYGTAGAVKQAQNYLNETFIIVSGDVITDFNLSELIAFHKSKSSKFTLALYSVENPLQFGVVITNKEGKVLKFLEKPGWGEVFSDTVNTGIYVVEPEILNYIPEDKPFDFAMDLFPKLMKSGIDLWALKMRGYWRDIGNIDSYRDVHKDIFAGLVKIRIPGRIITTKEARIYVEEGTEIPENVSLKGTVILGKNVKVGEGSELKNCVIGNNTVIGRNVKLFDSVLWWNVSIDEESEIRNGVICNDVKIGKRVKAKEGVVIAEDCEVEDEVLFLKDVVVWPEKVIEKGSVVTKNIVCESKWEKGIFKGNKVIGRINVELTPDNATKLGMALGSVLPPKSTVILARDYHRASRTIKRSFLGGILSTGINVIDLHLSPLPVMRFTLTEDKKAVCGVYFSISQEFPGSVEICVFDENGLPIDTNFQKKIERVFFREAYRFETFTDLGLIKEKPYFSENYVTKLLSSIDGDSIKLSSNKVVYDALHSPISPFISEVLGKLEIENVILNALYDERKLSRISTYASSSEGNVSKVLKALSYDVGFVMEPSATKLKLVDDRGRTISGDRLLLVVLMLLDKSAEKQLRVYLPVWAPEVLDAILNNVIVERGKFTNLRKSFIEDFYMLADTDGSFTFTEFSYSPDALYASLKIMEMLTKLKVKVSEIYDSLPEYYFLHEVVSCSSEKKGTVLRKISEMAEGKEASFIEGVKIYEDYGNWVLVLPDSYKDLIHVYVQSTERERAEELIKNYMEIVRGICKK

SEQ ID NO: 14378 - DNA, 1080 bp, Mycobacterium tuberculosis
  CDS (1)..(1080)
atggcaactcaccaagtcgatgcggtggtcctggtcggtggcaagggtacccgactgcggccgttgacgctgtcggcgcccaagccaatgctgcctaccgccggactgccgttcctcacccatctgctgtcgcggatcgccgcagcgggcatcgagcacgtgatcctgggtacgtcctacaaacccgcagtcttcgaagcggagttcggcgacgggtccgcactgggcctacagatcgaatacgtgaccgaggagcatcccttggggactggcggcggcatcgccaacgttgccggcaagctgcgcaacgacaccgcgatggtgtttaacggcgatgtgctctcgggcgcggatctggcccaactgctggacttccaccgaagcaatcgagccgatgtcacgctgcaactggtgcgggtgggcgacccgcgggcattcggctgcgtacccaccgacgaggaggaccgcgtagtcgcctttctggagaagacggaggatccgccgaccgaccagatcaatgccggctgctatgtcttcgaacgcaacgtcatcgaccggattccgcagggccgggaggtttcggtggaacgcgaggtgttcccggccttgctcgccgacggcgactgcaagatctacggctatgtcgatgccagctattggcgggacatgggcacaccggaagacttcgttcgcggatcggcggatctggtgcgcggcatcgccccgtctccggccttgcgtggtcaccgcggtgagcagttggtgcacgacggtgcggcggtatctcccggtgcgttgctgattggcggcaccgtcgtggggcgtggtgccgaaatcggccccggcaccagattggacggcgcggtcatcttcgatggtgtccgggtggaggccgggtgcgtgatcgagcgttcgatcatcggcttcggtgctcgcatcggaccgcgggcgttgatccgcgacggtgtgatcggtgacggggccgacatcggcgcgcgctgcgagttgttaagtggtgcccgggtatggcccggtgtctttcttcccgacggcgggatccgttactcgtccgacgtttga

SEQ ID NO: 14379 - protein, 359 aa, Mycobacterium tuberculosis
MATHQVDAVVLVGGKGTRLRPLTLSAPKPMLPTAGLPFLTHLLSRIAAAGIEHVILGTSYKPAVFEAEFGDGSALGLQIEYVTEEHPLGTGGGIANVAGKLRNDTAMVFNGDVLSGADLAQLLDFHRSNRADVTLQLVRVGDPRAFGCVPTDEEDRVVAFLEKTEDPPTDQINAGCYVFERNVIDRIPQGREVSVEREVFPALLADGDCKIYGYVDASYWRDMGTPEDFVRGSADLVRGIAPSPALRGHRGEQLVHDGAAVSPGALLIGGTVVGRGAEIGPGTRLDGAVIFDGVRVEAGCVIERSIIGFGARIGPRALIRDGVIGDGADIGARCELLSGARVWPGVFLPDGGIRYSSDV

SEQ ID NO: 14380 - DNA, 1251 bp, Pyrococcus horikoshii
  CDS (1)..(1251)
atgaataagatgaaggctgtaattcttgctgggggatttgggactagattaaggccaatttcttcaacgaggccaaagccaatggttcccgtgttaggaaagccgaacctacagtatattttagaggccctggaaaaggttaaggaaattgatgaaataatactttcagttcactacatgaggggcgagattagggaatttattcaggaaaaaatgagagactatcctaaggatataaggttcgtaaatgatccaatgccgctcgaaactggtggggcactgaaaaacgtcgaggaatacgtttcagatgatttcctggtgatctatggagacgtcttcacgaactttgattattctgaactaatagaggcccacaagaagaacgatggtttgataactgtagccctcacgaaggtttatgatcctgagaggttcggagtcgtaattaccgatgaggaaggaaagatcgtggagttcgaagagaaacccaggaaaccaaagacaaatttggtagatgctggaatttacatggttaacaaggatgtcctaaaagagataccaaagaacaaagagatctactttgagagggaaattcttccaaagttcgtaaatcaaggattggtttatgggtacaagatgccaaagcagtattactgggttgacttgggaaccccagaggacttcttctatgcccatcaaatagcacttgatgagctatccaaggaaaatggatacatgatcctaggggaaaacgttgaaattccagatgatgtcgaggttcaaggacccgtgtacatagatgacaacgcaaagatagggcatggggttaagataaaggcctacacttacatagggcctaatacaataattgaggataaagcctactttaagcgctcaatactcctggggaacgacataataaaggagagggccgagctaaaggatgcgatattaggcgaaggagtcgtcgtaggaaaggatgtcataataaaggagaacgccgtaataggggattacgctaagatatatgacaatctggttatctatggggccaaggttcttccatggaagaaagttgaggagtacgaggcatacataaagataaagctcgatccaacgaaagttagaccaggacaatatcccgatcactgtcctctcggccttccagagtgtatatacaaaaagtttaaggccattgcaggagagaagccaccttgcgatgagtgtatagagaaccagtggctcttctga

SEQ ID NO: 14381 - protein, 416 aa, Pyrococcus horikoshii
MNKMKAVILAGGFGTRLRPISSTRPKPMVPVLGKPNLQYILEALEKVKEIDEIILSVHYMRGEIREFIQEKMRDYPKDIRFVNDPMPLETGGALKNVEEYVSDDFLVIYGDVFTNFDYSELIEAHKKNDGLITVALTKVYDPERFGVVITDEEGKIVEFEEKPRKPKTNLVDAGIYMVNKDVLKEIPKNKEIYFEREILPKFVNQGLVYGYKMPKQYYWVDLGTPEDFFYAHQIALDELSKENGYMILGENVEIPDDVEVQGPVYIDDNAKIGHGVKIKAYTYIGPNTIIEDKAYFKRSILLGNDIIKERAELKDAILGEGVVVGKDVIIKENAVIGDYAKIYDNLVIYGAKVLPWKKVEEYEAYIKIKLDPTKVRPGQYPDHCPLGLPECIYKKFKAIAGEKPPCDECIENQWLF

SEQ ID NO: 14382 - DNA, 1326 bp, Chlamydophila pneumoniae, Chlamydia pneumoniae
  CDS (1)..(1326)
atgatagaaaacgattttccggaggcctcaaattttgagagctctcatttttatcgagataaggttggagtaattatcttgtgtggaggggagggcaaaaggttatctcctctaactaattgtcgctgtaagcctaccgtatcttttggaggacggtataagctgatcgatattccaatatctcatgcaattagtgcaggtttttcaaaaatttttgttataggtcagtaccttacctacactctacaacagcatttatttaagacgtatttttatcatggagttttgcaggatcagatacatcttcttgctcctgaagcacgtcagggtgaccaaatctggtatcagggtaccgcagatgcaattcgaaaaaacttactttatttcgaagatacagaaatcgaatactttttaatcttatcaggagaccagctctacaatatggattttagatctattgtagatacagccatacgaactcatgtagatatggttcttgttgcccagcctatcccagaaaaagatgcctatagaatgggagtcttagatattgattctgaaggaaaactcatcgatttctatgaaaaacctcaagaaaaagaagtactcaagcgttttcagctttcttctgaagatcgccgtattcataagttaaccgaagattcaggagactttcttggatcaatgggcatctacttattccgaagagacagtttgttttctttgcttcgcgaagaagaaggaaacgattttggaaagcatctcatccaagctcagatgaagcggggacaagtacaaactctcctttataatgggtattgggccgacatcggaactatagaatcttattatgaagcaaatatagcgttaactcaaaagcctcatgcagagaaaagaggactgaattgttatgatgataacggaatgatctatagtaaaaatcatcatcttcctggagcaatcattacggattctatgatctcaagttctttattatgtgagggttgtgttattaatacgagtcatgtatctcggagtgtcttagggattcgtagtaagattggagagaactctgtagtcgatcagtctataattatgggcaatgctcggtacggatctccatccatgccatctttaggaattgggaaagactgtgagattcgtaaagcgattatagatgagaattgttgtattggaaacggtgtcaaactacagaatctcaagggctatattaaatatgattctcctgataaaaagctatttgtgagagataatattatcattgttcctcaaggcacgcacattcctgacaactatatcttctag

SEQ ID NO: 14383 - protein, 441 aa, Chlamydophila pneumoniae, Chlamydia pneumoniae
MIENDFPEASNFESSHFYRDKVGVIILCGGEGKRLSPLTNCRCKPTVSFGGRYKLIDIPISHAISAGFSKIFVIGQYLTYTLQQHLFKTYFYHGVLQDQIHLLAPEARQGDQIWYQGTADAIRKNLLYFEDTEIEYFLILSGDQLYNMDFRSIVDTAIRTHVDMVLVAQPIPEKDAYRMGVLDIDSEGKLIDFYEKPQEKEVLKRFQLSSEDRRIHKLTEDSGDFLGSMGIYLFRRDSLFSLLREEEGNDFGKHLIQAQMKRGQVQTLLYNGYWADIGTIESYYEANIALTQKPHAEKRGLNCYDDNGMIYSKNHHLPGAIITDSMISSSLLCEGCVINTSHVSRSVLGIRSKIGENSVVDQSIIMGNARYGSPSMPSLGIGKDCEIRKAIIDENCCIGNGVKLQNLKGYIKYDSPDKKLFVRDNIIIVPQGTHIPDNYIF

SEQ ID NO: 14384 - DNA, 1113 bp, Thermotoga maritima
  CDS (1)..(1113)
atgagggtgcttggattgattcttgctgggggaaaaagtgatcgtttgtggcctctgacgaaggtgagagccagtgcggcggttcctgtgtttggaaagtacagggctatagacttcactttgagcaacatggtgaattccggcatcaggaaagtgggtatccttactcagtacaatccaaggagtttgatggaccatctgggttctggaaaggaatgggacctcgatcggaaaagcggaggattgttcattctccagccctacgttgggccgaacagagaagtttggtacaggggaacggcggatgccatcttccagaatatgaccattctaagaaggggcgaggaagatcacgttttgataggttcgggagatcacatctacaagatgatctacagggatcttttcaactaccatctaaaaaagggagcggacataactctcgtagttaaagaactcgatgaaacgtacaacttgagtgaatatggaatagttcagctcgacgatgacatgagagtggtggagatagaagaaaaaccggcacatccaaaagggaacatcgcgtttcttggggtttacttcatgaacaaagagctgctcaaggagcttctttatgcaacggttccccaggggaagtacgatcttcttctcgacatagtgattcccaacctcgacaggttgaaggtctacgcttacaggttcgatggttactggagaaacgtaaagaagggaataaaagagtactacaggataaacatggatatattgaaaaaggaagtgcgcgatgagctcttctacagaaacggtaaggtttatacgaagctgaaggatcttcctcctccaaaattcacgaccacggctgttgttgagaattctttgattgcagatgggagcatagtttctggtacggtgagaaattctgtcattttcagaaacgtgcggataaaagtcggggcagtagtagaaaattccatcattatggagaacaccgtcgtggaggaaggagcagttctgagaaacgtgatcctggacaagaactgtatcgtgagagaaggtcgtgtcatcgaaggagacacagagttacctgttttcgaaaaaagagcagttttgtga

SEQ ID NO: 14385 - protein, 370 aa, Thermotoga maritima
MRVLGLILAGGKSDRLWPLTKVRASAAVPVFGKYRAIDFTLSNMVNSGIRKVGILTQYNPRSLMDHLGSGKEWDLDRKSGGLFILQPYVGPNREVWYRGTADAIFQNMTILRRGEEDHVLIGSGDHIYKMIYRDLFNYHLKKGADITLVVKELDETYNLSEYGIVQLDDDMRVVEIEEKPAHPKGNIAFLGVYFMNKELLKELLYATVPQGKYDLLLDIVIPNLDRLKVYAYRFDGYWRNVKKGIKEYYRINMDILKKEVRDELFYRNGKVYTKLKDLPPPKFTTTAVVENSLIADGSIVSGTVRNSVIFRNVRIKVGAVVENSIIMENTVVEEGAVLRNVILDKNCIVREGRVIEGDTELPVFEKRAVL

SEQ ID NO: 14386 - DNA, 1994 bp, Arabidopsis thaliana (mouse-ear cress)
  CDS (127)..(1698)
agaaaaagtaacagcttcctccgtcaactacgcacttcactgattcagtcttcgatttcaaacgatcaacaaacatttttatcataatcataatcagaaaaaagtgttaaactttctcctaaaaagatggattcttcttactcctttgccttggggacaagtagttctattttgccaaaactcagtttcaggaatgtagagaacagattttatggtgagaagaacaacaacaatggtttgtgtaaacgttttggatcagatttgggctccaagaagtttaggaatcaaaagttcaagcacggtgttgtttacgctgttgccacttcagataatccaaaaaaggctatgacagtaaagacttccatgtttgagagaagaaaggtagacccgcaaaatgtggctgcaatcattctaggaggaggcaatggagctaaactcttccctcttacaatgagagccgcaacaccagctgttcctgttggtggatgctacaggctgatcgatatcccgatgagtaactgtattaacagctgcatcaacaagatatttgtgctgacacagttcaactcagcttcccttaatcgacatttagcacgaacttattttgggaatggcataaactttggaggtggtttcgtagaggttcttgctgctacacaaacaccaggggaagctgggaagaagtggtttcaaggaacagcagatgctgtcagaaaattcctctgggtgtttgaggatgccaagaacaggaacattgagaacatacttattttgtctggagatcatctctatagaatgaactacatggactttgttcagtctcatgtggatagtaatgcggatattactctttcgtgtgcaccagttagtgaaagccgtgcatcaaattttggtctagtaaagattgatcgaggtgggcgtgtaatccatttctccgagaaaccaacaggagtcgacctgaaatcaatgcaaacagacacaacaatgcttggactgtctcatcaagaagcaacagattctccatacattgcatcaatgggagtttattgtttcaaaaccgaagctttgctgaaccttctaacaagacagtatccgagttccaatgactttggatctgaagttattcctgcagccataagagatcacgatgttcaaggatacatattcagagattactgggaggatattggaactataaagacattttatgaggctaatttagctcttgttgaggagcgaccaaagtttgaattctatgatccagaaactccgttctacacttctcctcggttcctcccaccaacaaaagctgagaaatgtcggatggtagattcaataatctcacatggatgtttcctgcgagaatgcagcgtccaacgttcaatcattggtgaacgatcacgtctagactacggggttgagcttcaggatacattgatgttaggtgcagattactaccaaactgagtctgagattgcatctctattagcagaaggaaaggttccaattggtattggtaaagacacaaaaatcaggaaatgcatcattgacaagaatgctaagatcggtaaaaacgtgatcatcatgaacaaaggcgatgtacaagaagcagataggccagaggaaggattctacattcgatcaggaatcactgtgatagtcgaaaaggcgacaattcaagatggtactgtaatatgaatggagagcttgaaagtaagtccaccgagcaacaatctgagattaaaaagcattttagctagccggtgaatgaaaatagaaagcttcgatcttttctttcccgcagtgcatctacaactagaagaactcaaatttagagatatagatttagagaacaataagaaacacagtcaagtattgatcagtgctccggccgagcagtctttctctcttttcaccttttgtatttaggaatctttgctgattctctttataatattattcaaaaaataagcaaaccaaaaaaaaaaaaaaaa

SEQ ID NO: 14387 - protein, 523 aa, Arabidopsis thaliana (mouse-ear cress)
MDSSYSFALGTSSSILPKLSFRNVENRFYGEKNNNNGLCKRFGSDLGSKKFRNQKFKHGVVYAVATSDNPKKAMTVKTSMFERRKVDPQNVAAIILGGGNGAKLFPLTMRAATPAVPVGGCYRLIDIPMSNCINSCINKIFVLTQFNSASLNRHLARTYFGNGINFGGGFVEVLAATQTPGEAGKKWFQGTADAVRKFLWVFEDAKNRNIENILILSGDHLYRMNYMDFVQSHVDSNADITLSCAPVSESRASNFGLVKIDRGGRVIHFSEKPTGVDLKSMQTDTTMLGLSHQEATDSPYIASMGVYCFKTEALLNLLTRQYPSSNDFGSEVIPAAIRDHDVQGYIFRDYWEDIGTIKTFYEANLALVEERPKFEFYDPETPFYTSPRFLPPTKAEKCRMVDSIISHGCFLRECSVQRSIIGERSRLDYGVELQDTLMLGADYYQTESEIASLLAEGKVPIGIGKDTKIRKCIIDKNAKIGKNVIIMNKGDVQEADRPEEGFYIRSGITVIVEKATIQDGTVI

SEQ ID NO: 14388 - DNA, 1143 bp, Lactococcus lactis subsp. lactis
  CDS (1)..(1143)
atggcaattgaaatgcttggtcttattcttgctggtggtcaagggacgcgtttaggtaaattgacaaaagatgttgcaaaacctgctgttccttttggaggtcgttatcgtatcattgattttgccttatcaaattgtgcaaattccaatgtaaaaaatgttggcgtcattactcagtatcaacctttaactctaaatgctcatattggaaatggagcaccatgggggttaaatggaatcaatagtggagtcactattctccaaccctattcttcacaagaaggttctaaatggtttgaaggaacctctcacgctgtttatcaaaatatctcttatattgaccagcaaaatccagaatatgttctcattctctcgggagatcatatttataaaatggattatgaagccatgttagaaagccataaagaacgtgaagctagtttaacagtttcggtgatggaagttccgcttgaagaagcaagccgttttggaattatgaataccgatgataatgaccgaattattgaatttgaagaaaaacctaaagaaccaaaatcaaaccttgcttcaatgggaatctatattttcaattggaaaaggcttcgcgaagttcttgtgaacggttactcgaaaggaaatccaatggaagatttcggtggggatgttatcccggcttatattgaagctggagaaaatgtgtttgcttaccgctttaagggatattggaaagacgttgggaccattgattctcttcatcaatccagtatggaatttcttgatttaaataatgaattaaatattacagataaatcttggcgaatttattcacataatgatatttcagctccacagtttatcacagaaaaatccaatgtaaaaaatgcacttgttggtgatggctgttacgttgatggaacagttcttcattcaatcctttcacagaatgtccatgttcaagaaggaacagtgattgaggacagtttcattatgtctgggacatttattggggaaaacgttacaatcaaaaatgcaatcattggtgaaaatgcaaaaattggtgataatgtagaaataatcggtgaaaatgaagtcgcagtgattggtcacggagaaattaaaggagaaaataaaaatgaacaatag

SEQ ID NO: 14389 - protein, 380 aa, Lactococcus lactis subsp. lactis
MAIEMLGLILAGGQGTRLGKLTKDVAKPAVPFGGRYRIIDFALSNCANSNVKNVGVITQYQPLTLNAHIGNGAPWGLNGINSGVTILQPYSSQEGSKWFEGTSHAVYQNISYIDQQNPEYVLILSGDHIYKMDYEAMLESHKEREASLTVSVMEVPLEEASRFGIMNTDDNDRIIEFEEKPKEPKSNLASMGIYIFNWKRLREVLVNGYSKGNPMEDFGGDVIPAYIEAGENVFAYRFKGYWKDVGTIDSLHQSSMEFLDLNNELNITDKSWRIYSHNDISAPQFITEKSNVKNALVGDGCYVDGTVLHSILSQNVHVQEGTVIEDSFIMSGTFIGENVTIKNAIIGENAKIGDNVEIIGENEVAVIGHGEIKGENKNEQ

SEQ ID NO: 14390 - DNA, 1140 bp, Streptococcus pneumoniae
  CDS (1)..(1140)
atgaagattgataaatattctgccattttaggaaatacagttggttttcacaatatgtcgacattgacggaccaccgtccagtagcaagtttgccatttggtgggaaatatcgtttgattgacttcccactttcaagccttgctaatgcaggtgttcgtagtgtctttggtattttccagcaggataatatcagctcagtatttgaccatattcgttcaggacgcgagtggggcttatcaacccttcttagccattactatctaggaatttacaatacccgtgtagaaagtagtacagttggaaaagaatactaccaacagcttcttacttatttgaaacgttctggctcaaaccaaacggttgccctcaactgcgatgttcttattaacattgatttgaaccaagttttccacctacatagtacaacaaaagagcctatcactgtagtttataaaaaactagctaagaaagatatttcagaagtaaatgcaatcttggatgtagatgaaacagaccatgttctttctcataaactctttgatagcaagtcaacagctgaaacgttcaatatgtctacagatatctttgtcgttgatacaccttggttgattgaacacttggaagaagaagctaaaaaagaacatccagagaaattgcgctatgttttacgggatttggctgtaaaagagggagctttcgcctacgagtacacgggctatctagccaatattcactctgttaaatcttattatcaagcgaatatcgatatgcttgaatcacaaaaattctattctcttttctcaccaaaccaaaagatttatacaaaggtcaaaaacgaagagccaacttactatgctaatacatctaaggtaagcacttctcagtttgcctctggtagtattattgaaggtcaagtagctaattctgttctatcacgtaatattcatgtccataaggatagcttggttaaagatagcctgctcttccctcgtgttgttattggagaaggggctcaggtcgaatatgctatcttggacaaaggggttgaagttgagcatggtgttgtgattcgaggaactgcagaacatccagttgtggttaagaaaggtgctaaagtaacagaggatattcattcatga

SEQ ID NO: 14391 - protein, 379 aa, Streptococcus pneumoniae
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEHGVVIRGTAEHPVVVKKGAKVTEDIHS

SEQ ID NO: 14392 - DNA, 2529 bp, Nostoc sp. PCC 7120
  CDS (1)..(2529)
atgcgtgcagtgctgatggcaggcggttccggaacgcgacttcgcccgttaacttgtgatctaccaaaaccaatggtaccgatcctcaatcgcccaattgccgaacatatcattaatctcctcaagagacatcacattacagaagttattgccaccttgcattatctacctgatgtcttgcgagactattttcaagatggcggtgattttggtgtgcagatgacctacgccgtcgaagaagaccagcctctgggaacagcaggttgcgtgaaaaacattgccgaacttctggatgaaacttttttagtaattagcggtgatagcatcacagattttgatttaggagaagcgatcgcttttcacaaacaaaaacagtcaaaagctactctaattttaacaagggttcctaaccctatagaatttggtgtcgtaatcaccgatgaagcaggcaaaattaaacgctttttagaaaaaccatctaccagcgaaattttttctgataccgttaatactggaacatacattctggaaccagaagttttagaatatctcccatccaatacagaatgtgacttttctaaagatttatttcctctgctgctggccaaagacgagccaatgtatggttacgttgccgaaggttactggtgcgatgtcggacacttagatgcttatcgggaagctcagtatgatggtttagatcgtaaggtaaaactagattttgcttacagggaaaattctcctggcttgtggataggacaaaatacttatattgacccctctgcacatatagaagccccagccgtgataggtaacaattgccgtatcggtgcgagagtacaaattgaggctggaactgtgattggggataatgtcaccattggtgctgatgccaatctcaagcgtccgattgtgtggaatggggcaattattggggaagaagcccagttgagtgcttgtgtaatctctcgtggaacccgtgtagaccgccgcgcccatgtgttagaagcctctgtagtgggttctttgtccacggttggggaagaagcccagattagccccggtgtcagagtttggcctagtaaaaagattgaatcaggggcaattttaaacatcaacttgatttggggtaacaccgcccaacgaaacttatttgggcaacgtggggtacaaggattagcaaatatcgatatcagcccagagtttgcggtgaagttaggggctgcttatggttctactttaaaacctggtgcaaaagtaactgtgtcccgtgaccaacgcaatgtttcccgcatggtgacgcgatcgctcattgcaggtttaatgtctgtaggtgtcgatattcaaaacctcgatgcaacagccatccccatcgcccggacagttatacccacaatgggagttgcgggagggattcatgtacgagtacaccccgatcgcgccgactatatcctgatagaattcatggatcataaggggattaatatctccaaagcccaagaaaagaaaattgaaggggcttatttcaaggaagatatgcgccgggctttaactcatgaaattggtgatgtggcttaccccagccaagttattgacctttactgcacagcttttgagaaactgttgaatgtttctaccctcaacaacagccgggcaaaagtcgtaattgactatgtttatgctgtatctggggctgttttaccccaaatgctagataaatttggtgctgacgcagtggtactaaatgccagtctgaataaaaatgctgtcaccacaaccgatagggaaacactactgactcagctaggtcatgtggtggaagcgttgaaggctaatttcggtgtccaagtctccgctaacggcgaacagctcattttagttgacgaatcaggctaccccattcgcggcgaactattaaccgcactgatggtagatatgattttgacttccaaccccagagggacggtagttgtgccggttcatgcttccagtgcggtggaacaagtcgcccgtcgccatgatggtaggatcattcgcaccaaagccaatgcgacagccttgatggaagcttgtcagaaaaatcccaatgtggtgttaggtggtagcggcgaaactggctttatctttccccaactgcatccggggtttgactccatgttctgcattgccaaaatcattgaaatgttaaccatacaagagcgatcgctggctactgtacgatcagaattaccccgtgtgatttacagaacccacaccatccgttgtccctggtcggctaaaggtgcattgatgcgctacttagtggaaactcacccagcccaaaacctcgaactcatcgatggggtgaagattcgccaaccctttgatgatagttggttgttagttttaccagatgctagtgaaccattagtacatttgtatgcgaacagtcacgagcgcgactgggtagatgagacggtgagggattaccgttcccgtgtgcagagtttcgtagagagacagcaggaatatcatccggcggaagtgtga

SEQ ID NO: 14393 - protein, 842 aa, Nostoc sp. PCC 7120
MRAVLMAGGSGTRLRPLTCDLPKPMVPILNRPIAEHIINLLKRHHITEVIATLHYLPDVLRDYFQDGGDFGVQMTYAVEEDQPLGTAGCVKNIAELLDETFLVISGDSITDFDLGEAIAFHKQKQSKATLILTRVPNPIEFGVVITDEAGKIKRFLEKPSTSEIFSDTVNTGTYILEPEVLEYLPSNTECDFSKDLFPLLLAKDEPMYGYVAEGYWCDVGHLDAYREAQYDGLDRKVKLDFAYRENSPGLWIGQNTYIDPSAHIEAPAVIGNNCRIGARVQIEAGTVIGDNVTIGADANLKRPIVWNGAIIGEEAQLSACVISRGTRVDRRAHVLEASVVGSLSTVGEEAQISPGVRVWPSKKIESGAILNINLIWGNTAQRNLFGQRGVQGLANIDISPEFAVKLGAAYGSTLKPGAKVTVSRDQRNVSRMVTRSLIAGLMSVGVDIQNLDATAIPIARTVIPTMGVAGGIHVRVHPDRADYILIEFMDHKGINISKAQEKKIEGAYFKEDMRRALTHEIGDVAYPSQVIDLYCTAFEKLLNVSTLNNSRAKVVIDYVYAVSGAVLPQMLDKFGADAVVLNASLNKNAVTTTDRETLLTQLGHVVEALKANFGVQVSANGEQLILVDESGYPIRGELLTALMVDMILTSNPRGTVVVPVHASSAVEQVARRHDGRIIRTKANATALMEACQKNPNVVLGGSGETGFIFPQLHPGFDSMFCIAKIIEMLTIQERSLATVRSELPRVIYRTHTIRCPWSAKGALMRYLVETHPAQNLELIDGVKIRQPFDDSWLLVLPDASEPLVHLYANSHERDWVDETVRDYRSRVQSFVERQQEYHPAEV

SEQ ID NO: 14394 - DNA, 1699 bp, Nostoc sp. PCC 7120
  CDS (248)..(1537)
agtcaacagtcatttcacaaattaaggcaagattaagaaaatactgtaaccattaacatatctaatatttttaatcatgagtgcaaattaatacagtggaaattgttttctgatcaatggctgcacgatacgtcaccagtaaggttttttaaaattcattcaagataatctttgatccccccttaccagctgccacagacagtcctaaactgtaggtgggagttgaaaggcagttgggagaaatcatatgaaaaaagtcttagcaattattcttggtggtggtgcgggtactcgcctttacccactaaccaaactccgcgctaaaccggcagtaccagtggcagggaaataccgcctaatagatatccctgtcagtaactgcattaattcggaaatttttaaaatctacgtattaacacaatttaactcagcttctctcaatcgccacattgcccgtacctacaactttagtggttttagcgagggttttgtggaagtgctggccgcccagcagacaccagagaaccctaactggttccaaggtacagccgatgctgtacgtcagtatctctggatgttacaagagtgggacgtagatgaatttttgatcctgtcgggggatcacctgtaccggatggactatcgcctatttatccagcgccatcgagaaaccaatgcggatatcacactttccgtaattcccattgatgatcgccgcgcctcggattttggtttaatgaaaatcgataactctggacgagtcattgatttcagtgaaaaacccaagggcgaagccttaaccaaaatgcgtgttgataccacggttttaggcttgacaccagaacaggcggcatcacagccttacattgcctcgatggggatttacgtatttaaaaaagacgttttgatcaagctgttgaaggaagctttagaacgtactgatttcggcaaagaaattattcctgatgccgccaaagatcacaacgttcaagcttacctattcgatgactactgggaagatattgggacaatcgaagctttttataacgccaatttagcgttaactcagcagcccatgccgccctttagcttctacgatgaagaagcacctatttatacccgcgctcgttacttaccacccacaaaactattagattgccacgttacagaatcaatcattggcgaaggctgtattctgaaaaactgtcgcattcaacactcagtattgggagtgcgatcgcgtattgaaactggctgcatgatcgaagaatctttactcatgggtgccgacttctaccaagcttcagtggaacgccagtgcagcatcgataaaggagacatccctgtaggcatcggtccagatacaatcattcgccgtgccatcatcgataaaaatgcccgcatcggtcacgatgtcaaaattatcaataaagacaacgtgcaagaagccgaccgcgaaagtcaaggattttacatccgcagtggcattgtcgtcgtcctcaaaaatgccgttattacagatggcacaatcatttagtcaacagtcaacagtcaacagttaagaatttcaactttgactaatgactactgaccctagactaatgacaaaactcatattactgattggtcttcctggtagcggtaagtcaaccttggcaaaacaattagtagcacaatgcccccagatgcagctgatttc

SEQ ID NO: 14395 - protein, 429 aa, Nostoc sp. PCC 7120
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKEALERTDFGKEIIPDAAKDHNVQAYLFDDYWEDIGTIEAFYNANLALTQQPMPPFSFYDEEAPIYTRARYLPPTKLLDCHVTESIIGEGCILKNCRIQHSVLGVRSRIETGCMIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 14396 - DNA, 1431 bp, Yersinia pestis
  CDS (1)..(1431)
atggtgaggtttgaaagtacagactcattgatgttggccagacaattacccaataaaaccgtggcactcattctggcgggaggccgtggctcacgattgaaagatttgaccgccacccgcgccaaacccgcagtccattttggtggcaaattccgcatcattgattttgcgctctccaactgcctgaactcaggggttcgccgtattggtgtgataacacaatatcagtcccatacattggttcagcatattcaacgtggctggtcatttctcaatgaagaaatgaacgaatttgttgatctactgcccgcccaacagcgtttgagcacagagcaatggtacaaaggcactgcggatgcggtctgtcagaacttggatattatccgccgctatgacgcagaatatatcgtcattctggctggggatcatatctataagatggattattctcgtatgctgctcgaccacgtggaaaaaggggctgaatgtaccgtcgcctgtatcccggtgccaattagtgaaggcagtgagtttggtatcatggaggttactgcggattatcagataaccgcgttctatgaaaagcccgcgaacccccctcctataccgggtgatccgagcaacgcattggctagcatggggatctatatcttcaatgctgactacctctttaagttactcgaagaggacaataataccccaggctccagccatgatttcggtaaagacatcatcccgcaactcaccgcaagaaaagtcgtctgggcgcatccgtttgatctctcttgtgtcacttccaatgctgaattaccgccttattggcgcgatgtcgggacattggacgcctactggcgggctaatctcgatttggcgtcagtgacaccagagctggatatgtatgatcgcgcctggccaatccgcacccatatggagccattgccacccgccaagtttgtccaagaccgatctggtagccatggcatgacgatgaattcactggtctctggcggatgtattgtttcaggttcagtggtggtgcattcggtgttgttccctcgggtgcgggtgaattcgttctgtactatcgattcctcactgctgttacctgatgtccatgtggggcgatcttgtcgcttgcgtcgctgtattattgaccgtgcctgtcacattcctgagggaatggtgattggcgaaaacgcggatgaagacagcgcccgtttctaccgttcagagggggggggtggtgttagtgactcgggatatgctggcaaagttagaggcaaaatagagccattaggttttttatttgtcaggttggatttattgatcagactgagcttattgatcagactgaacttatttatcagaatgaacctattgataatattaactttgtttttcaaattggcgtcgatacaggccagtcattag

SEQ ID NO: 14397 - protein, 476 aa, Yersinia pestis
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENADEDSARFYRSEGGGGVSDSGYAGKVRGKIEPLGFLFVRLDLLIRLSLLIRLNLFIRMNLLIILTLFFKLASIQASH

SEQ ID NO: 14398 - DNA, 1263 bp, Agrobacterium tumefaciens
  CDS (1)..(1263)
atgtcggaaaaaagagttcagcctttggcgcgtgatgcaatggcctatgtcctcgcaggcggaagaggaagccgtctgaaggaactgacggaccgccgggcaaaacccgcggtttattttggcggcaaggcgcgcatcatcgattttgcgctttccaacgcgctcaattccggcatccgccgcatcggcgtcgccacgcaatataaggctcactccctcatccgccacctgcaacgcggctgggacttcttccgtcccgagcgtaacgaaagcttcgacattctgccggcttcgcagcgcgtgtccgaaacgcaatggtacgaaggcaccgccgacgcggtttaccagaacatcgacatcatcgagccctatgccccggaatatatggtcattctggccggcgaccatatttacaaaatggactacgaatacatgctgcaacagcatgtggattccggtgccgacgtcacgatcggctgccttgaagtgccgcgcatggaagcgaccggcttcggcgtgatgcatgtgaacgaaaaagacgagatcatcgacttcatcgaaaagccggccgatccgcccggcattcccggcaatgaaggttttgcgctcgcctcgatgggcatctacgtcttccacacgaagttcctgatggaagcgctgcgccgcgatgccgccgatccgacctccagccgcgacttcggcaaggacatcattccctatatcgtcgaacacggtaaagccgttgcgcaccgcttcgctgattcctgcgtgcgttcggatttcgagcacgaaccctactggcgagacgtcggcaccatcgatgcctattggcaggccaatatcgacctcacggatgtggtgccggacctcgatatctacgacaagtcctggccgatctggacctatgcggaaatcaccccgccggcgaaattcgtgcatgacgatgaagatcgccgtggttcggccgtatcgtcggtcgtctcgggcgactgcatcatttccggtgcagcgctcaaccgcagcctgctgttcacaggcgtgcgcgccaattcatactcccgccttgagaatgccgtagtactgccgagtgtgaagatcgggcgtcatgctcagctcagcaatgtcgtcatcgaccatggcgtggtcattccggaaggactgattgtaggagaagaccccgaactggatgccaaacgcttccgccgcacggaaagcggcatctgccttatcacccaatcgatgatcgacaagctggacctgtag

SEQ ID NO: 14399 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEALRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 14400 - DNA, 1296 bp, Salmonella enterica subsp. enterica serovar Typhi
  CDS (1)..(1296)
atggtgagtttagagaagaacgatcgtgtaatgttggcgcgccagctgccattgaaatctgttgccctaatcctggccggcggccgcggcacgcgtctaaaagatttaacgaacaaacgcgccaaaccagccgtccactttggtgggaagttccgcatcatcgatttcgccttatctaattgtctgaactccgggattcgccgtatcggcgtgatcactcagtatcagtcccacacgctggtgcagcatattcagcgcggctggtcactgtttagcgaagagatgaacgaatttgtcgatctgctgccagcccaacagcgtatgaagggcgaaaactggtatcgcggcacggcagacgcggtgacccagaacctggatattattcgttgctataaagcggaatatgtcgtcatcctggcaggcgatcatatctacaagcaggactactcgcgtatgttgatcgatcacgttgaaaagggcgcgcgttgcacggtggcctgtatgccggtgccgatcaaagaagcgacggcgttcggcgtgatggcggtcgatgaaaacgacaagattattgattttgtcgaaaaaccggcgaatccccccgcaatgcctggtgacgccagcaaatcgctggccagtatgggcatttacgtttttgacgccgattacctgtatgaattgttggcggcagacgataaagatgacgcttccagccacgatttcggtaaagacattatccccaaaatcacccgcgaaggtatggcttacgcgcatcctttcccgctctcctgcgtgcagtccgatccacaagccgaaccgtactggcgtgatgtaggtacgctggaagcttactggaaggcgaacctggatttagcctcggtgacgccggagctggatatgtatgaccagaactggcctatccgtacgcatatggaatcgctaccgcctgcgaaattcgtgcaggaccgctccggtagccacggtatgacgctgaactcgctggtctccggcggctgcattatctctggttcggtggtggtgcaatctgtgctcttcccacgggtgagaataaattctttttgtaatattgattcggcagtgttgttacctgaggtttgggtagggcgctcctgccgtttacgtcgctgtgttattgaccgtgcctgtattatcccggaaggcatggtgattggtgaaaatgcggaagaggacgctcgtcgtttctaccgttcagaagaaggtattgtactggtcacgcgtgaaatgctgcgcaaactgcaggtcaaacaggagcgataa

SEQ ID NO: 14401 - protein, 431 aa, Salmonella enterica subsp. enterica serovar Typhi
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRCYKAEYVVILAGDHIYKQDYSRMLIDHVEKGARCTVACMPVPIKEATAFGVMAVDENDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 14402 - DNA, 999 bp, Archaeoglobus fulgidus
  CDS (1)..(999)
atgaaagtcataataatggcgggcggttacgcaacgaggctctggccgataaccaagagcaaggcgaagcccctgctgcctgtaggaactaagaggatagttgaccacgtttacgagaaggttctgaagttcaactcacccattctactatccacaaacaaaaggttcgaggaggacttcaggaagtgggctgagggtaaggacgttgaggtggttgttgaggacacgatgagggaggaggagaagcttggagcagtaaaggctctcgcacaggttgttgagggcattgacgacgacttccttgttgttgccggagacaacattttctccttcgagcttaaccctattgtagagctcttcaggaagaaaaaatcgcctgttaccgccctctacgacgttggggattacgagctggcaaaaaggtacggtgtggcggagcttgagggggaaattgtgagaaggttttatgaaaagccggaaaagccagcttcaacccttgttggaatagctatctacacttttccgagggaaatagccgacttactcgttgagtatgttggtgggaatgagaggagcgataaccttggcgatttcctcagctacctctgccagaaaatggatgtttacggctgcatcttcgacaacggaaactggtacgatgtgggaaatcccgactcctacatcgaggccttcaagttttacactgacagcttcgttcacgagtcggtggaggttgccaaggctgctaaaatcatcgagccggttgtgattgaaagggatgtggtcataaagggcaggtcgattgttgggccctacgcctacatcggcgagggctgcgagatcgactcatcagatgtgagtgagagcgttgtgttttccaagacggttttgaagagggtgaggctctggaggagcataattgatgacgattgcgagatcaggaacatcgagctgagcggctcgataattggcgggcatgcgaagattcagagaggatga

SEQ ID NO: 14403 - protein, 332 aa, Archaeoglobus fulgidus
MKVIIMAGGYATRLWPITKSKAKPLLPVGTKRIVDHVYEKVLKFNSPILLSTNKRFEEDFRKWAEGKDVEVVVEDTMREEEKLGAVKALAQVVEGIDDDFLVVAGDNIFSFELNPIVELFRKKKSPVTALYDVGDYELAKRYGVAELEGEIVRRFYEKPEKPASTLVGIAIYTFPREIADLLVEYVGGNERSDNLGDFLSYLCQKMDVYGCIFDNGNWYDVGNPDSYIEAFKFYTDSFVHESVEVAKAAKIIEPVVIERDVVIKGRSIVGPYAYIGEGCEIDSSDVSESVVFSKTVLKRVRLWRSIIDDDCEIRNIELSGSIIGGHAKIQRG

SEQ ID NO: 14404 - DNA, 984 bp, Pyrococcus horikoshii
  CDS (1)..(984)
atgaaggtcctcataatggccggaggctatgcgacgaggctttggccgataaccaaggataatcccaaggccctcctacccttaggtaataagacgatactagagtacatcctcgagaaggttagggagctggatgttgacgtttacatctcaacaaataggttctttgctgagaagttcaggaagtacgatgtagagcttatagtcgaggataccgttcatgaggaggaaaagctaggaactatagccgctatgaggaatgcccttaacatcctgggcgaggatgattacctaatagttgccggcgataacgtgttctccttctcccttaaggacttcgttgataacttctctgggaaaacccttatagcggtttacgacgttggtgattttgagctagcaaagaggtatggagttgtagtccttgagaaggatagggttatagacttcgaggagaagcccgctaatcccaagagtacactgataagcaccggggtttacctcttccctagggatgtcatgaagctccttaatgaatacctcgaggatgggaacaaggattcccccggctacttcctccagtggctccttaagagaggggaggagataagggcttacaggttcgatggctactggtacgacataggttccgcggatagttaccttgaagcaatgaagaccctgcttaaggagagctacatagaggagatccagataagcccctacgcaaagataatacctccggtggttataaagaaggggactaagataatggggagatcgataataggcccctacgcctacataggcgaggaatgcataatagagaattctgatataagcgattccataatattcccgaggactgtgataaggaactccactatatggcgctctattatagatgaaaagtgcgagataaggaacctcgagctgaggaagagcctagttggaggccacgcaaagatccagaggggagattaa

SEQ ID NO: 14405 - protein, 327 aa, Pyrococcus horikoshii
MKVLIMAGGYATRLWPITKDNPKALLPLGNKTILEYILEKVRELDVDVYISTNRFFAEKFRKYDVELIVEDTVHEEEKLGTIAAMRNALNILGEDDYLIVAGDNVFSFSLKDFVDNFSGKTLIAVYDVGDFELAKRYGVVVLEKDRVIDFEEKPANPKSTLISTGVYLFPRDVMKLLNEYLEDGNKDSPGYFLQWLLKRGEEIRAYRFDGYWYDIGSADSYLEAMKTLLKESYIEEIQISPYAKIIPPVVIKKGTKIMGRSIIGPYAYIGEECIIENSDISDSIIFPRTVIRNSTIWRSIIDEKCEIRNLELRKSLVGGHAKIQRGD

SEQ ID NO: 14406 - DNA, 1272 bp, Thermotoga maritima
  CDS (1)..(1272)
atgggaaataccgttgcgatgatactggcgggtggtcaggggacgcggctcggagttctcacggagagaatagcgaaacctgcggttccttttggagggaaataccgtctcatagattttactctgagcaattgtgtgaattctggaatctatagggtaggagttttgacccagtacagaccccatgttctctcgaaacacataggtattggaagaccctgggatctggacagaaaggacggaggggttgaaattcttccaccttacgtcgggaggcacgagtctgactggtacaaagggactgccaacgccgtctatcagaatctcgaatttctcgaagaaaacgatgcggaactcgtcctcatcctctcaggagatcacgtgtacgccatgaattacaacgatctcatagattaccatctgctcaaagaggcggatggaacgatagcctgcatggaagtgcccatcgaagaagcgagcagattcggtatcatgataacggacgtggatgggaggatcgtcgattttgaagaaaaaccggcaaaaccccggtcgaacctggcatctctgggaatctatgtcttcaactatgaattcctgaagaaagttctcatcgaagacgagaacgatccaaacagttcccacgattttggaaaagacgtgattccaagaattttgagggaaaatctcggttctctctacgcgttcagattcgacgggtactggagagacgttggtacgctcagatcttactgggaagccaatctggagcttgttcttccagtgccgcctttcaatctctacgatccaaactggaggtttttcacccacaccgaagagatgccgcccgcttacgtagctcctggttcgaaggtttccacctccctcgtgagtgaaggagcagaggtttatggcaacgttttcaactccgttattttccagggtgtgaagatcggtagaggaacagtggtgaaaaattcagtcataatgaccagaactgagataggagagaactgttatctggaaaacgtgataatagcggaaaatgtaaaaataggaagcaacgtcaggatgggagtgggtgaagacgctgaaagcaaactggatccaaaggtgtactcgggtcttctgacagtggttgggatgaattctgtgattcccgacgacatggtgataggaaagaactgtgttataggtattggtgtaagacctgaagacttcaaatcgaaaactttagaatcgggagattatgtgatagtcagggaggagtag

SEQ ID NO: 14407 - protein, 423 aa, Thermotoga maritima
MGNTVAMILAGGQGTRLGVLTERIAKPAVPFGGKYRLIDFTLSNCVNSGIYRVGVLTQYRPHVLSKHIGIGRPWDLDRKDGGVEILPPYVGRHESDWYKGTANAVYQNLEFLEENDAELVLILSGDHVYAMNYNDLIDYHLLKEADGTIACMEVPIEEASRFGIMITDVDGRIVDFEEKPAKPRSNLASLGIYVFNYEFLKKVLIEDENDPNSSHDFGKDVIPRILRENLGSLYAFRFDGYWRDVGTLRSYWEANLELVLPVPPFNLYDPNWRFFTHTEEMPPAYVAPGSKVSTSLVSEGAEVYGNVFNSVIFQGVKIGRGTVVKNSVIMTRTEIGENCYLENVIIAENVKIGSNVRMGVGEDAESKLDPKVYSGLLTVVGMNSVIPDDMVIGKNCVIGIGVRPEDFKSKTLESGDYVIVREE

SEQ ID NO: 14408 - DNA, 999 bp, Pyrococcus abyssi
  CDS (1)..(999)
atgaaagtcctaataatggctggaggttacgcaacgagactctggcccctaaccaaagataagccaaagcctctccttcccgttggaataaaaactatccttgactttataatggagaaagtcctcgagttaaacgtcgatgaagtatacatctcgacgaacaagttcttcgagcataagttcaaaccgtacgctgagaagtacggggtcgacttaattatagaggacacgtacagggaagaggagaagcttggaacaatcggggcaattaagaatgcgttggattccctaggattagacgactacttgataatagccggagataacatattctccctatcgcttagggacttcgtctccaaatttaccggtaaacctttaatagcagtttatgacgtcggtgaccttgagctcgctaagaggtatggagtcgtaatcctcgaaggtaatagggtggtaaagttcatagagaagccccaggagccaccttcaaccttaatcagcactggaatatacgccctaccaagggacgttatgggaatgatagatgagtacttgaaatacgggaacaaggacgccccaggatacttcattcaatggttgatagagagagggatcgaggtttacgcttacaaatttgatgacttctggtacgatatagggtcggctgacagctatttagaaagcttgaagatgctaatgaaggaaagctacattggtgatataaaggtcagcccatactcgaagataatcccacctgtagttattctcgatggaaccaggatagaaggcaggtcgatcataggaccctttgcttacatagggaggaactgtttaatagagaactccgacgtgagtgattcaataatctttgactccaccgtaataaggaactcaaccatctggaggtctataatcgacgagaaatgtgagataagaaatttagagctcaaaaagagcatcgtcggaggacatgcgaagatccagaggggagactaa

SEQ ID NO: 14409 - protein, 332 aa, Pyrococcus abyssi
MKVLIMAGGYATRLWPLTKDKPKPLLPVGIKTILDFIMEKVLELNVDEVYISTNKFFEHKFKPYAEKYGVDLIIEDTYREEEKLGTIGAIKNALDSLGLDDYLIIAGDNIFSLSLRDFVSKFTGKPLIAVYDVGDLELAKRYGVVILEGNRVVKFIEKPQEPPSTLISTGIYALPRDVMGMIDEYLKYGNKDAPGYFIQWLIERGIEVYAYKFDDFWYDIGSADSYLESLKMLMKESYIGDIKVSPYSKIIPPVVILDGTRIEGRSIIGPFAYIGRNCLIENSDVSDSIIFDSTVIRNSTIWRSIIDEKCEIRNLELKKSIVGGHAKIQRGD

SEQ ID NO: 14410 - DNA, 1335 bp, Deinococcus radiodurans
  CDS (1)..(1335)
atgccgaaccctaatgctctgcccggcgcggctcacctgagcggggcgggggctgcgcagactggcagtccgatgaagacccggattgctggcaaaaccattctcgccatcgtgctggccggggggcgcggcagccgcctctcgccgctgaccgacgagcgggccaaaccggcggtgccgtttctgggcacctaccgcctgatcgatttcaccctttccaacctcgttcacagcggcatcaacgacgtgtgggtcatcgagcagtacctgccgcacggcctgaacgaccacctctcgggcgggcgcccctgggacctcgaccgcacacgcggcgggctggtggtgatgccgcccttcgcgagcgccgagaacgaggaaggcgagttcgcgcagggcaacgcgcacgccctggcgcagcacgcgcacctcatccgcgagttcggcgccgacttggtgctggtcctgagcgccgaccatgtgtaccgcctagactactcggacgtgatccggcagcatgtggagcgcggcgcgagcgtgacgatggtcacgacggagctggcagacgaacagcaggccacccgcttcggcaacgtccgtgcggcgaagaatggcaaggtcagcgagttcgcctacaaacccgacgagccgctcggcaagaccgtaaccgccgaagtcttcgtgtacgacgcgcacatcatgctttccacgctggaagccctgtcaaaagagggcgagctgggcgactacggcgaggagctgctgcccgcgctggtggcccgtggtgacgcccacgcctttcccatgcacggttactggatggacgtgggcacgctggacgcttacttgcaaacccaccgcgattttctggacggcaaaggctttgcgctcgacgacccgcagtggcccttcatcacttccagcatcagccgcccgccgacccggatcgagaagaccgcccggctggacgaggcgttggtctgcggcggcgcggtgatcgccggggaagtcgtgcggagcctgattgccccgaacgcggtggtggaagcgggcgccgtggtccgcgactcggtggtgcagccgggtgccgtgattcgcgccggggcacaggtgagccgcgcggtggtggaccaggacgccgaagtcggcccgggctcgcgcgtgggcggacagaccggcaacagccgccccaccgtggtcggcgcccatgcccacctgggtcccggcgtgcaggtcggccccggtcaggtggtggccccgcgcacccgcgtgaaggcaggcgaggaggggcagaaggtgcaggagctggacgcggacgacaaggcggggaaaaagtag

SEQ ID NO: 14411 - protein, 444 aa, Deinococcus radiodurans
MPNPNALPGAAHLSGAGAAQTGSPMKTRIAGKTILAIVLAGGRGSRLSPLTDERAKPAVPFLGTYRLIDFTLSNLVHSGINDVWVIEQYLPHGLNDHLSGGRPWDLDRTRGGLVVMPPFASAENEEGEFAQGNAHALAQHAHLIREFGADLVLVLSADHVYRLDYSDVIRQHVERGASVTMVTTELADEQQATRFGNVRAAKNGKVSEFAYKPDEPLGKTVTAEVFVYDAHIMLSTLEALSKEGELGDYGEELLPALVARGDAHAFPMHGYWMDVGTLDAYLQTHRDFLDGKGFALDDPQWPFITSSISRPPTRIEKTARLDEALVCGGAVIAGEVVRSLIAPNAVVEAGAVVRDSVVQPGAVIRAGAQVSRAVVDQDAEVGPGSRVGGQTGNSRPTVVGAHAHLGPGVQVGPGQVVAPRTRVKAGEEGQKVQELDADDKAGKK

SEQ ID NO: 14412 - DNA, 1140 bp, Lactococcus lactis subsp. lactis
  CDS (1)..(1140)
atgaacaatagtaataaaatggcagcaatcctctcaaatatttcttcaagcaaacacttaagccccttaacagaggttcgtccgattgctactcttccttttgattgtaaatatcatttgattgattttccattgtcatcattatcaaatgcccatgtagataatatttttatgacctttaatgaaggagaaacgcaatctgtttttgaccatctaggttcaggtggcgaatggggcttggatggctttaatagtcgttactttgtctatattcaacaagattttgaccgtttaagggaacaaggtaaggattattttgctcaacagttaaattttttgcgtaaatctaaagcaccatatacagttcttttgggcagtaaatttatttgtaatgtcgatttaacggctgttcttaaaatacataaattggcaggtaaggaaataaccaccgtttataaaaaagtttctccagatttagcaagtgaatatgatacaattcttcgttttgatgaatcagggaaaatgagtaactgttatgttaatcaattagaaaatccccaagaaaaagaagccctttgtttgaatctctttatcgtgaacaccgattggttgattaattttataaaagagatgcaagatataggagaattgacttcaattgcccgtctcattcgtgtttatatgaagaactatgatgtgaatacttatgaatacacaggttatatgagtaatatcactaatattaagtcattttatgatgccaatatggtcatgctcgacccccaaaattttacctctcttttatatagtagccaacctgtttatactaagattaagaatgaagttcccacttatttttctgagaatagtaaagtggagaatagtcaattaggttctggttgtattatcaatggtaaagtaaaaaattctctcatttctcgtggagttaagattcaagatgatgccttaattgaagaatcattagtttttaccaactctgaagttaaaagtggcgctcaagttaaatttgccatcattgataaaggagtggttgtcgaaaataatgtcaaaattattggtagttcagaaaaaccagtagtgattcctaaaggaacagttgtgaccgcagatatcttatag

SEQ ID NO: 14413 - protein, 379 aa, Lactococcus lactis subsp. lactis
MNNSNKMAAILSNISSSKHLSPLTEVRPIATLPFDCKYHLIDFPLSSLSNAHVDNIFMTFNEGETQSVFDHLGSGGEWGLDGFNSRYFVYIQQDFDRLREQGKDYFAQQLNFLRKSKAPYTVLLGSKFICNVDLTAVLKIHKLAGKEITTVYKKVSPDLASEYDTILRFDESGKMSNCYVNQLENPQEKEALCLNLFIVNTDWLINFIKEMQDIGELTSIARLIRVYMKNYDVNTYEYTGYMSNITNIKSFYDANMVMLDPQNFTSLLYSSQPVYTKIKNEVPTYFSENSKVENSQLGSGCIINGKVKNSLISRGVKIQDDALIEESLVFTNSEVKSGAQVKFAIIDKGVVVENNVKIIGSSEKPVVIPKGTVVTADIL

SEQ ID NO: 14414 - DNA, 1395 bp, Aquifex aeolicus
  CDS (1)..(1395)
atgcgtgctgtaattctggctgccggactcggaacgaggttcaagagcgaaaaacccaaagttctccacgaaatactcggaaaaccgatgctctggtacgtgataacgaacgtaagaaacggaaggatagacgacatagctgtcgtggtgggacacaaggcgcaggaagtgatggaagcctttaaaaacgaaaacctgaaattttttatacaggaaaaccccaaaggcgggactgctgacgctgtactcgcagcgaaggactttttctcttcttacgagggatacgtactcataataaacggggacagtcccttagtcagcggggaaactataagaaacatgcaacaattcattcacatggttcggacttacgaggggataaaactcggaggggttgttttaacgacccaccttcccgaccctactggatacgggaggattataaaggaagaggggacggacagaattatcaggatagttgaggaaaaggacgcaactcccgaagaaaaggctataacggaaataaacgctggaacttacatcttttacgcaccttacctccttgaagccctatacaggataaaaccgagtcccgtgacaggagagctctacctgaccgacgtaatagagtacatggtaaacaaagggtatgaagtaaggagctttatggcaaaagaacccacggaagcccttggtgtaaacacccgctgggatttagcactcgtagaaaacgtaataaaactcaagatagcgaggtactgggccgaaaggggagttactgttcattatccagaaaccgtgtggatagaaccggacgtttccatagaacccgacgtggaaatatttcccgacgttatgttgaaaggaaagacgaaaataaagaaaggttcagtaataggaaagggaagcgttataaaggactcactcgtggaagaaaatgtaatagtaagggaatactcggtaatagaaaattcggaaattaagaaaagggctgttgtcggaccctttgcgaggataaggaacgaatctgttataggagaagaggctgaaatagggaactttgtggaagttaagaagagcagtataggaaaaggggtaaaggcaaagcacctcgcttacataggggatgcaactgtgggagagaatacgaatataggggcgggtacggtctttgcaaattacgacgggaagaggaaatacgagagctacgtaggaaaaagcgcctttataggtagtaactcccttttaatagctcctataagggtaggggattgggcttatatagcggggggttccgttgtaaacaaagatataccggaaggggcactcgcggtctcaaggcctgaactgaaaatttttgaaggaagggggaagaaaaaactccagaaagattaa

SEQ ID NO: 14415 - protein, 464 aa, Aquifex aeolicus
MRAVILAAGLGTRFKSEKPKVLHEILGKPMLWYVITNVRNGRIDDIAVVVGHKAQEVMEAFKNENLKFFIQENPKGGTADAVLAAKDFFSSYEGYVLIINGDSPLVSGETIRNMQQFIHMVRTYEGIKLGGVVLTTHLPDPTGYGRIIKEEGTDRIIRIVEEKDATPEEKAITEINAGTYIFYAPYLLEALYRIKPSPVTGELYLTDVIEYMVNKGYEVRSFMAKEPTEALGVNTRWDLALVENVIKLKIARYWAERGVTVHYPETVWIEPDVSIEPDVEIFPDVMLKGKTKIKKGSVIGKGSVIKDSLVEENVIVREYSVIENSEIKKRAVVGPFARIRNESVIGEEAEIGNFVEVKKSSIGKGVKAKHLAYIGDATVGENTNIGAGTVFANYDGKRKYESYVGKSAFIGSNSLLIAPIRVGDWAYIAGGSVVNKDIPEGALAVSRPELKIFEGRGKKKLQKD

SEQ ID NO: 14416 - DNA, 1215 bp, Mycobacterium tuberculosis
  CDS (1)..(1215)
atgagagaagtgccgcacgtgctgggcatagtcttagccggcggtgagggcaagcggctttatccgctgaccgcggaccgggccaagcccgcggttcctttcggcggcgcctatcgattgatcgatttcgtactctcaaacctcgtcaacgcccggtatctgaggatctgtgttctcacccaatacaagtcgcattcactggaccgccatatctcgcagaactggcggttgtctggtctggcgggtgagtacatcaccccggtgccggcacagcagcgcctcggcccgcgctggtataccggctccgccgatgcgatctatcaatcgctgaacttgatctacgacgaagatccagactacatagtggttttcggcgccgaccacgtctaccgtatggatcccgaacagatggtccggttccacatcgacagcggtgccggcgcgacggtggccggcatacgggttccacgtgaaaatgcgaccgcgttcggttgtatcgacgccgatgactccggccgtattcgcagcttcgttgagaagccgctggagccgcccggaacccccgacgaccccgacaccacgttcgtctcaatgggcaactacattttcacgaccaaggtgcttatcgacgcgattcgcgccgacgccgacgacgaccactcggaccacgacatgggtggtgacatcgttccgcggttggtggccgacggtatggcggcggtctatgacttctccgataacgaagtgcctggtgccaccgatcgcgaccgagcatattggcgcgacgtcgggacgcttgacgcgttttacgacgcacatatggacctggtgtcggtgcacccggtgttcaacctgtacaacaagcggtggccgatccgcggggagtcggagaacctggcgccggcgaagttcgtcaatggcggctccgcacaggagtcggtggttggtgccggcagcatcatctcggcggcctcggtgcgtaattcggtgctgtcgtcgaacgtcgtggtcgacgacggcgcgatcgttgagggcagtgtgatcatgcccggcacccgcgttgggcgcggggcggtggtgcgccacgcgatcctggacaagaacgtcgtcgtcgggcccggtgagatggtcggcgtggatctggagaaggaccgggaacgcttcgcgatcagcgccggcggcgtggtcgccgtgggcaagggtgtttggatctag

SEQ ID NO: 14417 - protein, 404 aa, Mycobacterium tuberculosis
MREVPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRENATAFGCIDADDSGRIRSFVEKPLEPPGTPDDPDTTFVSMGNYIFTTKVLIDAIRADADDDHSDHDMGGDIVPRLVADGMAAVYDFSDNEVPGATDRDRAYWRDVGTLDAFYDAHMDLVSVHPVFNLYNKRWPIRGESENLAPAKFVNGGSAQESVVGAGSIISAASVRNSVLSSNVVVDDGAIVEGSVIMPGTRVGRGAVVRHAILDKNVVVGPGEMVGVDLEKDRERFAISAGGVVAVGKGVWI

SEQ ID NO: 14418 - DNA, 1227 bp, Methanococcus jannaschii
  CDS (1)..(1227)
atggatgccataatattatgtgcagggaaaggggagagattaagacctctaacagagaacagaccaaaaccaatgattcctatagctggaaagccaattttacaacatattattgaaaaagttgaggatttggtagataatatttacttaattgttaagtataaaaaagaaaagattgttgattattttaaaaaccatccaaaaatcaaatttttagagcagggagaaatagatggaactggacaggcagttttaacagccaaggattatgtagatgatgaatttttagttataaatggggatattatctttgaagatgacttagaagaatttttaaaatacaaatatgctgttgctgttaaagaggtaaaaaatccagaaaactttggagttgtagttttagatgatgaaaataatattatagaactccaagaaaagccagaaaacccaaaatcaaatttaataaatgccggaatatacaaatttgacaaaaagatttttgaattaattgaaaaaacaaagatttctgaaagaggagagagagaacttacagatgcaataaaacatcttattaaagaagaaaaagttaaaggaattaagttaaatggttattggaacgatgttggaagaccatgggacattttggaggcaaataaatatctcctggataaaataaatacagatatcaaggggaaaattgaagaaaatgttgttattaaaggagaggttataatagaagagggagcaattgttaaagcaaattcagttattgaagggcctgcaattattaaaaaaggggctgttgtggggccgttagcttatataagaccatatactgttttaatggaaaatacttttgttggaaattcatctgaagttaaggcaagtataattatgaaaaatacaaaaattccacatctatcttatgttggagatagtataattggagagaactgcaattttggttgcaatacaataactgccaacttaagatttgatgataaaccagttaaagtcaatataaagagtaaaagggttgagagcgttagaaaattgggagttataatgggagataatgttaaaacaggtattcaagtctcttttatgccaggggttaaagttggaagtaactgctggattggggcaagttgtttaattgatagagatatagaaagtaatacatttgtttataaaagagatgagctgatatttagaaaattgaaatag

SEQ ID NO: 14419 - protein, 408 aa, Methanococcus jannaschii
MDAIILCAGKGERLRPLTENRPKPMIPIAGKPILQHIIEKVEDLVDNIYLIVKYKKEKIVDYFKNHPKIKFLEQGEIDGTGQAVLTAKDYVDDEFLVINGDIIFEDDLEEFLKYKYAVAVKEVKNPENFGVVVLDDENNIIELQEKPENPKSNLINAGIYKFDKKIFELIEKTKISERGERELTDAIKHLIKEEKVKGIKLNGYWNDVGRPWDILEANKYLLDKINTDIKGKIEENVVIKGEVIIEEGAIVKANSVIEGPAIIKKGAVVGPLAYIRPYTVLMENTFVGNSSEVKASIIMKNTKIPHLSYVGDSIIGENCNFGCNTITANLRFDDKPVKVNIKSKRVESVRKLGVIMGDNVKTGIQVSFMPGVKVGSNCWIGASCLIDRDIESNTFVYKRDELIFRKLK

SEQ ID NO: 14420 - DNA, 1260 bp, Pyrococcus horikoshii
  CDS (1)..(1260)
atgaaagcggtaatacttgccgcaggaaagggagagaggctaagacctttaacggatgacagacctaaacctattttgaagattgcaaataagccaattatagagtacatacttgagaatctagatccattcgttgatgaatttataattgtagttaaatacaaaaaggagaaaataattgaaacccttggcgatgaattccatggaaagccaataacgtacgttgtccaaggggatgaagaaggaactgcaagggctatatattcagcaaaggatgccatcattgatgaggaatttttcgccataaatggcgatatatactttgaacaggaagccattaggggacttctacacacctacaggaaaatgaaggcagatggtggaatcgtggttaaaaagtttgaaaacctatcccaattggggcttgttgaggttaagaataatctagtaaaaaagataatagaaaagccaggaaaaatggaaggctttgcaaatcttggaatttacatctttaacagtgaagtctttgacttcattgaagaaacggaaaaaagtgaaaggggagagtacgagattaccgatactatcaatataatgatagagaggggaaagaggatagtatattttgaatataaaggattttggagtgatataggtagaccatgggatcttctcgaggttaacgagtacatccttaagacgaagctcaaacataacattaggggaactgtggaggaaggggctactataattcctccagtcgaaataggggaaggaactatagtaagatctggtagctatatcattggtccagtaaaaattggaaagaactgtaggatagggccaaactgcttcattaggccatacactagcataggagataactgtcatatagggaacgcagtcgaagttaagaactcgataatcatggataactcaaatgccccccatctcaactacgttggagattcgataataggagaaaatacgaaccttggggccggtaccattaccgctaacctaaggcacgataacaagacggtaaaggttgagattaaaggtaacctcgaagattccggaagaaggaagcttggagcaataatagggcataacgtgaaaactggaataaacgtgagcatatatccgggaagaaaaattggaagtggagctcttgtaggccctggagtaatagtcgataaaaacatccccccaggagttttagtggtagctaaacaggaaaagatggtgacaaaaagatga

SEQ ID NO: 14421 - protein, 419 aa, Pyrococcus horikoshii
MKAVILAAGKGERLRPLTDDRPKPILKIANKPIIEYILENLDPFVDEFIIVVKYKKEKIIETLGDEFHGKPITYVVQGDEEGTARAIYSAKDAIIDEEFFAINGDIYFEQEAIRGLLHTYRKMKADGGIVVKKFENLSQLGLVEVKNNLVKKIIEKPGKMEGFANLGIYIFNSEVFDFIEETEKSERGEYEITDTINIMIERGKRIVYFEYKGFWSDIGRPWDLLEVNEYILKTKLKHNIRGTVEEGATIIPPVEIGEGTIVRSGSYIIGPVKIGKNCRIGPNCFIRPYTSIGDNCHIGNAVEVKNSIIMDNSNAPHLNYVGDSIIGENTNLGAGTITANLRHDNKTVKVEIKGNLEDSGRRKLGAIIGHNVKTGINVSIYPGRKIGSGALVGPGVIVDKNIPPGVLVVAKQEKMVTKR

SEQ ID NO: 14422 - DNA, 1107 bp, Bacillus halodurans
  CDS (1)..(1107)
atgaaatcacttatgggtgttgttaacctcgatcacgatcaagacctgttgcacgagcttacgtattttcgcagcgtagcaggtgtcccgtttggcggacgctaccggatgattgattttgttctttccaatatggtgaatagcggtatccaagatatcgccgtgtttgcccgaaataaatatcgctcccttatggatcacttaggaacaggtgctccatgggatttaaatcgaaaacgaggtggattatttatccttcctcctgattggaatgatcctaccgacatttcgaaaggagatttacgtcactttcataaccatcgtgatttctttcatcgcggaaacgccgatcacgtccttgttagtggaagtcaattcatctcgaaggttgattacgaggatgccttcaaaagacaccaagaaacgaaagcggatgtgaccgttttatataaaaaagtggatcagcttgaaccagaggatcggtatcgaatgaagcttgagtttgattcgtttggaaatgtgaaaagtatcaccaatgacgaaatgaattcgaatctttatatgcaaatgtacattattcgcaaagaattactcttggagcttttaaatcactgcatagggtaccacaagcaagatctgtttgtagacggtattatgagcaatcttaatgagctcgcaattcgcgcgtatgaatataaaggctatctctcaatcatttcttctgttgctagctactacaaacatagcatggaccttttaaagccagaaatctaccaatcgctctttttagctggttcccctatctatacaaaaattaaagatgaaccgccagcaaagtatgtgaacggctcagaagtatcgaactctttagttgcaaacggctgcgtcattgaaggtcatgttgaaaactcgatcttgtttcgcggcgtgtatgtggctaaaggggtatcgattaaaaactcgatcattatgcagcgttgttacattcatgaggatacccacctagaccatgtcatccttgataaagatatccttatatcaccgaaccgacaatttgctggagcccctgaacagccgtttgtcattgccaaacgtaaagccatgtaa

SEQ ID NO: 14423 - protein, 368 aa, Bacillus halodurans
MKSLMGVVNLDHDQDLLHELTYFRSVAGVPFGGRYRMIDFVLSNMVNSGIQDIAVFARNKYRSLMDHLGTGAPWDLNRKRGGLFILPPDWNDPTDISKGDLRHFHNHRDFFHRGNADHVLVSGSQFISKVDYEDAFKRHQETKADVTVLYKKVDQLEPEDRYRMKLEFDSFGNVKSITNDEMNSNLYMQMYIIRKELLLELLNHCIGYHKQDLFVDGIMSNLNELAIRAYEYKGYLSIISSVASYYKHSMDLLKPEIYQSLFLAGSPIYTKIKDEPPAKYVNGSEVSNSLVANGCVIEGHVENSILFRGVYVAKGVSIKNSIIMQRCYIHEDTHLDHVILDKDILISPNRQFAGAPEQPFVIAKRKAM

SEQ ID NO: 14424 - DNA, 1086 bp, Sulfolobus solfataricus
  CDS (1)..(1086)
atggtatccgcaattgtactagctggaggttatgctactagacttaggcctttaagtttgactaaaccgaaagctcttttccccattttaaacaaacctatactgggttacattttggaaagtcttatcaattccgatgttagtgatatatatttatcattaagagtaatggctgacaagataatcgattacttaaaggatactagcatgctagataaggttaagatagaagttgaaagtgaacctttaggtgatgcaggacctttaaaattgatctcccagaagtataatttagatgatgacgttttggtcatatatggagatatatatagtgagataaatataaaatcccttctcgatttttattataaaaagagttgtgatgcagtagtagttggtacggaagttgaagatccgagaagatatggtgtactttatacagaaaatgatgtcttagtagagttaatagaaaaacctaaaaaacctataagcaatttgattaacggaggagtatatatttttaaaaaggatctattcaagttagtagaaactccatcttctattagtaaggattttttacctaagctacttagaactaagtccatttcagtgtataaatatcacgggatatgggcagatataggagtcccagacgactatcttagactcaattttgaagtattagtacagaaataccctaagggttatataaactcgtcagctaaggtcagtgaaaaatctacgcttattccgccctattatattggttcgaaaaatgttattggagaggatgcatatattacctctaatactattttgggtaatgatgtagaaataggaaaaggaacatacatatctgagagtatactaatgaataaagtgcaagttaaagaatatacatatatctcaggatctataatagctgacaaaactaagatagggagatggaatcatatattagatgggtctattttaggtgaagaggtaattactagcgatggagtacttataaatcgacgtacgataatcttgcctaataaggaagtgaaggaacacgtttatgataaaggcaaaataatactataa

SEQ ID NO: 14425 - protein, 361 aa, Sulfolobus solfataricus
MVSAIVLAGGYATRLRPLSLTKPKALFPILNKPILGYILESLINSDVSDIYLSLRVMADKIIDYLKDTSMLDKVKIEVESEPLGDAGPLKLISQKYNLDDDVLVIYGDIYSEINIKSLLDFYYKKSCDAVVVGTEVEDPRRYGVLYTENDVLVELIEKPKKPISNLINGGVYIFKKDLFKLVETPSSISKDFLPKLLRTKSISVYKYHGIWADIGVPDDYLRLNFEVLVQKYPKGYINSSAKVSEKSTLIPPYYIGSKNVIGEDAYITSNTILGNDVEIGKGTYISESILMNKVQVKEYTYISGSIIADKTKIGRWNHILDGSILGEEVITSDGVLINRRTIILPNKEVKEHVYDKGKIIL

SEQ ID NO: 14426 - DNA, 1158 bp, Methanobacterium thermoautotrophicum
  CDS (1)..(1158)
atgttcatgacatctgttgttgtcatggcggggggaaagggtacaagaataagacccttaacattctcaaggccaaaaccacttgtacctgttgcaaacaggccaatcctcgattacataatccatagggttcttgattctggttacagtaaggttgtgatgacccttgggtaccttaaagatcagataagatcccacgttctcgcagagtaccctgagattgactttagattctcagtcgaaaagaagccacttggaactgctggaggtgtgaaggcagccgccagtgaaataaatgaaaccttcattgtactcagtggcgatgtaatctttgatcttgatctgcgagaaatggtaaaattccacagaaaaaagaatgcccttgtcacagtggcgctcacaccagttgaagatccctcacattatggaatagcggttctcgatgatgatgggaagataaaacgattccatgagaaaccacgccccgaagaggtcttcagcaaaatcgccaatgctggcatatatgtgatggaaccggaggtcattgaacacatcccccagggaagctctgacttttcagccgatattttccctgttctgatagagagggatgccgggatgtatggattccttttcgacggatactggaatgatgccggcaaacccaacacattcttaagggccaatcatgatgtcttgaatggaacagtgactcctgaacctgatggtgagatagctgaggaggtgcccggtagatttggaaagatatggatcggcagggatgtcgttatcggtgacagggtccgtattgtgggaccagcggtactcggggatggttcaagggtagatgatggtgcatacataggtaaaaacaccgtgattggatcccgtgttaacgtgggggagaacagctttataagggggtctgttattcttgatggctgtgtgattggaagaggttctcagcttctaaactgtgttgtagatgaagactgtgaaataggagcaggatgtgcaattgacagatgcgcaataattggtcgcggggcatttataggtccctccaccgttatcagatctcactgcagcgtcagtaaccgtctcaggatattatctggctcccttgtggactcagactatccgctggtacctgagtga

SEQ ID NO: 14427 - protein, 385 aa, Methanobacterium thermoautotrophicum
MFMTSVVVMAGGKGTRIRPLTFSRPKPLVPVANRPILDYIIHRVLDSGYSKVVMTLGYLKDQIRSHVLAEYPEIDFRFSVEKKPLGTAGGVKAAASEINETFIVLSGDVIFDLDLREMVKFHRKKNALVTVALTPVEDPSHYGIAVLDDDGKIKRFHEKPRPEEVFSKIANAGIYVMEPEVIEHIPQGSSDFSADIFPVLIERDAGMYGFLFDGYWNDAGKPNTFLRANHDVLNGTVTPEPDGEIAEEVPGRFGKIWIGRDVVIGDRVRIVGPAVLGDGSRVDDGAYIGKNTVIGSRVNVGENSFIRGSVILDGCVIGRGSQLLNCVVDEDCEIGAGCAIDRCAIIGRGAFIGPSTVIRSHCSVSNRLRILSGSLVDSDYPLVPE

SEQ ID NO: 14428 - DNA, 1326 bp, Chlamydia trachomatis
  CDS (1)..(1326)
atggctggtagacggacgaaagaagagcagatcaatcgaaaacgatcgcatttctatcgagataacgtaggagttattgtcttatgcggaggagaggggaaacgattatctccgttaacttgttggcgttgtaagccaacagtatcttttgggggaagatacaagcttattgatgtgcctatatctcatgcctttgcctcaggattttccaagatttttgttatcgggcaataccttacctatactttacagcaacacttatttaagacgtatttttaccatggagtcatgcaggatcagattcatctcttggtccctgaaagacgagatggaagtcaggtttggtatcagggaacagctgatgcaattcgccaaaatcttctttatctacaagattctcgtgtagagtattttttaatcttgtcaggtgaccaactatacaatatggattttcgctcgatagtagattatgctatcgatgcacaggcggatatggtgatcgcttctcagcctgtatcagataaagatgtttcacgattcggagtgttgaaagtagacgatgagtcgaaactgattgatttctatgagaaacctcaaagtgaagagattttgaaacattttcgtctaagtaacacggcgatgaaaaaatttggtctcgatcctcagcacgggaattttctaggatctatggggatttatcttttccgtaaagattgtctcttccaattgcttctagaagaaactggagatgattttgggaaagagctgattcatagacaaatgcatcgcgggaaaactgttgcatatctgtacgacggttattggacagatatcgggactatagaatcttattacgaagctaatatggctttgactcaacggccttcgcacaatattcgtgggtttaattgttatgatgacggggggataatctatagtaaaaataatcatcttcctggagcaattatttcagattcgagaatttcgagttctttactgtgtgaaggagctatgattgagtctggccaggtctcgaatagtgtcgttggagttcgaggggtaataggccaaggatctgtgtttgaccgttctatcatgatgggaagcgattcgtatggttctgagtctttccctttagggattgggaaaaactgtgaaattcataaaaccattattgatgaaaactgctgtataggaaacggtgtgcgtttacagaatctgcaggggcataaggattatgattctccagatgggaaattagttgttcgagatggtattatcatcgttcctagaggaacgcaaatcccagataattacgtattttag

SEQ ID NO: 14429 - protein, 441 aa, Chlamydia trachomatis
MAGRRTKEEQINRKRSHFYRDNVGVIVLCGGEGKRLSPLTCWRCKPTVSFGGRYKLIDVPISHAFASGFSKIFVIGQYLTYTLQQHLFKTYFYHGVMQDQIHLLVPERRDGSQVWYQGTADAIRQNLLYLQDSRVEYFLILSGDQLYNMDFRSIVDYAIDAQADMVIASQPVSDKDVSRFGVLKVDDESKLIDFYEKPQSEEILKHFRLSNTAMKKFGLDPQHGNFLGSMGIYLFRKDCLFQLLLEETGDDFGKELIHRQMHRGKTVAYLYDGYWTDIGTIESYYEANMALTQRPSHNIRGFNCYDDGGIIYSKNNHLPGAIISDSRISSSLLCEGAMIESGQVSNSVVGVRGVIGQGSVFDRSIMMGSDSYGSESFPLGIGKNCEIHKTIIDENCCIGNGVRLQNLQGHKDYDSPDGKLVVRDGIIIVPRGTQIPDNYVF

SEQ ID NO: 14430 - DNA, 1260 bp, Pyrococcus abyssi
  CDS (1)..(1260)
atgaaagcagttgttcttgcggctgggaaaggagagagattaaggccactaaccgatgataggccaaaaccgatcttgaaagtcgccaataaacccataattgagtacatacttgagaacctagacccattcgttgatgagttcattataatcgtgaaatacatgaaggagaagataattgaaactcttggtgatgaattccacggaaaacccataacgtacgtttcccaagttgaggaagagggaacggcaaaggccatttattctgcaaaagattacattgaagaggaggagttcttcgcgataaatggagatatatacttcgaacaggaagcaataaggggattgctccacgtttataagaaaacaaaagctaatgcagcactcgttgtcaagaagtttgatgatctatctcagctcgggatggtaaaaaccgaaggaggttatgtaagggaaatagttgagaaacctgggaacgttggtgggttggcgaacttgggaatttacatattcaatccagacgttttcgagtttatcgaacgaacccaggaaagcgagaggggagaatatgaaataacagataccataaacctaatgattagtgatggaaggaaagttgcgtactttgaatactccggcttctggagtgacattggaagaccttgggatcttttggaggtcaatgagtacatactcaagaccaaacttaagcatgacatcagggggactgttgaggaaggggctactataatcccaccggtggagatcggagagggaactgtggtaaggtcaggaagttacataattgggccggttaagattggaaagaactgtagaattgggcccaactgcttcataagaccctacacgagcataggggacaactgccacattggtaatgccgttgagattaagaactcgataatcatggataattcaaatgctccccatcttaactatgttggcgattcaatcgtgggggagaacacaaacctaggggctggaaccataacggcaaaccttagacacgacaacagaacgataaaggttgaaataaaaggtaaactcgaagattcgggaagaaggaagctaggagccataataggccacaacgttaagactggtataaacgttaccatatacccaggaaggaaaataggaagcggagccttagtcgggccgggagtgatagtggacaagaacattccacctaacgtcttggtcgttgcaaagcaagaaaagatagtgaaggagatatga

SEQ ID NO: 14431 - protein, 419 aa, Pyrococcus abyssi
MKAVVLAAGKGERLRPLTDDRPKPILKVANKPIIEYILENLDPFVDEFIIIVKYMKEKIIETLGDEFHGKPITYVSQVEEEGTAKAIYSAKDYIEEEEFFAINGDIYFEQEAIRGLLHVYKKTKANAALVVKKFDDLSQLGMVKTEGGYVREIVEKPGNVGGLANLGIYIFNPDVFEFIERTQESERGEYEITDTINLMISDGRKVAYFEYSGFWSDIGRPWDLLEVNEYILKTKLKHDIRGTVEEGATIIPPVEIGEGTVVRSGSYIIGPVKIGKNCRIGPNCFIRPYTSIGDNCHIGNAVEIKNSIIMDNSNAPHLNYVGDSIVGENTNLGAGTITANLRHDNRTIKVEIKGKLEDSGRRKLGAIIGHNVKTGINVTIYPGRKIGSGALVGPGVIVDKNIPPNVLVVAKQEKIVKEI

SEQ ID NO: 14432 - DNA, 1218 bp, Vibrio cholerae
  CDS (1)..(1218)
atggctggagtattaggcatgattttggcgggaggagaagggtcacgtttgaagccgttgactgaaacccgtaccaagccggcagttccttttggtggaagctaccgtttaatcgactttgcactcaataatttcgtgaatgccgatttaatgcggatttatgttctgacgcagttcaaatcgcaatcgctatacattcatatgaaaaagggctggaatctttccgggatcaccgaccgttttatcgacattattccagcacagatgcgtgatggaaaacgttggtatgaaggcactgccgatgcgatttatcaaaacctccgttttgttgagatcgtcgcgccggatcaagtctgtatttttggttcagaccatatctacaagatggatattcgccaaatgctcgattttcatcgccgtatggaagcggagttgaccgtttctgcactgcgtatgccgatcagccaagcctctcagttcggggtgattgaagtggatgaaaacggcaaaatggtcggttttgaagagaaaccgagcaatcccaaatcgatccccggtgagcctgagtgggcactggtctcgatgggtaactacatcttcgaagcggaaacgctcagcaaagaactgcgtgaagatgctgaaaataaccagtccagccatgactttggcaaagacattattccgaaaatgttcccgcgcggtaaagtctatgtgtatgacttcacgaccaacaaaattaagggagagaaggaatcgacctactggcgtgatgtcggaaccatcgaatcgtattggtcggcacatatggacttgctcgacaaagatccagaattttcgctatacaaccgtagttggccgctgcacacctactatcctcctttgccacctgcgacgtttgtggatgtcaaagacaagaaagtcaaaatcacagatagcttgatctctgggggaagttatatccaaggatcaaccatttataaatcagttctgggtttccgtagcaacattgctgctggctcttttatcagtgaatctgttatcttgggcgacgtgaaaattggagctggctgcacgattaagcgcgccattatcgataaagatgtcgagatcgccgccggtaccatcattggtgaagatttggaaatggacagaaagcgtttccacgtttccgatgaagggattgtggtgattgcgaaaggtagtaaggtaggattctag

SEQ ID NO: 14433 - protein, 405 aa, Vibrio cholerae
MAGVLGMILAGGEGSRLKPLTETRTKPAVPFGGSYRLIDFALNNFVNADLMRIYVLTQFKSQSLYIHMKKGWNLSGITDRFIDIIPAQMRDGKRWYEGTADAIYQNLRFVEIVAPDQVCIFGSDHIYKMDIRQMLDFHRRMEAELTVSALRMPISQASQFGVIEVDENGKMVGFEEKPSNPKSIPGEPEWALVSMGNYIFEAETLSKELREDAENNQSSHDFGKDIIPKMFPRGKVYVYDFTTNKIKGEKESTYWRDVGTIESYWSAHMDLLDKDPEFSLYNRSWPLHTYYPPLPPATFVDVKDKKVKITDSLISGGSYIQGSTIYKSVLGFRSNIAAGSFISESVILGDVKIGAGCTIKRAIIDKDVEIAAGTIIGEDLEMDRKRFHVSDEGIVVIAKGSKVGF

SEQ ID NO: 14434 - DNA, 1152 bp, Bacillus halodurans
  CDS (1)..(1152)
atgaaaaaagaaattgtaggaatgctccttgcaggaggagaaggaaagaggcttggtcaactgactagaaagttagcaaagccagctgtctattttggggggaaatatcgaattatcgatttcccattgagcaattgcacgaactcaggtatcgatacggttggtgttcttacccaatacgaaccgctcgccttaaacggtcacattggaatcgggagtccttgggatttagatcgacgtcatggaggagtgaccgttctccctccctacatcgaaaaacaaggaggctcttggtacaaaggtaccgctgacgccatctaccaaaacagatactacattgagcagtatgatcctgaatatgtcctcattttatcaggggatcacatttacaaaatggactacgaccgcatgattagccatcataaaaaacttggggctgatgctacgatttcagtcattgaagtcccatgggaagaagcgagtcgttttggcattatgaatacaaatgaggaaatgacgattacccaatttgaagaaaaaccgaccacaccgataagcaacctcgcttcaatgggcatttatatttttaattggtctgtactaaaatcttatctgatccaagatgcgaagcaagcaaactcgagccatgactttggaaaagatattataccgaaaatgcttgcaaaagatttaaagcttgtcgcctacccgtttgaaggttattggaaagatgttggaacaatcaaaagttattgggaagctaatatggacttactggatgaacattcttctctgatgttaaatgatccgtcttggcggatttactcggtcaatcgtaaccagccacctcaatatatttcgacgagagcctacgttagatgctcactcgtgaatgaagggtgcgtcgtccatggaaatgtagagcaatccattttgtttcctggtgtccatatcggtgcaaactcctcagtcttcgaatctgtgttaatgccaaatgtaaaagtgggagaaaatgtcgttcttcggcgaacaattattatggaaggagcgtgcatcccatcaggtactcacttagctccaagcgatccagatgatattctcgtcatcgataaagatactgaattttccccttcaattgcagcaaatcaatga

SEQ ID NO: 14435 - protein, 383 aa, Bacillus halodurans
MKKEIVGMLLAGGEGKRLGQLTRKLAKPAVYFGGKYRIIDFPLSNCTNSGIDTVGVLTQYEPLALNGHIGIGSPWDLDRRHGGVTVLPPYIEKQGGSWYKGTADAIYQNRYYIEQYDPEYVLILSGDHIYKMDYDRMISHHKKLGADATISVIEVPWEEASRFGIMNTNEEMTITQFEEKPTTPISNLASMGIYIFNWSVLKSYLIQDAKQANSSHDFGKDIIPKMLAKDLKLVAYPFEGYWKDVGTIKSYWEANMDLLDEHSSLMLNDPSWRIYSVNRNQPPQYISTRAYVRCSLVNEGCVVHGNVEQSILFPGVHIGANSSVFESVLMPNVKVGENVVLRRTIIMEGACIPSGTHLAPSDPDDILVIDKDTEFSPSIAANQ

SEQ ID NO: 14436 - DNA, 1952 bp, Arabidopsis thaliana (mouse-ear cress)
  CDS (295)..(1851)
ccgtttctctttccactgccaaaagttaaagctctctctctcactcaatcacacactcatttctcactatttcacaacttccttgtggacaaaattagtcgacttctctgttctctccaacactgtttcgttttcactacccaaaattcgaatctgggttattgaaaaagttccaatttttttatctgggtttttcgaaagctgatatctttttagaatctgatctatctcttctacttcatttcccttgcatttttttaataagttgtagaatctgtcttgttctggaaaaatatggagtcttgctttcctgccatgaagctgaatcagtgtacctttggtctcaacaacgaaattgtctctgagagagttagtgcgttctggggaacccaagttgtcaagcccaatcatttgaggacaacgaaacttaggagtgcacctcagaagaagattcagacaaacctcattcgctccgttcttactccatttgttgatcaagagtctcatgaacctctgttgagaactcaaaatgcagaccctaagaatgtagcgtctatcatactaggtggtggtgctgggactcgcttgttccctcttacaagcaagagagctaaacctgcggtgccaattggagggtgttacaggctgatagatataccgatgagcaattgcatcaacagtggtattagaaagatcttcatcttaactcagttcaactcattttctctcaatcgccacttgtctcgtacttacaactttggcaatggagtcaattttggtgatgggtttgttgaggtccttgctgcaacccaaacttccggagatgcaggaaagaaatggtttcagggaactgctgatgctgttaggcagtttatatgggtctttgaggatgccaagacaaagaatgtggaacatgtcttgatcttgtctggggatcatctctatcggatggattacatgaactttgtgcagaagcacattgagtccaatgctgatatcacagtttcttgtcttcccatggatgagagccgtgcttcggactttgggctgcttaaaattgaccagtctggtaaaatcattcaattctcggaaaaaccaaagggagatgacttaaaggcaatgcaagttgacacttccattcttggtttaccaccgaaagaagctgcggagtccccatacattgcatcgatgggtgtttacgtatttagaaaagaggttttgctaaagcttctaaggtcaagttatcctacatccaatgactttggttctgaaattatcccgttggccgtaggggagcataatgttcaggcatttttgttcaatgactattgggaggatattggaaccataggatcattctttgatgccaatttagccctcacggaacagcctcctaaattccaattctacgatcaaaaaacacccttcttcacttctccaagattcttgccacctaccaaagttgataaatgcaggatacttgattccatagtttcacatggatgcttcttgagagaatgcagtgtgcagcactcaatcgttggcatacgatcacgtctcgagtctggagtagagcttcaggatacaatgatgatgggagctgatttctaccaaacggaagctgagatcgcgtctcttttggcggaagggaaagttccggtaggggttggccagaacacaaaaatcaagaactgtatcattgacaagaacgccaagatcgggaagaacgtggtcatagcgaatgcagatggcgtggaagaaggcgatagaccagaggaagggtttcacataagatcaggcatcaccgttgtgctgaagaacgccaccattagagatggtctgcatatttaagcttttaaacctctctttaggagcagtgtatgtggcttcttgtgattttgtaacgagactagttacgttcgattaataatttaataaaaaaaaaaaaaaaa

SEQ ID NO: 14437 - protein, 518 aa, Arabidopsis thaliana (mouse-ear cress)
MESCFPAMKLNQCTFGLNNEIVSERVSAFWGTQVVKPNHLRTTKLRSAPQKKIQTNLIRSVLTPFVDQESHEPLLRTQNADPKNVASIILGGGAGTRLFPLTSKRAKPAVPIGGCYRLIDIPMSNCINSGIRKIFILTQFNSFSLNRHLSRTYNFGNGVNFGDGFVEVLAATQTSGDAGKKWFQGTADAVRQFIWVFEDAKTKNVEHVLILSGDHLYRMDYMNFVQKHIESNADITVSCLPMDESRASDFGLLKIDQSGKIIQFSEKPKGDDLKAMQVDTSILGLPPKEAAESPYIASMGVYVFRKEVLLKLLRSSYPTSNDFGSEIIPLAVGEHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTKIKNCIIDKNAKIGKNVVIANADGVEEGDRPEEGFHIRSGITVVLKNATIRDGLHI

SEQ ID NO: 14438 - DNA, 1143 bp, Clostridium acetobutylicum
  CDS (1)..(1143)
atgtcaaagaaagaaattatagctatgattcttgcaggtggtcaaggaagcagactcggtatacttactagaagaacagcaaaacctgcagtaccatttggtggtaaatatagaattattgattttacactaagtaattgttctaactccggaatagatactgtaggagttttaactcaatacaagccattagcactaaattctcatataggtatcggaagtccatgggatttagatagaaccagcggtggagtgagcgttcttcctccatacatgaaggagactgggggaaattggtacaaaggaactgccaatgctatttatcaaaacagacattttatagagaattatgatcctgaatacgtggtcatattatcgggagatcacatatataagatgaactatttagaaatgcttgatttccataagaaaaaaaatgctgatgcaacaattgctgtattcgaagttcctttaaatgaagccagcagattcggcattatgaacactgacgaagacgatagaataaatgaatttgaagaaaagccaaaaaaaccaaaaaacaatctagcttctatgggcatatatattttcaactggagattccttaaaagatttttagaagaagatgcaagagatgaatcctcaaacaatgatttcggcaaaaatataattcctaatatgcttaataaaaaaagaaaactctatgcctatagatttaatggctattggaaagatgttggtacaattcaaagcttatgggaagccaatatggatttattagatgataacaatagtttaaatatatatgatcctaaatggaaaatttattctgtaaaccctactatgcctcctcaatacatagcctgcaattccgatgtgaaaagatctttggtggttgaaggatgtatagtattagggaaagtatacaattctgtgttatttcctggtgtttatattggaagggatacaattataacaaattccgtaatcatgccaaatgtaatcgtaggtaataatgtaattattaaaaaatctataataggtagtaatgcaagagtagatgataacgtaattgtaggtactaatgacaatatctctgtggtaggtgcaggaagtaaagtaaaggaaagcattatacaataa

SEQ ID NO: 14439 - protein, 380 aa, Clostridium acetobutylicum
MSKKEIIAMILAGGQGSRLGILTRRTAKPAVPFGGKYRIIDFTLSNCSNSGIDTVGVLTQYKPLALNSHIGIGSPWDLDRTSGGVSVLPPYMKETGGNWYKGTANAIYQNRHFIENYDPEYVVILSGDHIYKMNYLEMLDFHKKKNADATIAVFEVPLNEASRFGIMNTDEDDRINEFEEKPKKPKNNLASMGIYIFNWRFLKRFLEEDARDESSNNDFGKNIIPNMLNKKRKLYAYRFNGYWKDVGTIQSLWEANMDLLDDNNSLNIYDPKWKIYSVNPTMPPQYIACNSDVKRSLVVEGCIVLGKVYNSVLFPGVYIGRDTIITNSVIMPNVIVGNNVIIKKSIIGSNARVDDNVIVGTNDNISVVGAGSKVKESIIQ

SEQ ID NO: 14440 - DNA, 2448 bp, Clostridium acetobutylicum
  CDS (1)..(2448)
atgaaagcaattattatggcaggaggtcagggtaaaagacttagaccacttacatgcaatttacctaaacctatgatgccaattatgcaaaagcctgttttacaatatattatagagcttttgaaaaaacatgggataaatgaaatcggtattacactgcattaccttccagatgaagttatggattactttggagatggaaaagaacttggagtaaatatacattattttatagagcaaagtcctttgggaactgctggcagtgttaggaatgctgagagttttcttgatgaaacctttgtggttataagcggagatgctttaactgatgtgaatttaactaatatcttacaataccacaaagaaaaaaacgctatggtaacgattgtgctgaagaaggtaactatacctcttgaatatggagttgcaattacggacacagaggggagaataagtaattttattgagaagcctggttggggagaaatatttagtgacaaagcaaatacagggatatatgtaatggagccaggtatatttgaattctataataaggataaaaagtttgattttagtgaggaattatttcctgaacttttaaagagtggcaaagagatttttggttatgtggttaatgattattggagggatataggaaatatagagcaatttatgaaatgtaattttgatatattaaatggatatgtagatgtagatgtagatatagatgctagtcagcatcagaagggtgtatggattggaaaaaatacaatagtaagtgataatgtaaaagttattccaccagtttatataggagataattctgaaatacgttatggtgcagagatagggccttttgccgttataggtagaaataatattatatctgaaatggctactataaagagaagtataatatttgaaaattgttatataggaagtggtgcagaacttaggggaagcgtagtgtcaaataatgttcaagtgggcgggggagtatcaacttttgaggaatctgccattggaacaggaagcttggtaggggagaaaagtgttgtaaaagcaggagttaaaatatggccggacaaagttataggaagtaaaacaataataaagacaaatgttgtgtggggagaaaataggtgtaaggtgcttttcggtaaagaaggtataagtggagaaataaatgtagaattaacgccagaatttgtatcgaaattagcatctgcatttgcatcaaacttaaggatgaattcaaaggttgtagtatgttcagattacaatttggcagctgaaatgcttaagtattcttttgtttcaggtcttatttcaatgggaatagaggtttattctgcaaaagagatgacgataccaatgcttaggttttctacagcatattttaaagcagatgctgctgtatatatatattgtaaaggtagtaataaagaaaaagtaaatatattattcatagataaggatggaataatgatatcaaggtctatggagaaaaaaatagcaaacagctttttaagggaagatttcagaagaactagagcaaataactttaaaagattaagagactttggagaatgtatgggttattatgaagattatattaaagaaaatttgtgcatacaagaaataagaaatagtgggctgaaggttgcagtatcaatggaaaataagcttataaaaaatgaagtaaagagtatattttcagatcttaaaattcagtatagtatatatgataattatgcggatttagaagggttaaaaaaagaagttatagagaaaaaaatggattttggtgtttgcatatctgagaattgtgataaagcaataattattgatgaaaacgctaatataataagtactcaaatgtatgagagtataaaagcactgatactaataagtgtatataaatttaaaactatagtggcacctgttaattcttctaaagctttaaagtatatagctaagagatataattgcaaatatgttaagtcaaaaatttcagaaagatatattttaaatgaatatatcttgaatgaaaaggataaaaatataaaagaggttttgttttcatatctttctagtacagatgctttaaacatagtaataaatataattaacatcttagctagaggtaaaataaagctctctgagcttatggaaagaataccaaattatattttaagagaaaaagaaatagcttgttcctgggataataagggcaaaattatgagaagcttaatagaagaaaatatatcaaagtcaatagaacttattgagggaattaaggtaaattatgaagacgcttgggttcttattatacctgactcagatgaacccatatgtaagatatatgctgaatctaacgatgaagaaaaaactgataagattataaatgagtttgaaagcgaaatagaattatttatgaaaaattga

SEQ ID NO: 14441 - protein, 815 aa, Clostridium acetobutylicum
MKAIIMAGGQGKRLRPLTCNLPKPMMPIMQKPVLQYIIELLKKHGINEIGITLHYLPDEVMDYFGDGKELGVNIHYFIEQSPLGTAGSVRNAESFLDETFVVISGDALTDVNLTNILQYHKEKNAMVTIVLKKVTIPLEYGVAITDTEGRISNFIEKPGWGEIFSDKANTGIYVMEPGIFEFYNKDKKFDFSEELFPELLKSGKEIFGYVVNDYWRDIGNIEQFMKCNFDILNGYVDVDVDIDASQHQKGVWIGKNTIVSDNVKVIPPVYIGDNSEIRYGAEIGPFAVIGRNNIISEMATIKRSIIFENCYIGSGAELRGSVVSNNVQVGGGVSTFEESAIGTGSLVGEKSVVKAGVKIWPDKVIGSKTIIKTNVVWGENRCKVLFGKEGISGEINVELTPEFVSKLASAFASNLRMNSKVVVCSDYNLAAEMLKYSFVSGLISMGIEVYSAKEMTIPMLRFSTAYFKADAAVYIYCKGSNKEKVNILFIDKDGIMISRSMEKKIANSFLREDFRRTRANNFKRLRDFGECMGYYEDYIKENLCIQEIRNSGLKVAVSMENKLIKNEVKSIFSDLKIQYSIYDNYADLEGLKKEVIEKKMDFGVCISENCDKAIIIDENANIISTQMYESIKALILISVYKFKTIVAPVNSSKALKYIAKRYNCKYVKSKISERYILNEYILNEKDKNIKEVLFSYLSSTDALNIVINIINILARGKIKLSELMERIPNYILREKEIACSWDNKGKIMRSLIEENISKSIELIEGIKVNYEDAWVLIIPDSDEPICKIYAESNDEEKTDKIINEFESEIELFMKN

SEQ ID NO: 14442 - DNA, 1242 bp, Pyrococcus abyssi
  CDS (1)..(1242)
atgaaagcagtaattcttgctggaggattcgggacgagattgaggccaatttcttcaacgaggccgaaaccaatggttcccgtgctagggaagcccaatctacagtatattctcgaggccctcgagaaggttaaggagatagatgaggtgatcctttccgttcactacatgaggggtgagattagggagttcatccaggagaagatgagagactaccccaaggatattaggttcgttaacgaccccatgcccctcgaaactggaggcgccctgaagaacgttgaagagtacgtttcagacgacttccttgtaatatatggagacgtgttcacgaacttcgattactcggagctaatagaggcccacaagaagaacgatggcttggttactgtggctttaacgaaagtttacgatccagagaggttcggagttgttataactgatgaagaggggaagatagttgagttcgaagagaagcccaggaagccaaagactaacttagttgacgctggaatttacatggtcaacaaagacgttctaaaggagatacccaagaacaaggaggtttactttgagagggagatacttccaaagttcgttagccagggcctagtatatggatataagatgcccaagcactactattgggtcgaccttggaacgccagaggacttcttctatgctcaccagatagccctggatgagatggccagggagaatggttacatgatcttgggtgagaacgtcgagatacctgaggatgtagaagttcaggggccagtgtatatagatgacaacgcgaagatagggcacggcgtgaagataaaggcttatacatatataggtccgaacacgatgatagaggacaaggcatacatcaagcgcgccatactcctgggcaacgacataataaaggagagagccgagctcaaagatacaatcctgggagaaggggtcgttgtagggaagaacgtcataatcaaggaaaatgccgttataggagactacgcaaagatctacgacaacttagttatctatggagctaaagtcttgccgtggaagaaagttgaggagtatgaggcttacataaggataaagctagatccggcaaaggttaggccagaattgaccccagacagatgcccactcgggttgcctgagtgtatatataagaagttcaaggctatcgctggagaaaagccaccctgcgacgagtgtatagagaaccagtggctcttctga

SEQ ID NO: 14443 - protein, 413 aa, Pyrococcus abyssi
MKAVILAGGFGTRLRPISSTRPKPMVPVLGKPNLQYILEALEKVKEIDEVILSVHYMRGEIREFIQEKMRDYPKDIRFVNDPMPLETGGALKNVEEYVSDDFLVIYGDVFTNFDYSELIEAHKKNDGLVTVALTKVYDPERFGVVITDEEGKIVEFEEKPRKPKTNLVDAGIYMVNKDVLKEIPKNKEVYFEREILPKFVSQGLVYGYKMPKHYYWVDLGTPEDFFYAHQIALDEMARENGYMILGENVEIPEDVEVQGPVYIDDNAKIGHGVKIKAYTYIGPNTMIEDKAYIKRAILLGNDIIKERAELKDTILGEGVVVGKNVIIKENAVIGDYAKIYDNLVIYGAKVLPWKKVEEYEAYIRIKLDPAKVRPELTPDRCPLGLPECIYKKFKAIAGEKPPCDECIENQWLF

SEQ ID NO: 14444 - DNA, 1143 bp, Streptococcus pneumoniae
  CDS (1)..(1143)
atgaaaaatgaaatgttagctttgattcttgctggtgggcaaggaactcgtctcggtaaactcactcaaagcatcgcaaaaccagctgtgcaatttggtgggcgctaccgtatcattgactttgccctatcaaactgtgccaactcagggattcacaatgttggggtcgttacacagtatcaaccacttgctctcaacaaccatattgggaatggttcaagctggggactagacggtattaattcaggtgtctctattcttcaaccttattctgcaagtgaaggaaatcgttggtttgaggggactagtcacgctatttaccaaaatatcgactatatcgacagtgtcaatcctgagtatgtcttgattttgtctggggatcacatctacaaaatggactatgatgatatgctccagtctcataaggataataatgccagcttgacagtagcagttttagacgtccctcttaaagaagcaagccgttttggtatcatgaacacagatgctaacaatcgtattgttgaatttgaagaaaaaccagctcaacctaaatctacaaaagcttctatgggaatctacatttttgattggcaacgccttcgtaatatgttagtcgctgctgaaaagagcaaggttggcatgtcagactttggtaaaaatgtcattccaaattaccttgagtcaggtgaaagtgtttatgcttacgaatttagtggttattggaaagatgttggtactattgagtcactttgggaagcgaacatggagtatatttctccagaaaatgccttggatagtcgtaaccgtcaatggaagatttactcaagaaacttgatttcaccaccaaacttcctcggggcaaatgctcatgtggaagactcattagttgtagacggatgtttcgttgatggaactgttaaacattctatcctttcaacaggcgcgcaagttcgcgaaggagcggaagtccttgattcagttatcatgagtggagctatcattggtcaaggagctaagattaaacgtgccattattggtgaaggtgcgattatttctgacggtgtcgaaattgatggaacagatgaagtacaagttgtaggatataatgaagtagtgggggtagcaacagatgaagattga

SEQ ID NO: 14445 - protein, 380 aa, Streptococcus pneumoniae
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDSVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSTGAQVREGAEVLDSVIMSGAIIGQGAKIKRAIIGEGAIISDGVEIDGTDEVQVVGYNEVVGVATDED

SEQ ID NO: 14446 - DNA, 1119 bp, Clostridium acetobutylicum
  CDS (1)..(1119)
atgctaaataactatatgtcaattctaagcttaaatgaaaatgataatgatataaaaagtcttacaaaagcaaggcctctagcctccatcccaattgcaggaagatacagaattatagattttatactttccaatcttgtaaattcaggagttaaaaatattggtatattaactcagtgtaaatcaagatctctactcgaccatcttggatcaggtaaaccttgggatttagatcgaaaattaaatggcttatttatatttaattttagtggtataacttctactctaagcgatatagaaatgttaaaaagtaatatggagtatttatatagaagcacacaggagaaagtaatcctctcctcatctgcagttatatgcaacatagattttcaaagagctgcagaatttcatgaaaagtctggtaaagacataacccttatatacaaaagaaccaataatggtaaacgaaaatttttaaactgcagtgtattaaatatggataaaaacaataatgttataagtattggcaaaaataccggtttagatgatgtacagaatatatctcttggcatgtttatcatgaataaaaagttattgataaacatattaaataattgtataagaaccggattttcacttagcttaaaacaatgtatccgtaagcatatgaataatttcaccgtaaatgcttatgaatttaatggctatgcagagtatatagattcagtaaaatcttactataaagtcaatatggatatgctaaaccttgacattaacagagaggttttctttaaaaatggtcttatatacactaaagtaaaagatgaggctccaacaaaatactttaatgactctgaggtatgtaactcccttatagcaaacggttctttaatacacggacaaattgaaaatagtataatcggaagaagagttactatttctaagggagctagaattaaaaattgcgttataatgcaaaattgcacaataaaagaaaatgtggatttaactaacgttatagtagataaaaatgtaataatcgatgaaaacacagttctaaaaggaggaaaagaattccctcttgttatagaaaaaaaatccatttactctgaagtttaa

SEQ ID NO: 14447 - protein, 372 aa, Clostridium acetobutylicum
MLNNYMSILSLNENDNDIKSLTKARPLASIPIAGRYRIIDFILSNLVNSGVKNIGILTQCKSRSLLDHLGSGKPWDLDRKLNGLFIFNFSGITSTLSDIEMLKSNMEYLYRSTQEKVILSSSAVICNIDFQRAAEFHEKSGKDITLIYKRTNNGKRKFLNCSVLNMDKNNNVISIGKNTGLDDVQNISLGMFIMNKKLLINILNNCIRTGFSLSLKQCIRKHMNNFTVNAYEFNGYAEYIDSVKSYYKVNMDMLNLDINREVFFKNGLIYTKVKDEAPTKYFNDSEVCNSLIANGSLIHGQIENSIIGRRVTISKGARIKNCVIMQNCTIKENVDLTNVIVDKNVIIDENTVLKGGKEFPLVIEKKSIYSEV

SEQ ID NO: 14448 - DNA, 1958 bp, Citrullus vulgaris S
  CDS (91)..(1671)
gagctgcatagctgattttcattttttccggcgactagctgatcggagaagacaccggagatcgcttgtgtggatttgaattgatcatctatggcgtcttctatggctgcggttggagttctcagacttccgacgacatcggcgtcgtcgtcttcgtcatcgaacggcggttctaatcgtgcaaggagacacagccttcgaagcctctcattcggtgcgtctcacatttctggtgataagattgactttagagcttctgctttgggatcacgacgtgtttccggtggtagagcggttccttcgatcgtttctccaaaagcggtttctgattccaagaacactcagacttgcctcgatcccgatgctagccggagtgtgcttgggattattctgggaggtggtgctggaactcggctctatccgctcactaagaagcgcgcgaagcccgctgttcctcttggagcgaactataggttgattgatattcctgttagcaactgtctcaacagcaatatttcaaagatttatgttctcacgcaattcaattctgcttctcttaatcgtcacctttcccgagcttatgcgagcaacatgggtggttacaagaatgaaggatttgttgaggttctggccgctcagcagagtccggagaatccaaattggttccagggcacagctgatgcagttagacagtacttgtggttatttgaagagcagaatgtgttggagtatctagttcttgctggtgatcatttgtaccgaatggattacgagaggtttattcaagcacatagggagactgatgcagatatcactgtagctgctctaccaatggatgaaaaacgtgcaactgcatttggtttgatgaagattgatgaagagggacgcataattgagtttgcagagaaaccaaaaggagagcaattgaagacgatgaaggttgatactactattttgggtcttgatgatgcgagaggcaaagagatgcctttcatagctagcatgggtatttacgttatcagcaaggatgtgatgctgagtcttcttagagataaatttcctggagcaaatgattttgggagcgaagttattcctggtgcaacttccattggaatgagggtgcaagcttacttgtatgatggttactgggaagatattggtaccattgaagctttttacaatgcaaatctggggatcacaaagaagccagtaccagattttagcttctacgatcgttcgtctccaatctacacccaacctcggtatttgccgccatcgaaaatgcttgatgctgatatcacagacagtgttattggtgagggctgtgtcataaagaactgcaagattcaccattctgtcgtgggcatccgaacttgcatatcggaaggtgcaatcatagaagacactttattgatgggtgcagattattatgagacggacgccgaccgtagattattggcggcaaagggtagtgtaccaattggaattggtagaaactctcacatcaagagagctatcattgacaaaaatgctcgcatcggggaggatgtcaagattgtgaatggagacaatgttcaagaagctgcaagagagacagatggttacttcataaagagtggaattgtgacagtaatcaaggatgctttgattcccagtggcaccgtcatctaaagcccaccacaacacaacacaacacaacacaacaaagcagacatgtttttcactaaactggtgcctctctctctctctctctctctctctctctctctcttcctcaattttgtttctgccttcaagctcacatattatgtccacatacattccttttggaagtaaatgcaaagcttaggaagagaatcccccactccacagtccactaggcactatttctttttaacttgttatgctgtaaatgtcccttttctgcactgaataatttcataacctttctttctctt

SEQ ID NO: 14449 - protein, 526 aa, Citrullus vulgaris S
MASSMAAVGVLRLPTTSASSSSSSNGGSNRARRHSLRSLSFGASHISGDKIDFRASALGSRRVSGGRAVPSIVSPKAVSDSKNTQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKTMKVDTTILGLDDARGKEMPFIASMGIYVISKDVMLSLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGEDVKIVNGDNVQEAARETDGYFIKSGIVTVIKDALIPSGTVI

SEQ ID NO: 14450 - DNA, 1693 bp, Citrullus vulgaris S
  CDS (1)..(1449)
atgaattctaattcctctcctcgtagcacggctagaaagcttacaccgggagttgcctattctgttctcatgtcagaaattagtgaggtttcttcgactttacaggctcctatattcgagactccaagagctgatccgaaaaagattgcttcaatcattctgggtggaggtgctggaactcgcttgtttcctcttaccagccagcgagccaaaccagcggttcctattggaggttgttataggttgatcgacatacccatgagtaattgcatcaatagtggcattgaaaagatattcgtcctaacgcagtttaactcattttcactcaatcgtcaccttgctcgtatttataattttggtaatggagtgaattttggcgatggattcgtggaggttctagctgccactcagacttcgggtgaaactggaaaaaaatggttccaaggaactgctgatgctgtcaggcaatttatatggttatttgaggacgctaagaccaaaaatgttgagcacactctaattttgtctggcgatcacctttaccgaatggactacatggattttgtgcagagacatattgacacaaatgcagatattacagtttcatgcatacccatggatgatagccgggcatcagattacggtctcatgaaaatagatgatacaggacgcattttacattttgcagagaaaccaaaggggtctgacctggaagcaatgaaagttgacactacagttctaggactttcaaatcaagacgctaggaaaaatccttatattgcatcaatgggggtctacatattcagaactgatcttctattaaagcttttgacatggagttatccttcatgcaatgacttcggctcagaaattattccatcggctgttaaggactacaaagttcaagcatatttattcaatgactactgggaggacattggaaccgtaaagtcattttttgatgctaacttagcgctaacggagcagcccccaaagtttgagttctatgatccgaagactccattttatacatcacctcgattcttgcccccttctaaagttgaaaaatgcaggattgtagatgcaataatatctcatggttgcttcctccgagagtgtagtgttgaacactctattgttggcgtgcgctctcgattggagtacggtgtggagcttaaggatacaatgatgatgggtgcggactactaccagactgaatctgaaattgcatctctgcttgccgaaggaaagatcccaattggcattggagagaacaccaagatcaggaattgcataattgacaagaatgccaggatcggaagaaatgtggttattgcaaattctgatgacgttcaagaagcagatagaccagaagacgggttttatataagatccggtatcacagtcacattgaagaatgcaacgataaaagatggaaccattatttaaaatccaatggcagtctcttattcaggtcaagagacagctgagagttgaaaggaatcaattgctcgaggctttcaatctacaatgctcggcaacgagtaattggctaagaacttcccttgatgtaaaattctagtttcttttcatatatgtaaaaagcaaaaagccaacacttttccatcctgagtaataacaacttctgatttcaatccatatatcataagagaagacaatattcaaagccact

SEQ ID NO: 14451 - protein, 482 aa, Citrullus vulgaris S
MNSNSSPRSTARKLTPGVAYSVLMSEISEVSSTLQAPIFETPRADPKKIASIILGGGAGTRLFPLTSQRAKPAVPIGGCYRLIDIPMSNCINSGIEKIFVLTQFNSFSLNRHLARIYNFGNGVNFGDGFVEVLAATQTSGETGKKWFQGTADAVRQFIWLFEDAKTKNVEHTLILSGDHLYRMDYMDFVQRHIDTNADITVSCIPMDDSRASDYGLMKIDDTGRILHFAEKPKGSDLEAMKVDTTVLGLSNQDARKNPYIASMGVYIFRTDLLLKLLTWSYPSCNDFGSEIIPSAVKDYKVQAYLFNDYWEDIGTVKSFFDANLALTEQPPKFEFYDPKTPFYTSPRFLPPSKVEKCRIVDAIISHGCFLRECSVEHSIVGVRSRLEYGVELKDTMMMGADYYQTESEIASLLAEGKIPIGIGENTKIRNCIIDKNARIGRNVVIANSDDVQEADRPEDGFYIRSGITVTLKNATIKDGTII

SEQ ID NO: 14452 - DNA, 1994 bp, Citrullus vulgaris S
  CDS (92)..(1672)
atatttataatccatagaaaatgtgttgattgatattccttgatatatatttccattgccaacaatttttatcatttatttaaaatgagatatggttgcgatggattcctgctttgtgtctttgaaatccaatacccatttgatgaagggtaattggggtggtctggatcgttgtgagaatggattttatggtgagaaagttagaggaagttttaatgaaaatgcttggattaagagcttgaaatccgagaagaaagctttgaagcttacccctaatgttgcctatgctgtggccacgccaaatatttccaagcagcctgtgagcattcaagtgccatcaattcccaaagtaaaagcaaatcctaaaaatgttgcttcaatcatattgggagggggtgctgggactcacctgtttccccttactagaagatcagcaacacccgctgttccagttggaggatgctataggcttatagatattccaatgagcaactgcatcaacagtgggatcaacaaaatatttgtgcttactcagttcaactctgcttctttgaatcgtcatatttcacgcacatactttggaaatggtgtcaacttcggagaaggatttgtggaggttcttgccgccacccaaacatctggggaaaccggcatgcactggttccaaggaactgcagatgctgtgagacagtttatttgggtatttgaggatgcaaagaacagaaatgttgagaacattctaattttggcaggggatcacatgtatagaatggactatatggactttgtgcagaatcacattgacagaaacgctgatatttcaatctcgtgcgcagctgtgggcgacagccgcgcatcagactacggattggtgaaaatagatagtagaggtcgaattatccagttttctgaaaagccaatgggtgccaatttgagtgcaatgcgagtagatacaacttcatttggtttgtctcgggaggagtcattgaagtctccttacattgcgtcgatgggagtttatgttttcaaaacagatattttgctaaaccttttgaagtggagatatcctacatctaatgactttggctctgaaatcattcctgcagctgtaaaggagcacaatgtccaagcatatatatttagagactattgggaggacattggatcaataaagaccttctatgatgcaaacttggccctcacggaagagtttcctaaatttgaattttatgaccccaagacacctatctatacttctcctcgattcctaccgccgaccaagattgacaagtgtcagattgtcgatgcaataatctcgcatggatgctttttgagagaatgtagtgtccaacattcaatagttggtgaacggtcaagattagactacggtgttgaacttaaggatactataatgatgggtgcagatacttaccaaactgaacctgaaatcgcaggtctgctagcagagggaaaagttcctataggtattggacgaaacacgaaaatcaggaactgtataatcgataagaatgcgaaaatcggcaaggatgttgtcattatgaacaaagaaggcgtccaagaagcagatcggcctgaacagggattctacattcggtcgggaatcaccattatactggaaaaggcaacgatcgaagacggcacagttatatgaacagatctcaaaatcctcaatttgggtttggaagacctgttggaagttggttttcatgagattgcctgcactgtggccaggagaaaggagaaaggtcttgattacagaggctgaatttaaagcttctttcaaatatttatagatagttttaagagatttggagacaagaaagttccacatagggagagatctaaactagagattccaagtcttaagtgtaattctcttcaataagagtggctaacacagccagattagttggttatgttatgtacataaaaatattatgttgatgtattatccataatcatttccttctatc

SEQ ID NO: 14453 - protein, 526 aa, Citrullus vulgaris S
MVAMDSCFVSLKSNTHLMKGNWGGLDRCENGFYGEKVRGSFNENAWIKSLKSEKKALKLTPNVAYAVATPNISKQPVSIQVPSIPKVKANPKNVASIILGGGAGTHLFPLTRRSATPAVPVGGCYRLIDIPMSNCINSGINKIFVLTQFNSASLNRHISRTYFGNGVNFGEGFVEVLAATQTSGETGMHWFQGTADAVRQFIWVFEDAKNRNVENILILAGDHMYRMDYMDFVQNHIDRNADISISCAAVGDSRASDYGLVKIDSRGRIIQFSEKPMGANLSAMRVDTTSFGLSREESLKSPYIASMGVYVFKTDILLNLLKWRYPTSNDFGSEIIPAAVKEHNVQAYIFRDYWEDIGSIKTFYDANLALTEEFPKFEFYDPKTPIYTSPRFLPPTKIDKCQIVDAIISHGCFLRECSVQHSIVGERSRLDYGVELKDTIMMGADTYQTEPEIAGLLAEGKVPIGIGRNTKIRNCIIDKNAKIGKDVVIMNKEGVQEADRPEQGFYIRSGITIILEKATIEDGTVI

SEQ ID NO: 14454 - DNA, 2037 bp, Hordeum vulgare (barley)
  CDS (189)..(1772)
acgaccacctccgaactcaacgcctccacggaccatctctctcctctcccctcccctcaccaccaccaccaccaccaccccttctccctccctgcatttgattcgttcatattcatccgtcgcttgcccggtcgccaccccgtcgatccctcaccccgccgtccccggcagttgcaggtggactgctaatgtcatcgatgcagttcagcagcgtgctgcccctggagggcaaggcgtgcgtttccccagtcaggagagagggatcggcctgcgagcgcctcaagatcggggacagcagcagcatcaggcacgagagagcgtccaggaggatgtgcaacggcggcgcaggggccccgccgccaccggtgcgcagtgcgtgctcacctccgacgccagcccggccgacacccttgttctccggacgtccttccggaggaattacgccgatccgaacgaggtcgcggccgtcggtcgcggccgtcatactcggcggcggcaccgggactcagctcttcccgctcacaagcacaagggccacacctgctgttcctattggaggatgttacaggctcatcgatattcccatgagcaactgcttcaacagtggcatcaacaagatattcgtcatgacccagttcaactcggcatctctcaatcgccacattcaccgcacctacctcggcgggggaatcaatttcactgatggatctgttgaggtattggccgcgacacaaatgcctggggaggctgctggatggttccgcggaacagcggatgccgtcagaaaatttatctgggtgcttgaggactactataagcataaatccatagagcacattttgatcttgtcgggcgatcagctttatcgcatggattacatggagcttgtgcagaaacatgtggatgacaatgctgacattactttatcatgtgcccctgttggagagagccgggcatctgagtacgggctagtgaagttcgacagttcaggccgtgtgatccagttttctgagaagccaaagggcgacgatctggaagcgatgaaagtggataccagttttctcaatttcgccatagacgaccctgctaaatatccatacattgcttcgatgggagtttatgtcttcaagagagatgttctgctgaaccttctaaagtcaagatacgcagaactacatgactttgggtctgaaatcctcccgagagctctgcatgatcacaatgtacaggcatatgtcttcactgactactgggaggacattggaacaatcagatccttcttcgatgcgaacatggccctctgcgaacagcctccaaagtttgaattttatgatccaaaaacccccttcttcacttcgcctcggtacttaccgccaacaaagtcagacaagtgcaggatcaaagaagcgatcatttcgcacggctgcttcttgcgtgaatgcaaaatcgagcactccatcatcggcgttcgttcacgcctaaactccggaagcgagctcaagaacgcgatgatgatgggcgcggactcgtacgagaccgaggacgagatctcgaggctgatgtctgagggcaaggttcccatcggcgtcggggagaacacaaagatcagcaactgcatcatcgacatgaacgcgaggataggaagggacgtggtcatctcaaacaaggagggggtgcaagaagccgacaggccggaggaagggtactacatcaggtccgggatcgtggtgatccagaagaacgcgaccatcaaggacggcaccgtcgtgtagggcgtgccgggtcggcgcgacggggttctgcgacaacctgtgcgctgcgtcggtcgtcatcatcttctcaaactccgggactgaagaagtgatccggggacgggagacgtttgaagcttgaatgactgagactgaaagtgaaggcgcagcagaggcaggcagcattagtagtaagtagtaagtaagtagcagtggaacaaagtaatagtcgttcgtttttcccctgtaataaataagaggctgtgtgttgaggtaaaaaaaaaaa

SEQ ID NO: 14455 - protein, 527 aa, Hordeum vulgare (barley)
MSSMQFSSVLPLEGKACVSPVRREGSACERLKIGDSSSIRHERASRRMCNGGAGAPPPPVRSACSPPTPARPTPLFSGRPSGGITPIRTRSRPSVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 14456 - DNA, 1757 bp, Triticum aestivum (common wheat)
  CDS (17)..(1438)
tgcttatccctcggcaatggatgtgcctttggcatctaaaaccttcccctcgccctccccttccaagcgtgaacaatgcaacattgatggccataagagctcatcgaagcatgcagatctcaatccacatgttgatgatagtgttctcggaattattcttggaggtggtgcagggactagattgtatcccctgacgaagaagcgtgcgaagcctgcagtgccattgggtgccaactacaggcttattgatattcctgtcagtaattgtctgaacagcaacatatcaaagatctatgtgcgcacgcagttcaactcagcatctcttaatcgtcatctctcacgagcctatgggagcaacattggaggttacaagaatgaaggatttgttgaagtccttgctgcacagcagagcccagataaccctgactggtttcagggtactgcagatgctgtaaggcagtacttgtggctattcgaggagcataatgttatggaatatctaattcttgccggagatcacctgtaccgaatggactatgaaaagtttattcaggcacacagagaaacagatgctgatattactgttgctgccttgcccatggatgaggaacgtgcaactgcatttggccttatgaaaatcgatgaagaagggaggataattgaattcgcagagaaaccaaaaggagaacagttgaaagctatgatggttgatacgaccatacttggccttgacgatgcgagggcaaaggaaatgccttatattgctagcatgggtatctatgttattagcaaacatgtgatgcttcagcttctccgtgagcaatttcctggagctaatgactttggaagtgaggttattcctggtgcaactagcactggcatgagggtacaagcatacctatacgatggttactgggaagatattggtacaattgaggcattctataatgcaaatttgggaattaccaaaaagccaatacctgatttcagtttctatgaccgttctgctcccatttacacacaacctcgacacttgcctccttcaaaggttcttgatgctgatgtgacggacagtgttattggtgaaggatgtgttattaaaaactgcaagatacaccattcagtagttggactccggtcctgcatatctgaaggggcaataatagaggacacattgctaatgggtgcggactactatgagactgaagcggataagaaactccttgctgaaaaaggtggcattcccattggtattggaaagaattcacacatcaaaagagcaataattgacaagaatgctcgtattggagataacgtgatgataatcaatgttgacaatgttcaagaagcggcgagggagacagatggatacttcatcaaaagtggcattgtaactgtgatcaaggatgctttactccctagtggaacagtcatatgaagcagatgtgaaatgtgtgccaagggacagggctacttgcatcagtctggaatcaaccaacgaggccgcgaagagatcataagagcaataaaaaggagtgccatgcaaggcacttctccaccctttttcccccttgatgtattaggaactgtgatgtacaagcaactgtgatgcacttaggcgaagtgcccctggattcagctttctctttgcttgtagttgatttccagcagaccatgctatttgttgtatggttcatgtaaaaccttgcgttgctttttatataaaatgcgctgaaagcctatttcgctaaaaaaaa

SEQ ID NO: 14457 - protein, 473 aa, Triticum aestivum (common wheat)
MDVPLASKTFPSPSPSKREQCNIDGHKSSSKHADLNPHVDDSVLGIILGGGAGTRLYPLTKKRAKPAVPLGANYRLIDIPVSNCLNSNISKIYVRTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 14458 - DNA, 1143 bp, Bacillus subtilis
  CDS (1)..(1143)
atgaaaaaacaatgtgtagccatgctccttgccggcgggaagggcagccgtctcagcggattaacaaaaaatatggccaaaccggctgtatctttcgggggaaaatacaggattattgattttaccctaagcaactgttctaattcaggcatagacacagtcgggattttaacgcaatatcagccgctcgagctgaattcctatattgggatcggcagtgcatgggacctggatagatataatggcggcgtgacggttttacccccttatgccgagtcatcagaagtcaaatggtataaagggacggcaagctccatttatgaaaatctcaattatttgaatcagtatgatcctgagtatgtactgattttatcaggagatcacatatacaaaatggactacggcaaaatgcttgattatcacattgaaaagaaagcagatgtgaccatctctgtcatcgaagtgggctgggaggaagcaagccggttcggcatcatgaaggccaatccagatgggacgatcacacattttgatgaaaagcccaaattccctaagagcaatcttgcctcaatgggaatttatatattcaattggccgcttttgaaacagtatcttgagatggacgatcaaaacccttattctagccacgacttcggcaaagacattattccactgcttttggaagagaaaaagaagctttctgcttatccgttcaagggatattggaaggatgtcggaacggtgcagagcttgtgggaagccaatatggatttgttaaaagaggactcggagctgaagctgtttgaacgcaaatggaaaatttactccgtcaatccaaatcagcctccgcaatttatttcatctgatgcgcaggttcaagattcgcttgtgaacgaaggttgtgttgtatatggaaatgtgtctcactccgttctttttcaaggtgtgactgttggtaagcatacgactgttacatcatccgtcataatgccggatgtgacgattggggagcatgtagtcattgaaaatgccatcgttcctaatgggatggtgctgccggatggcgcagtgattcgctccgaaaaagacattgaagaggtgctgctcgtttcagaggaatttgtagaaaaagaattgatttaa

SEQ ID NO: 14459 - protein, 380 aa, Bacillus subtilis
MKKQCVAMLLAGGKGSRLSGLTKNMAKPAVSFGGKYRIIDFTLSNCSNSGIDTVGILTQYQPLELNSYIGIGSAWDLDRYNGGVTVLPPYAESSEVKWYKGTASSIYENLNYLNQYDPEYVLILSGDHIYKMDYGKMLDYHIEKKADVTISVIEVGWEEASRFGIMKANPDGTITHFDEKPKFPKSNLASMGIYIFNWPLLKQYLEMDDQNPYSSHDFGKDIIPLLLEEKKKLSAYPFKGYWKDVGTVQSLWEANMDLLKEDSELKLFERKWKIYSVNPNQPPQFISSDAQVQDSLVNEGCVVYGNVSHSVLFQGVTVGKHTTVTSSVIMPDVTIGEHVVIENAIVPNGMVLPDGAVIRSEKDIEEVLLVSEEFVEKELI

SEQ ID NO: 14460 - DNA, 1859 bp, Vicia faba (fava bean)
  CDS (19)..(1557)
aaaagccatatggcgtcaatggcagcgatcggtgttctcaaagtgccgccatcctcctcctcttcttcatcttcttcttcatccaaagccattgcacgcaacctctctttcacttcatcacacctctccggtgataagattttcactctttcaggaagaacaagaagaacttctggcagaaaccccttcattgtttctcccaaagccgtttctgattccaaaaactcccagacttgtcttgatccagatgctagccgaagtgtgcttggcattatacttggaggtggtgctgggacgcgtctttatccgttgacaaagaagcgggcgaaacccgctgttcctcttggagcaaactatagattgattgatattcctgttagcaattgcctaaatagcaacatatcaaagatctatgtgctcacacaattcaattcagcgtcgttgaataggcacttgtcccgtgcgtatgcgagtaacttgggtggatacaaaaatgaaggtttcgttgaggttcttgccgcgcagcagagtcctgagaatccaaattggttccagggtactgcagatgcggtgaggcaatatttatggcttttcgaggagcacaatgttttggagtacttggttctggctggtgaccatttgtatcgaatggactatgagagatttatacaagcgcacagggaaagtgatgctgatatcactgttgctgcgttgccaatggatgaagcgcgagccactgctttcggtctaatgaaaattgatgaagaggggcgtataattgaattttcagagaatccaaaaggagaacagttgaaagctatgaaggttgatactactattttgggtctcgatgacgatagagctaaggaaatgccttatatagctagcatgggtatatatgtcgtcagcaaacatgtgatgctagatctgctccgcgacaagtttcctggtgcaaatgacttcgggagtgaagttattcctggtgcgactgagcttggaatgagggtgcaagcttatttatatgatggatactgggaagacattggtacgattgaggctttctataatgcaaatctgggaatcaccaaaaagcctgtgccagattttagtttctatgaccgttcatctccgatctacacccaacctagatatttgcctccctctaagatgcttgatgctgatatcaccgatagtgttattggtgaagggtgtgtaattaagaactgcaaaattcaccattctgttgttggactgcgttcttgcatatcagaaggtgcaatcattgaggacactttgttaatgggagcagattattatgagacggatgctgataggaggtttttggctgctaaaggcggtgttccaattggtattgggaagaattctcatatccgaagggcaatcattgacaagaatgctagaattggtgacgacgtcaagatcattaacagtgacaatgtgcaagaagctgcaagggaaactgaaggttatttcataaaaagtggtattgtcacagtaatcaaggatgcattaattccaagtggtactgtcatctaagagcactctctactacttttgcctcatcctgccgtgcattgcaagaccccattttcactactggaaggccctaaaagagcagctccgcttccaagttgggtttctggtgcaatgttttatttgatttgccagtatatagagtagaggaccctttctgtagccgtgatgtaaatttaatttaattcagtcaaataaatgcttctttagtctgcagtgtctgatgcatgttcttttgcagtaggggtggaataatatccactaaaaacagtgaaaagaaatacaataaaagccagacactagct

SEQ ID NO: 14461 - protein, 512 aa, Vicia faba (fava bean)
MAAIGVLKVPPSSSSSSSSSSSKAIARNLSFTSSHLSGDKIFTLSGRTRRTSGRNPFIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLVLAGDHLYRMDYERFIQAHRESDADITVAALPMDEARATAFGLMKIDEEGRIIEFSENPKGEQLKAMKVDTTILGLDDDRAKEMPYIASMGIYVVSKHVMLDLLRDKFPGANDFGSEVIPGATELGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGGVPIGIGKNSHIRRAIIDKNARIGDDVKIINSDNVQEAARETEGYFIKSGIVTVIKDALIPSGTVI

SEQ ID NO: 14462 - DNA, 2040 bp, Vicia faba (fava bean)
  CDS (90)..(1616)
acaacaattcacacactcttgttctaaaccatacaacaacacaaacatagtaacacaaacatagtacacacaaacaaacaatctctgcaatgtcttcgattgttacttcaggtgttatcaacgttccacgttcttcttcttcatcaaagaacctctcattctcatcatcatcacaactctccggtaacaagattcttacagtctccggtaatggtgcaccaagaggaagatgcactctcaagcacgtgtttcttactccgaaagccgtttccgattcacagaactctcaaacatgccttgatcctgatgctagcagaagtgtgcttggaattatacttggaggtggtgctggtactaggctttatccactcaccaagaagagagcgaaaccagctgttcctcttggagctaactatagactcattgatattcctgttagcaattgcttgaatagcaacatatctaagatctatgttcttactcaattcaattccgcgtctctcaatcgacatctttctcgcgcatatgcaagtaatttaggtggttacaaaaatgagggttttgttgaagttcttgcggctcagcaaagtcctgagaatcctaattggtttcagggtactgcagatgctgtgaggcaatatttatggctttttgaggagcataatgttttggagtacttaattctggcgggtgatcatttgtatagaatggattatgaaaaatttatccaagcgcatagggaaagtgatgctgatatcactgtggctgcgttgccaatggacgaaaagcgtgcaacagcttttggcttgatgaagatcgatgaagaggggcgtataattgagtttgcagaaaagccaaagggagaacagttgaaagctatgaaggttgatactacgattttaggtcttgatgatgaaagagcgaaagaaatgccttttattgctagcatgggtatatatgttatcagcaaaaatgtgatgttagacctgctccgcgacaagtttcccggtgcaaatgactttgggagtgaagtgattccgggtgctacttccattggaatgagagtgcaagcttacttatatgatggctactgggaagacataggtaccattgaggctttctataatgcaaatcttggaattacgaaaaagcctgtgccggatttcagtttctatgatcgttcatctccaatttacacccaaccgcgatacttgcctccatctaagatgcttgatgctgatattactgatagtgttatcggagaaggatgtgtgattaagaactgcaaaattttccattctgtcgtcgggctgcgatcttgcatatcagaaggtgcgattattgaagacactttgttaatgggggcagattattacgagacagaagctgataaacggtttttggctgctaaaggcagtgttccaattggtattggcaaaaactcgcatatcaaaagagcaattgttgacaagaatgctagaatcggcgaaaatgtcaagataattaacagtgacaatgttcaagaagctgctagggaaacagaaggttatttcattaaaagcgggatcgtcacaataatcaaggatgccttaattcctagtggaactgtcctatagaagactgaaactccatcttttgttttctaatggtgagtgagacttgaagctcattttcaaagaagggtttaaacagttctacttcgacgtcttagttcatgttgcatgatatatttatttttcgataaaggcttgtaaatagtagttgaagagagaagatccttcttgtgttttggaaagtagtactggtaaagtttgctaatcaattgaataaatatatcatgcaacatgaactaagacgtcgaagtagaactgtttaaacccttctttgaaaatgagcttcaagtctcactcaccattagaaaacaaaagatggagtttcagtcttctataggacagttccactaggaattaaggcatccttgattattgtgacgatcccgcttttaatgaaatagccttctgtttccctagcagcttcttg

SEQ ID NO: 14463 - protein, 508 aa, Vicia faba (fava bean)
MSSIVTSGVINVPRSSSSSKNLSFSSSSQLSGNKILTVSGNGAPRGRCTLKHVFLTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVL

SEQ ID NO: 14464 - DNA, 2123 bp, Zea mays (maize)
  CDS (189)..(1754)
ggctcgctcgccttcctcctccccactccactccattccaacgcaacgcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtacgtccgaaccatccttttcggaggaattatgctgatcctaatgaagtcgctgccgtcattttgggtggtggtaccgggactcagcttttccctctcacaagcacaagggccacccctgctgttcctattggaggatgttacaggcttattgatatccccatgagcaactgtttcaacagtggcataaacaagatatttgttatgactcagttcaactcagcttctcttaaccgtcacattcatcgtacctatcttggtggggggatcaacttcactgatggatctgttgaggtgctggctgcaacacaaatgcctggggaggctgctggttggttccagggcacagcagacgccgttagaaaatttatctgggtacttgaggattattacaagcataaagctatagaacacattttgattttgtcaggagatcaactctatcgtatggattacatggagcttgtgcagaaacatgtcgatgacaatgcagacataactttatcatgcgctcctgttggagagagtcgagcatctgactatggattagttaagttcgatagttcaggccgtgtaattcagttctctgagaaaccaaagggtgctgccttggaagaaatgaaagtggataccagcttcctcaatttcgccacttgcactctcccagctgaatatccctatatcgcttcaatgggagtttacgtttttaagagagatgttttgttagaccttctaaagtcacggtatgctgaactgcatgactttggttctgaaattctgcccaaggctttgcatgagcacaatgtacaggcatatgttttcactgactactgggaggacattggaacaatcagatctttctttgatgcaaacatggccctctgcgagcagcctccaaagttcgagttttacgatccgaaaacaccattcttcacttcccctcggtacttgccaccaacgaagtcggataagtgcaggattaaagacgcgatcatttcacacggctgcttcttgcgtgagtgtgccatcgagcactctattgttggtgttccgtcacgcctaaactctggatgcgagctcaagaataccatgatgatgggtgcggatttgtatgagaccgaagacgagatctcaaggctactggcagagggcaaggtgccaattggcgtaggggagaacacgaagataagcaactgcatcatcgacatgaattgccagggttggaaggaacgtctccataacaaacaaagagggcgttccaagagtcccgaccggcctggacgaaggatactaatccggtctgggatcgtggtagtcctgaagaacgcaaccatcaaggacggcaccgtcatatagagactaactttggccttacgcatggcctgcaaggttacaggttagtcatcgtcttgagagttgagacttagtttgaggcgcgcccgaccttgacttgagccgtcggagggacaagaacatgaggaagaagggctggtggtgccggatgttgccatggacgacgagaaatggtttggctggtcgcatcggtccagtagctagctcttccgatgttattaatatatgtatctagtggagtagtgcgaacagtgcaataagctgggcgagcaaagccgcggcaactcttggcttggggattggttggtgcatcttgtaaataataaactcggacgcagcaaatgaaacatgcccctcatcttcttccaaaaa

SEQ ID NO: 14465 - protein, 521 aa, Zea mays (maize)
MQFSSVLPLEGKACMSPVRRGSGGYGSERMRINCCSIRRNKALRRMCFSARGAVSSTQCVLTSDAGPDTLVRPNHPFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFATCTLPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVPSRLNSGCELKNTMMMGADLYETEDEISRLLAEGKVPIGVGENTKISNCIIDMNCQGWKERLHNKQRGRSKSPDRPGRRILIRSGIVVVLKNATIKDGTVI

SEQ ID NO: 14466 - DNA, 1926 bp, Beta vulgaris (beet)
  CDS (205)..(1773)
caaaagaaaaacttcccatttctacttctttgcacaatataatttcccacaatttttctttaaatttctcactttcatttaatcagttttcagcaacattctgatactcgacaacccactttctgttctcccaagattccaaacctctgattctcattccactaatatttttgcttattttttttctggatttaaagaaaagctatggatgcaagtgcagcagccataaatgtcaatgcccatttaacagaagttggaaagaaacgttttttaggagagagaatcagtcaaagtttgaagggtaaagatctgagagctctgttttcaagaactgagagcaagggtagaaatgtcaataaacctggggttgcattttctgttctcacctcagattttaatcaaagtgttaaagaatctttgaaatatgagccagcattatttgaatctccaaaagctgacccaaaaaatgtggctgcaattgtgctgggtggtggtgctgggactcgcctctttcctcttactagcaggagagctaagccagcagtgccaattggagggtgttacaggctgattgatgtgcctatgagcaactgcatcaacagtggcattagaaagattttcattcttacccagttcaattcgttttcgcttaatcgtcatcttgctcgaacctataattttggagatggtgtgaattttggggatggctttgtggaggtttttgctgctacacaaacacctggagaatcaggaaagaaatggttccagggcaccgctgatgcagtaagacagtttttctgggcatttgaggattccaaatccaaggatgtcgagcatatagttattttatccggtgatcatctttaccgaatggattacatgagtttttggcagaagcacattgacaccaatgctgatattacagtgtcatgcatacccatggatgacagccgtgcatcggattatgggctgatgaagattgatcacactggacgcattgtccattttgcagaaaaacccaagggttctgatctaacagcaatgcaagtagatacaactgttcttgggctctctgaccttgaagctatgtcaaatccatatattgcatcaatgggtgtttatgtctttcgaacggatgttcttatggagcttctcaatcgaaaatacccttcaagcaatgattttggctctgagattattccttcagctgtaggagagtctaatgttcaggcatatctatttaatgactactgggaggatatcggaaccataaagtctttctttgattccaatttggcccttacacaacagcctcccaagtttgaattctacgatccaaaaacacctttttatacatctgcaagatttctgcctcctacaaaagtcgacaggtgcaagattgtcgattccattgtatcccatggttgttttctacaggagtctagcatccaacattccattgttggtgttcgctcaagattagagtccggggttgagttccaggacaccatgatgatgggcgcagattactatcaaactgaatcagaaattgcttctctgcttgctgagggaaaggttcctgttggtgtcggacagaataccaaaataaagaattgcataattgacaagaacgccaaaattggaaaagatgtggtaatcgcaaacacggatggtgttgaggaagcagatagaccaaatgaaggcttttacatcaggtcgggcattaccatcattttgaagaacgcaaccatacaagacggtcttgtgatttagatttaatcataacctcattagaaagaaataattttgcatgatttccttttcatgtaacctaaactggctaaaccacgaggttttctcatctgtatatataatatgtctataactatggataatcttaataaaaaaaaaaaaaaaaaaaaaaaa

SEQ ID NO: 14467 - protein, 522 aa, Beta vulgaris (beet)
MDASAAAINVNAHLTEVGKKRFLGERISQSLKGKDLRALFSRTESKGRNVNKPGVAFSVLTSDFNQSVKESLKYEPALFESPKADPKNVAAIVLGGGAGTRLFPLTSRRAKPAVPIGGCYRLIDVPMSNCINSGIRKIFILTQFNSFSLNRHLARTYNFGDGVNFGDGFVEVFAATQTPGESGKKWFQGTADAVRQFFWAFEDSKSKDVEHIVILSGDHLYRMDYMSFWQKHIDTNADITVSCIPMDDSRASDYGLMKIDHTGRIVHFAEKPKGSDLTAMQVDTTVLGLSDLEAMSNPYIASMGVYVFRTDVLMELLNRKYPSSNDFGSEIIPSAVGESNVQAYLFNDYWEDIGTIKSFFDSNLALTQQPPKFEFYDPKTPFYTSARFLPPTKVDRCKIVDSIVSHGCFLQESSIQHSIVGVRSRLESGVEFQDTMMMGADYYQTESEIASLLAEGKVPVGVGQNTKIKNCIIDKNAKIGKDVVIANTDGVEEADRPNEGFYIRSGITIILKNATIQDGLVI

SEQ ID NO: 14468 - DNA, 2102 bp, Solanum tuberosum (potato)
  CDS (130)..(1689)
aaccccactgtgttgtgttatgaacacactctaacctagtaataattttatttgtaagtaccaaaaactttttctgcagaaaactttttgaggaaaagttgggtgtttgaaaaagcttaattcagagcaatggatgcgttgtgtgctagtatgaagggcactgcacaattagtggcaatttgcaaccaagagagtgcattttggggagagaagattagtggaagaagattgataaacaagggttttggggtccggtcgtgcaagagctttacaactcaacaaaggggtagaaatgttacgcctgctgttctcacccgtgatataaacaaagagatgctgccatttgaagaatcaatgtttgaggaacaaccaactgcggacccaaaagctgttgcctctgtcattctaggtggtggtgttggaactcgtctttttcctcttaccagcagaagagctaaaccagctgttccaattggtggttgttaccggctaattgatgtaccaatgagtaactgcattaacagtggcatacggaaaattttcatcttaacacagttcaattccttttccctcaatcgtcaccttgcgacgtataattttggaaatggagtgggttttggagatggatttgtggaagttttagctggaacccagactccaggggatggccggaaaatgtggttccaagctgctgatgctgtgcgggaatttatatgggtatttgagaatcagaagaacaagaatgtcgagcacataataattttgtctggtgaccatctttaccgaatgaactacatggactttgttcagaagcatattgacacgaatgctgatattacagtttcatgtgttccaatggacgatggtcgagcttcagattttggattgatgaaaatagatgaaacaggagctatcatccaatttgctgagaaacccaaaggccctgctttgaaggcaatgcaagttgacacatctatcctcggactatctgagcaagaggcgtccaattttccttacattgcatccatgggtgtttatgtattcaaaactgatgttttactaaatcttctcaagtcagcatacccttcatgcaatgattttggctctgaaatcatcccttctgctgtgaaggatcacaatgtccaggcatatttgtttaatgattactgggaggatattggaacagtgaagtctttctttgatgccaacttggccctcacaaagcagcctccaaagtttgacttcaatgacccgaagaccccgttctacacttctgctaggttcttacctcctacaaaagttgacaaaagcaggatagtggatgcaataatttcacatggttgctttctgagggaatgcaacatccagcactctatagttggtgtacgatcacgcttagactatggtgttgagtttaaggataccatgatgatgggtgcagattattatcaaactgaatgtgagattgcttcactactagcagaaggaaaggttccaataggagtcgggccaaacaccaagatacaaaattgcataattgacaagaatgcaaagataggaaaagatgtggttattctgaacaaggaaggtgttgaagaagctgataggtcagcagaaggattttacattaggtccgggattaccgtcataatgaagaatgcaaccattaaagatgggacagtcatatgaaaatcttgcttagtgttcttgctagttgatcctggaaggaaataaaaaagtaggctggtatgtctagtgatgatgaatgtgcatgtaaggttttctgacatgtacttctacctatgacatattcacttcttggacttgatgaaacacatttccaagtgaacctcagtcctccatctttaagttttcagctggcagcagcttggtgagagcttttgctgctcgcttcagtttccaccatttgcagagggggtgtgacaaagggtttgctgggtttgctggatatatatgatattgtatatataggttagatattacttttttatacttggtatgttaactaattgacactaaggtggtggttggtacaaagaggaataacgtgtggattagtaatgcatggactagtaatgtca

SEQ ID NO: 14469 - protein, 519 aa, Solanum tuberosum (potato)
MDALCASMKGTAQLVAICNQESAFWGEKISGRRLINKGFGVRSCKSFTTQQRGRNVTPAVLTRDINKEMLPFEESMFEEQPTADPKAVASVILGGGVGTRLFPLTSRRAKPAVPIGGCYRLIDVPMSNCINSGIRKIFILTQFNSFSLNRHLATYNFGNGVGFGDGFVEVLAGTQTPGDGRKMWFQAADAVREFIWVFENQKNKNVEHIIILSGDHLYRMNYMDFVQKHIDTNADITVSCVPMDDGRASDFGLMKIDETGAIIQFAEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTECEIASLLAEGKVPIGVGPNTKIQNCIIDKNAKIGKDVVILNKEGVEEADRSAEGFYIRSGITVIMKNATIKDGTVI

SEQ ID NO: 14470 - DNA, 1708 bp, Solanum tuberosum (potato)
  CDS (64)..(1515)
tgcaaccctgcagcactgacagggagaaacttgaaggtagtgaagttttgcaatggagaattgatggggaagaaactcaagtatacaaaatttcagttaaggagtaatgtagtgaagcctaatatctgcatgtcacttacaactgatattgcaggtgaggctaagttgaaggatcttgagaggcaaaagaagggcgatgcaaggacagtagtagcaatcattctaggagggggagcgggaactcgtcttttccccctcaccaaacgtcgtgctaagcctgccgttccaatgggaggagcatataggctaattgatgtaccaatgagcaactgtattaacagtggcatcaacaaagtatacattctcactcaattcaactcagcctcacttaacaggcatatagctcgtgcttacaactttggcaatggggtcacattcgagagtggctatgtcgaggtcttagcagcaactcaaacaccaggtgaattaggtaaaagatggttccaaggtactgcacatgctgtgaggcaatttcactggcttttcgaggatgcaagaagcaaggacatagaagatgtgctcattctctctggagatcacttgtatagaatggactacctgcactttgttcagagtcatcggcaaagtggtgcagacattaccatatcaagtttgccaatagatgacagtcgagcttcagattttggcttgatgaaaattgatgacacagggcgggtcatgtccttcagcgaaaagccaaaaggagatgatttgaaggcgatggcagtagacacaactgttctaggattatctccagaagaggctaaagagaaaccttacattgcttcaattgggaaggtttacgtcttcaagaaggatattctcctcaatcttttaagatggcgttttccaactgcaaatgactttggttcagagatcatccctgcctccaccaaagaattctgtgtcaaggcttacttattcaatgattactgggaagatattggtacaatcagatccttttttagagctaaccttgcactcactgaacatccaccaagatttagtttctatgatgcaacaaagccaatatacacgtcaaggagaaacttacctccatcagcaattgataatagcaagattgttgattcaattgtatcacatggtattttcttgaccaattgcttcgtggagcacagtgttgtcggcatccgatcccgtataggcaccaatgttcacttgaaggacacagtgatgcttggcgctgactactatgaaactgatgctgagattcgttcacagctagctgaaggaaaagtgcctttaggaataggagagaataccagaataaaagattgcatcattgacaagaatgcaagaattggaaagaatgttgttattgccaactcagagggtgtacaagaagcagacagatcctcagaaggattttacatggcatcaggcatcacagtcatatcgaagaactcaacaatcccagatggaactgtgatatgacaagtgtgacaatgtctttttgtcttttctttcaagtagcattggcaccaagaaaattctgaaatatgagaagtaaaactttcagattatcaacttttccacattccagcaaggaaatatattgaacaacaggctgatgataaaaagggttgtttctcccattgatgaattttgaattaagaataaaatgtct

SEQ ID NO: 14471 - protein, 483 aa, Solanum tuberosum (potato)
MGKKLKYTKFQLRSNVVKPNICMSLTTDIAGEAKLKDLERQKKGDARTVVAIILGGGAGTRLFPLTKRRAKPAVPMGGAYRLIDVPMSNCINSGINKVYILTQFNSASLNRHIARAYNFGNGVTFESGYVEVLAATQTPGELGKRWFQGTAHAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASIGKVYVFKKDILLNLLRWRFPTANDFGSEIIPASTKEFCVKAYLFNDYWEDIGTIRSFFRANLALTEHPPRFSFYDATKPIYTSRRNLPPSAIDNSKIVDSIVSHGIFLTNCFVEHSVVGIRSRIGTNVHLKDTVMLGADYYETDAEIRSQLAEGKVPLGIGENTRIKDCIIDKNARIGKNVVIANSEGVQEADRSSEGFYMASGITVISKNSTIPDGTVI

SEQ ID NO: 14472 - DNA, 1990 bp, Triticum aestivum (common wheat)
  CDS (143)..(1711)
gcacgaggcggggccacccccggcctcttcttccctgcatttgattgatccgtcgcttgcccggtcgcccgtcgatccgtttacccgccgtccgcccgtccccggcagccgcagccgcaccgcagttgcaggtggactgcgaatgtcatcgatgcagttcagcagcgtgctgcccctggagggcaaagcgtgcatctcccccgtcaggagagagggctccgcctccgagcgcctcaaggtcggggacagcagcagcatcaggcacgagagggcctccaggaggatgtgcaacggtggcaggggccccgccgccaccggcgcgcagtgcgtgctcacctccgacgccagcccagcagacacccttgttctccggacgtccttccgcaggaattacgccgatccgaacgaggtcgcggccgtcatactcggcggtggcaccgggactcagctcttccctctcacaagcacaagggccacacctgctgttcctattggaggatgttacaggctcatcgatattcccatgagcaactgcttcaatagtggcatcaacaagatattcgtcatgacgcagttcaactcggcctctcttaatcgtcacattcaccgcacctacctcggcgggggaatcaatttcactgatggatctgttgaggtattggccgcgacgcaaatgcccggggaggctgctggatggttccgcggaacagcggatgccgtcagaaaatttatctgggtgcttgaggactattataagaataaatccatagagcacattttgatcttgtcgggcgatcagctttatcgcatggattacatggagcttgtgcagaaacatgtggatgacaatgctgacattactttatcatgtgcccctgttggagagagccgggcatctgagtacgggctagtgaagttcgacagttcaggccgtgtggtccaattttctgagaagccaaagggtgacgatctggaagcgatgaaagtggacaccagttttctcaatttcgccatcgacgaccctgctaaatatccatacattgcttctatgggagtctatgtcttcaaaagagatgttctgctcaaccttctaaagtcaagatacgcagaactacatgactttgggtctgaaatcctcccgagagctctgcatgaccacaatgtacaggcttatgtcttcactgactactgggaggacattggaacaatcagatccttcttcgatgcgaacatggccctctgcgagcagcccccaaagttcgagttttatgatcccaaaactcccttcttcacctcgcctcgatacttgccaccaacaaagtcagacaagtgcaggatcaaagaagcgatcatttcgcacggctgcttcttgcgtgaatgcaaaatcgagcactccatcatcggcgttcgttcacgcctaaactccggaagcgaactcaagaacgcgatgatgatgggtgcggattcgtacgagaccgaggatgagatctcgaggctgatgtccgagggcaaggtccccatcggcgtcggggagaacacaaagatcagcaactgcatcatcgacatgaacgcgaggataggaagggacgtggtcatctcaaacaaggagggagtgcaagaagccgacaggccggaggaggggtactacatcaggtccgggatcgtggtgatccagaagaacgcgaccatcaaggacggcaccgtcgtgtagagcaccgccgggtcggcgtgacgggttctgcgacaacctctgcgctgcgttgatcgtcgtcgtcgtctcgaggcccgggagggactgaagaagtgacccggggacgggaggcgtttgaagcttgaatgactgagaaggcgcgcgcgggcagcattagtagtaagtagtagtaaggagcagtggaacaaagtaatagtcgttcgtttttcccctgtaataaataagaggctgtgtgttgaggtaaaaaaaaaaaaaaaaaaaaaaaaaaaaaaaaaaaaa

SEQ ID NO: 14473 - protein, 522 aa, Triticum aestivum (common wheat)
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 14474 - DNA, 1822 bp, Hordeum vulgare (barley)
  CDS (59)..(1477)
aaaagtgaactcacacatcactcaatatctatatccttccattttatatccctcggtgatggatgtacctttggcatctaaagttcccttgccctccccttccaagcatgaacaatgcaacgtttatagtcataagagctcatcgaagcatgcagatctcaatccccatgctattgatagtgttctcggtatcattcttggaggtggtgcagggactagattgtatcccctgacgaagaagcgtgcaaagcctgcagtgccattgggtgccaactacaggcttattgatattcctgtcagtaattgtctgaacagcaacatatcaaagatctatgtgcttacacagttcaactcagcttctcttaatcgtcatctctcacgagcctatgggagcaacattggaggttacaagaatgaaggatttgttgaagtccttgctgcacagcagagcccagataaccctgactggttccagggtactgcagatgctgtaaggcagtacttgtggctattcgaggagcataatgttatggagtatctaattcttgctggagatcacctgtaccgaatggactatgaaaagtttattcaggcacacagagaaacggatgctgatattactgttgctgccttgcccatggatgaggaacgtgcaactgcatttggccttatgaaaatcgatgaagaagggaggataattgaattcgcagagaaaccaaaaggagaacagttgaaagctatgatggttgatacgaccatacttggccttgaagatgcgagggcaaaggaaatgccttatattgctagcatgggtatctatgttattagcaaacatgtgatgcttcagcttctccgtgagcaatttcctggagctaatgacttcggaagtgaagttatccctggtgcaactagcactggcatgagggtacaagcatacctatacgacggttactgggaagatattggtacaattgaggcattctataatgcaaatttgggaattaccaaaaaaccaatacctgatttcagtttctatgaccgttctgctcccatttacacacaacctcgacacttgcctccttcaaaggttcttgatgctgatgtgacagacagtgtaattggtgaaggatgtgttattaaaaactgcaagatacaccattcagtagttggactccgttcctgcatatctgaaggtgcaataatagaggacacgttgctaatgggtgcggactactatgagactgaagctgataagaaactccttgctgaaaaaggtggcattcccattggtattggaaagaattcacacatcaaaagagcaatcattgacaagaatgctcgtattggagataacgtgatgataatcaatgttgacaatgttcaagaagcggcgagggagacagatggatacttcatcaaaagtggcatcgtaactgtgatcaaggatgctttactccctagtggaacagtcatatgaagcagatgtgaaatgtatgccaaaagacagggctacttgcgtcagtctggaatcaaccaacaaggccgcgaaggagatcataaaataaaaarggagtgccatgcgagtcacttctacacccttttccccccttgatgtattaggaactgtgatgtacaagcaactgtgatgcacttacgcgaagtgcccctggattcagctttctctttgcttgtaactggtttccagcagaccatgctatttgttgtatggttcgtgcaaaaccttgcgatgctttatatatgctttatatataaacaagatgaatccccgcgcgttgctgcggcacaaaaaaaaaaaaaaaaa

SEQ ID NO: 14475 - protein, 472 aa, Hordeum vulgare (barley)
MDVPLASKVPLPSPSKHEQCNVYSHKSSSKHADLNPHAIDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 14476 - DNA, 1902 bp, Hordeum vulgare (barley)
  CDS (17)..(1558)
ctcgtcatccacctcaatggcgatggccgcggccgcctccccttccaagatcctgatccctccgcaccgagcctccgccgtgaccgctgccgcgtccacctcctgcgactccctccgcctcctctgcgcgccacgaggacggccaggcccgcgcgggttggtcgcgcgtccggttccgcggcggcccttcttcttctccccacgtgccgtgtcagactccaagagctcccagacttgtctcgaccccgacgcaagcacgagtgttctcggtatcattcttggaggtggtgcagggactagattgtatcccctgacgaagaagcgtgcaaagcctgcagtgccattgggtgccaactacaggcttattgatattcctgtcagtaattgtctgaacagcaacatatcaaagatctatgtgcttacacagttcaactcagcttctcttaatcgtcatctctcacgagcctatgggagcaacattggaggttacaagaatgaaggatttgttgaagtccttgctgcacagcagagcccagataaccctgactggttccagggtactgcagatgctgtaaggcagtacttgtggctattcgaggagcataatgttatggagtatctaattcttgctggagatcacctgtaccgaatggactatgaaaagtttattcaggcacacagagaaacggatgctgatattactgttgctgccttgcccatggatgaggaacgtgcaactgcatttggccttatgaaaatcgatgaagaagggaggataattgaattcgcagagaaaccaaaaggagaacagttgaaagctatgatggttgatacgaccatacttggccttgaagatgcgagggcaaaggaaatgccttatattgctagcatgggtatctatgttattagcaaacatgtgatgcttcagcttctccgtgagcaatttcctggagctaatgacttcggaagtgaagttattcctggtgcaactagcactggcatgagggtacaagcatacctatacgacggttactgggaagatattggtacaattgaggcattctataatgcaaatttgggaattaccaaaaaaccaatacctgatttcagtttctatgaccgttctgctcccatttacacacaacctcgacacttgcctccttcaaaggttcttgatgctgatgtgacagacagtgtaattggtgaaggatgtgttattaaaaactgcaagatacaccattcagtagttggactccgttcctgcatatctgaaggtgcaataatagaggacacgttgctaatgggtgcggactactatgagactgaagctgataagaaactccttgctgaaaaaggtggcattcccattggtattggaaagaattcacacatcaaaagagcaatcattgacaagaatgctcgtattggagataacgtgatgataatcaatgttgacaatgttcaagaagcggcgagggagacagatggatacttcatcaaaagtggcatcgtaactgtgatcaaggatgctttactccctagtggaacagtcatatgaagcagatgtgaaatgtatgccaaaagacagggctacttgcgtcagtctggaatcaaccaacaaggccgcgaagagatcataaaataaaaaggagtgccatgcgagtcacttctacacccttttccccccttgatgtattaggaactgtgatgtacaagcaactgtgatgcacttacgcgaagtgcccctggattcagctttctctttgcttgtaactggtttccagcagaccatgctatttgttgtatggttcgtgcaaaaccttgcgatgctttatatatgctttatatataaaacaagatgaatcccgcgcgttgctgcggcacaaaaaaaaaaaaaaaaaa

SEQ ID NO: 14477 - protein, 513 aa, Hordeum vulgare (barley)
MAMAAAASPSKILIPPHRASAVTAAASTSCDSLRLLCAPRGRPGPRGLVARPVPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 14478 - DNA, 1182 bp, Synechocystis sp
  CDS (1)..(1182)
atggtcagtgttgaccgattcctgcttactgataactgttcactgaaccctagacccaacaacataaccgctatcaagatttttatgaaggctctcattctctccggtggcaaaggaactcgcttgcgtcccctcacctacaccggggctaagcagttggtgcctgtggctaacaaaccaatcctctggtatggcattgaggcgatcgccaaagctggcattaccgacattggcattattattagcccagaaacgggagaggaaattaaaactatcaccggcaacggagaaaagttcggtatccagattacctatattttgcaatccgaaccattggggttggcccatgcagtgaaaacggcggcagactttctccaagattccccttttgtgatgtatttaggcgataacctaattcaagaccacctagagcaattcctcgcccattttcaggctaaatccctcgattccttgattctactgcggcgagtgtccaatcccagcgcctttggggtggccaccgttaatgaccaaggcaaagttttagccctagtggaaaaaccagagcatcccccttccaacttggccctagtgggactttacttttttgccccgaccattcaccaggcgatcgccaacattgagccctctgcccggggagaactagaaatcaccgatgcaattcaatatctgatcagccatgattatcgggtggaatccctacaactaaaaggatggtggctcgacaccggtaagaaagacgacctgctggccgccaatcagattatcctcgataccctagtggaaaaaaacatccaaggcaccgtagacgatcaaagcaaaatctccggtcgggtaaccattggcccccacagtcaaattatcaacagcgtcatccgtggccccgtggcgatcggccccaactgtcatctggaaaactgcttcatcggtccctatagcagtattgccgagggagttaaaatcagggatgcagatcttgaacatagtgtcgtgctccaaggagctagcattgtggccatccaacaaagaattgtcgatagtgtcatcggcaaaaacgccaaaatttttcccgctccccgccgtccccaggctttgcgcttcctgattggtaatgattcccaagtggaactaattggaccctcttcctatccccaggactaa

SEQ ID NO: 14479 - protein, 393 aa, Synechocystis sp
MVSVDRFLLTDNCSLNPRPNNITAIKIFMKALILSGGKGTRLRPLTYTGAKQLVPVANKPILWYGIEAIAKAGITDIGIIISPETGEEIKTITGNGEKFGIQITYILQSEPLGLAHAVKTAADFLQDSPFVMYLGDNLIQDHLEQFLAHFQAKSLDSLILLRRVSNPSAFGVATVNDQGKVLALVEKPEHPPSNLALVGLYFFAPTIHQAIANIEPSARGELEITDAIQYLISHDYRVESLQLKGWWLDTGKKDDLLAANQIILDTLVEKNIQGTVDDQSKISGRVTIGPHSQIINSVIRGPVAIGPNCHLENCFIGPYSSIAEGVKIRDADLEHSVVLQGASIVAIQQRIVDSVIGKNAKIFPAPRRPQALRFLIGNDSQVELIGPSSYPQD

SEQ ID NO: 14480 - DNA, 2532 bp, Synechocystis sp
  CDS (1)..(2532)
atgcgagctgtgttgatggcagggggggcaggcacccgtttgagacccctgacttgcgatctgcccaagcccatggtgcccattgttaatcaaccgatcgccgcccatattatccatttgctccgtcgccataacattactgaggtggtggccaccctccactacctccctgatgccatgcgggactatttccttgatggcagtgaatttggtgttcagatgacctatgcagtggaggacgagcatcccctcggtacggcgggttgtgtaaagaacattgaagagttattggatgatacttttttggtaattagtggggatagcatcaccgattttaatctcacccaggcgatcgccttccacaaacaaaaacaagccaaggcgaccctgattttgaccaaggttcccaaccccctggaatttggcgtggtcatcaccgacgaaaaccaacgggtgcaaagatttttagaaaagccctccaccagtgaagttttttccgacaccgtcaacacgggcacctatatcctcgaaccggaagttttggcctatctgccccccaaggaagaaatggatttttccaaggatttatttcccctcctgctggaaaatgacgaacccatgtatggttttgtcgccgatggttactggtgcgatgtcggtaatttggacgcctatcgggaagcccaatacgatgccctagaaaaaaaagtcacgctggaattgggtaacctaccccggcactcggacatttggatcggggaaaacaccaccattgaccccactgctattctcactccccctctggcgatcggggataactgcaacatcggttcaggaactaaattggaagcgggcaccatcattggcgataacgtcaccattggcgctggagcagaattaaagcgagccattgtttggaatggcgtactcattggtgatgaagcctatctagctgcctgtgtagtggggcggggctgtcgcatagaaagacgggtacaggtcctggaaggggcagtcattggtcccctatccatcattggcgaagaagcccaaatcaactcaaatgttaaagtttggcccagtaaacgggtggaaccgggagccattctcaacattaatttaatttggggcagcaccggccaccgcaacctattcggacagagaggtgtttccggcattgtcaacattgatatgacgccggagtttgctgtcaaattgggggctgcctacggttcttccctcaggcccggagcagaaattgtcgtttcccgcgatcaacgcaatgtctcccgcatggtcacccgttccctcattgctggcctgatgtcggtgggggtaaatattcaaaacctggaagccacagcgatccccattgctcgcaccatgactccgaagttaaaagtggccggcggcatccatgtgcgtatccatcccgatcgcccagattacctactgattgaatttctggatagccagggtatcaatatttccaaaaaaaccgaaaaaaaaattgaaggagcctatttcaaggaagatttacggcgggtaagcattccccaaattggcgacatgtcctatccggcccaggtgttggaaacctattgccacacctttgaaaaactcctagacatggacatcatcaacaacgatggggccaaaattgttattgactacgcctatggagtgtctggggccattctgcccctactgttgaccaaattcggctgcgacgcagtggtgctcaatgccagtctacgacaaaccgccgtttccaatgaagaaaaagaagtcttacttagtcaattgggacaagtggtatcggccctacaggccaatttgggggtgcaggtttccgctaatggcgaacaactcaccctggtggacgaagggggcctacccatccggggggaactgctaacagctttgatggtgcatatggtgttaactgcttctcccaggggaaccattgtggtgccagtacaggcttccagtgcggtggagcatttggcccgtcgccatgggggtaaagttttgagaaccaaggctaaccccactgcattgatggccgccgcccaatcgagccataacgtggttttgggcggtagtggagaaactggctttatttttcctcgcctccacccaggctttgatgccatgttttgcattgccaaagtaatggaaatgctgactgtccaaaaacgcaccctgggggaaattcgctcagaattgccgacggtttaccataacagttgtagtgtccgttgttcttggaaaattaaaggggccctgatgcgccatttggtggaaattcatcgggatcaacatattgaactggtagacggggttaaaatgacttttccccatggagacaactgggtattgattttgcccgatgcgggggagcccctggtccacatctatgccaacagtgaagaccgccattgggtagatgagaaattacgttactaccaagcccaggtcttgaattttattagtgacgcccaggaggagtcctaccaacatttttcctga

SEQ ID NO: 14481 - protein, 843 aa, Synechocystis sp
MRAVLMAGGAGTRLRPLTCDLPKPMVPIVNQPIAAHIIHLLRRHNITEVVATLHYLPDAMRDYFLDGSEFGVQMTYAVEDEHPLGTAGCVKNIEELLDDTFLVISGDSITDFNLTQAIAFHKQKQAKATLILTKVPNPLEFGVVITDENQRVQRFLEKPSTSEVFSDTVNTGTYILEPEVLAYLPPKEEMDFSKDLFPLLLENDEPMYGFVADGYWCDVGNLDAYREAQYDALEKKVTLELGNLPRHSDIWIGENTTIDPTAILTPPLAIGDNCNIGSGTKLEAGTIIGDNVTIGAGAELKRAIVWNGVLIGDEAYLAACVVGRGCRIERRVQVLEGAVIGPLSIIGEEAQINSNVKVWPSKRVEPGAILNINLIWGSTGHRNLFGQRGVSGIVNIDMTPEFAVKLGAAYGSSLRPGAEIVVSRDQRNVSRMVTRSLIAGLMSVGVNIQNLEATAIPIARTMTPKLKVAGGIHVRIHPDRPDYLLIEFLDSQGINISKKTEKKIEGAYFKEDLRRVSIPQIGDMSYPAQVLETYCHTFEKLLDMDIINNDGAKIVIDYAYGVSGAILPLLLTKFGCDAVVLNASLRQTAVSNEEKEVLLSQLGQVVSALQANLGVQVSANGEQLTLVDEGGLPIRGELLTALMVHMVLTASPRGTIVVPVQASSAVEHLARRHGGKVLRTKANPTALMAAAQSSHNVVLGGSGETGFIFPRLHPGFDAMFCIAKVMEMLTVQKRTLGEIRSELPTVYHNSCSVRCSWKIKGALMRHLVEIHRDQHIELVDGVKMTFPHGDNWVLILPDAGEPLVHIYANSEDRHWVDEKLRYYQAQVLNFISDAQEESYQHFS

SEQ ID NO: 14482 - DNA, 1320 bp, Synechocystis sp
  CDS (1)..(1320)
atgtgttgttggcaatcgagaggtctgcttgtgaaacgtgtcttagcgattatcctgggcggtggggccgggacccgcctctatcctttaaccaaactcagagccaaacccgcagttcccttggccggaaagtatcgcctcatcgatattcccgtcagtaattgcatcaactcagaaatcgttaaaatttacgtccttacccagtttaattccgcctcccttaaccgtcacatcagccgggcctataatttttccggcttccaagaaggatttgtggaagtcctcgccgcccaacaaaccaaagataatcctgattggtttcagggcactgctgatgcggtacggcaatacctctggttgtttagggaatgggacgtagatgaatatcttattctgtccggcgaccatctctaccgcatggattacgcccaatttgttaaaagacaccgggaaaccaatgccgacataaccctttccgttgtgcccgtggatgacagaaaggcacccgagctgggcttaatgaaaatcgacgcccagggcagaattactgacttttctgaaaagccccagggggaagccctccgggccatgcaggtggacaccagcgttttgggcctaagtgcggagaaggctaagcttaatccttacattgcctccatgggcatttacgttttcaagaaggaagtattgcacaacctcctggaaaaatatgaaggggcaacggactttggcaaagaaatcattcctgattcagccagtgatcacaatctgcaagcctatctctttgatgactattgggaagacattggtaccattgaagccttctatgaggctaatttagccctgaccaaacaacctagtcccgactttagtttttataacgaaaaagcccccatctataccaggggtcgttatcttccccccaccaaaatgttgaattccaccgtgacggaatccatgatcggggaaggttgcatgattaagcaatgtcgcatccaccactcagttttaggcattcgcagtcgcattgaatctgattgcaccattgaggatactttggtgatgggcaatgatttctacgaatcttcatcagaacgagacaccctcaaagcccggggggaaattgccgctggcataggttccggcaccactatccgccgagccatcatcgacaaaaatgcccgcatcggcaaaaacgtcatgattgtcaacaaggaaaatgtccaggaggctaaccgggaagagttaggtttttacatccgcaatggcatcgtagtagtgattaaaaatgtcacgatcgccgacggcacggtaatctag

SEQ ID NO: 14483 - protein, 439 aa, Synechocystis sp
MCCWQSRGLLVKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRAMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 14484 - DNA, 1477 bp, Arabidopsis thaliana (mouse-ear cress)
  CDS (151)..(1236)
ttttgccaacgaacgttctttcttcttaatcacagctcagcctgacgcaaccgctcaggctgatctcttccaatttacagccatttcccagctcagatctctgatccggtgagatctctctcaaggaaaaggagttagagcatcatcaagatgaaggcactcattcttgttggaggcttcggcactcgcttgagaccattgactctcagtttcccaaagccccttgttgattttgctaataaacccatgatccttcatcagatagaggctcttaaggcagttggagttgatgaagtggttttggccatcaattatcagccagaggtgatgctgaacttcttgaaggactttgagaccaagctggaaatcaaaatcacttgctcacaagagaccgagccactaggtaccgctggtcctctggctctagcgagagacaaattgcttgatggatctggagagcccttctttgttcttaacagtgatgtgattagtgagtaccctcttaaagaaatgcttgagtttcacaaatctcacggtggggaagcctccataatggtaacaaaggtggatgaaccgtcgaaatatggagtggttgttatggaagaaagcactggaagagtggagaagtttgtggaaaagccaaaactgtatgtaggtaacaagatcaacgctgggatttatcttctgaacccatctgttcttgataagattgagctaagaccgacttcaatcgaaaaagagactttccctaagattgcagcagcgcaagggctctatgctatggtgctaccagggttttggatggacattgggcaaccccgtgactacataacgggtttgagactctacttagactcccttaggaagaaatctcctgccaaattaaccagtgggccacacatagttgggaatgttcttgttgacgaaaccgctacaattggggaaggatgtttgattggaccagacgttgccattggtccaggctgcattgttgagtcaggagtcagactctcccgatgcacggtcatgcgtggagtccgcatcaagaagcatgcgtgtatctcgagcagtatcatcgggtggcactcaacggttggtcaatgggccaggatcgagaacatgacgatcctcggtgaggatgttcatgtgagcgatgagatctatagcaatggaggagttgttttgccacacaaggagatcaaatcaaacatcttgaagccagagatagtgatgtgaaaatgagatattatatgtgcaacttttttcttttttttttttgtgtcctttcttcaactttgaaatcgctttcgtaattcttaatggcttttgaataagcatcaatcaaaacgctgtatatcttgttagggtcgtttgctgttttgtctctttttttgttttgtaatttataaaaaaaattattctcattttatgtgagatacttttgaatattcattaattataaagctttttttttgtg

SEQ ID NO: 14485 - protein, 361 aa, Arabidopsis thaliana (mouse-ear cress)
MKALILVGGFGTRLRPLTLSFPKPLVDFANKPMILHQIEALKAVGVDEVVLAINYQPEVMLNFLKDFETKLEIKITCSQETEPLGTAGPLALARDKLLDGSGEPFFVLNSDVISEYPLKEMLEFHKSHGGEASIMVTKVDEPSKYGVVVMEESTGRVEKFVEKPKLYVGNKINAGIYLLNPSVLDKIELRPTSIEKETFPKIAAAQGLYAMVLPGFWMDIGQPRDYITGLRLYLDSLRKKSPAKLTSGPHIVGNVLVDETATIGEGCLIGPDVAIGPGCIVESGVRLSRCTVMRGVRIKKHACISSSIIGWHSTVGQWARIENMTILGEDVHVSDEIYSNGGVVLPHKEIKSNILKPEIVM

SEQ ID NO: 14486 - DNA, 2065 bp, Oryza sativa (rice)
  CDS (134)..(1693)
gaattcgcggccgcctttcctcctctttccctggagccatttcctcccctaaagggcctttccttttcttgatctctcttctatcttcgatccatccatccatccggccatccttcctaggtgaatttcaacgatgcagttcagcagtgtgtttcccttagagggtaaagcatgcgtgagcccaataaggagaggtggtgagggctcagctagtgatagattgaagatcggggacagtagcagcatcaagcatgatagagcagtgaggaggatgtgtcttggttataggggcaccaaaaacggtgcacaatgtgtgctcacctcagatgctggcccagacactcttcatgtccgaacatcattccggaggaactttgcggatccaaatgaggttgctgctgttatattgggtggtggcaccgggactcaactttttcctctcacaagcacaagggccacgcctgctgttcctattggaggatgctataggcttatcgatatccccatgagcaactgtttcaacagtggcataaacaagatattcataatgactcaattcaactcagcatctcttaatcgtcacattcatcgtacgtaccttggtggtggaatcaactttactgatggttctgttgaggtattagccgctacacaaatgcctggggaggctgctggttggttccagggtacagcagatgcagttagaaaatttatctgggttcttgaggactattacaagcataaagctatagaacacattttaatcttgtcaggagatcagctttatcgtatggactacatggagcttgtgcagaaacatgttgatgacaatgctgacattactttatcatgtgctcctgttggagagagtcgagcatctgactatggactagtgaagttcgacagttcaggccgtgtaattcaattttctgaaaaacccaagggcactgacttggaagcaatgaaagtggataccagctttctcaattttgccatagacgacccgactaaatttccctacattgcttcgatgggagtttatgtcttcaaaagagatgttcttttaaaccttctaaagtcaagatatgcagaactacatgactttgggtctgaaatcctcccaagagctttacatgagcacaatgtacaggcatatgtcttcgctgactactgggaagacattggaacgatcagatcgttctttgatgcaaacatggccctttgcgagcagcctcccaagtttgagttttatgatccaaaaactcccttcttcacttcacctcgatatttgccgccaacaaagtcagataaatgcaggattaaagatgcgataatttcccatggctgtctcttgcgtgaatgtaccatcgggcattcgatagttggagtccgttcacgccttaactctgcgtgtgagctcaagaataccatgatgatgggtgcggatttgtacgaaactgaagatgaaatttcaagactactgtcagaaggcaaggtccccattggtgtaggggaaaacacaaagataaacaactgcatcatcgacatgaacgcgagggttggaaggaacgtggtcatcacaaacagcgagggtgtccaagaaagtgatcggcctgaggaagggtactacataaggtcgggaatcgtggtgatcctgaagaacgcgaccatcaaggacgggaaggtcatataggagagctcgctgatgccacagatctctgaaccctgaacctgcaaatgcagtgcagtgcgtcttttcttgaggggttaggacatgcaagctcgttgattccacatggcagagaactcgagggaagatcccaggaagacggatgatcgagaaagattgtgtagtactagcagttcttcgctcgttaaaatgtgtgtactaaataactaataagctgccccgagtgaagtagcagcagcaactttttggagggtcgttggtgcatctcatgtgtaaataaactcaaaactggtaaaaaaatgtatccatcatgccattatctccaaaaaaaaaaaaaaaaaaaaaaaaaaaaaaaaaaaacaaaaaaaagcggcc

SEQ ID NO: 14487 - protein, 519 aa, Oryza sativa (rice)
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 14488 - DNA, 1554 bp, Sorghum bicolor (sorghum)
  CDS (1)..(1554)
atgcagttttcactagcatcggatgcgaactcaggtcctcacccaataagaagatcttgtgagggtggtgggattgacaggttggaacgattaagtattgggggcagcaagcaggagaaagctttgaggaataggtgctttggtggtagagttgctgcaactacacaatgtattcttacctcagatgcttgtcctgaaactcttcattttcaaacacagtcctctagaaaaagttatgctgatgcaaaccatgtatctgctatcattttgggtggaggcactggatctcagctctttcctctgacaagcacaagagctacgcctgctgttcctgttggaggatgttacaggcttatcgatatccctatgagtaactgcttcaacagtggtataaacaagatatttgtgatgactcagttcaattctacttcgcttaaccgccatattcatcgtacataccttggaggcgagatcaactttgctgatggatctgtacaggtattagcggatacacaaatgcccgaagagcctgatggatggttccagggtacagcagactctgtcagaaaatttatctgggtactcgaggattattacaatcacaaatctattgagcacattgtaatcttgagtggcgatcagctttatcagatgaattacatggaacttgtgcagaaacatgtcgaggacaatgctgacatcactgtatcatgtgctcctgttgatgagagccgagcttctaacaatgggctagtgaagtgtgatcatactggacgtgtacttcaattttttgagaaaccaaagggtgctgatttgaattcgatgagagttgataccaacttcctcagctatgctataggtgatgcacagaaatatcagtacatcgcatcaatgggcatttatgtcttcaagaaagatgcacttttagaccttctcaagtcaaaatatactcaattacatgacttcggatctgaaatcctcccaagagctgtactagagcataatgtgcagacatgcattttcatgggctattgggaggatgttggaacaatcaaatcattctttgatgcaaacttggccctcactgagcagccttccaagttcgatttttatgatccaaaaacacctttcttcactgcaccccggtacttgcctccgacacaattggacaagtgcaagatcaaagatgcatctatctcagatggttgcttactgagagaatgcagcatcgagcattctgtgattggagtctgctcacgtgtcagctatggatgtgaactcaaggactgtgtgatgatgggagcggacatctatgaaactgaagaagaagcttcaaagctactgttagctggggaggtcccagttggaataggaggaaacacaaagataaggaactgcatcattgacataaatgctaggattgggaagaacgtggtgatcacaaacagtaagggcatccaagaggctgatcaccctgaggaagggtactacataaagtctggaattgtggtgatcttgaagaatgcaaccatcaaggatgggtctgtcatataa

SEQ ID NO: 14489 - protein, 517 aa, Sorghum bicolor (sorghum)
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 14490 - DNA, 1855 bp, Oryza sativa (rice)
  CDS (34)..(1578)
cagttgcaggtttgtctgggactttgagtacccatgcaattcatgatgccattggatacgaatgcttgtgcacaaccaatgagaagggctggtgagggtgctgggactgagaggttgatggaaagattgaatattgggggcatgactcaggagaaagcactgaggaagaggtgctttggtgatggagttactggaactgcacgacgtgtgttcacatctgatgctgatagagacactcctcatcttcggacacaattctcccgaaagaattatgctgatgcaagccacgtttctgctgtcattttgggtggaggcactggagttcaactctttcctctcacaaggacaagggctacgcccgctgttcctgttggaggatgttacaggcttattgacatccctatgagcaattgcttcaatagcggaataaataaaaatatttttgtgatgactcagttcaatctcacttcgcttaaccgcaatattcatcatacataccttgtgggggggatcaacttaactgatgggtctgtacaggtattggcggctacacaaatgcctgacgaaccggctggatggttccagggtacagcagatgctatcagaaaatttatgtggatacttgaggatcatatccacaaatccattgacaacattgtaatcttgtgtggcgatcagctttacaggatgaattacatggagcttgtgcagaaacatgtcgatacaaatgctgacattaccatatcatgtgctcccatcgacgggagccgagcttctgactatggactggtgaagtttgatcattcaggccgtgtgatccaatttcttgagaaaccagagggtgctgatttggaatcgatggttgataccagcttcctcagctatgcaatagatgacaaacaaaagtatccctacattgcatcaatgggaatttatgtcttgaaaaaggatgttcttttagacattctgaagtcaaaatatgcacacctgcaagactttggatcagaaattctcccgagagctcttttagagcataatgtgaaggtagcatgtgtcttcacagaatattgggaggatattggaacaatcaaatcattttttgatgctaacttggccctcaccgagcagcctccaaagttcgaattttatgatccaaaaactcctttcttcacctcacctcgatacttacctccagcaagattggacaagtgcaagtgcaagatcaaagatgcaataatctcagatggctgttcctttagtgaatgcaccattgagcattctgtcattggaatctcttcacgcgttagctcgggttgtgaactcaagatctatgaaactgaagaagaaacttcaaagctattgtttgaaggcaaggtcccaattggaataggccagaacacaaagataaggaactgtatcatcgacatgaatgctaggattggcaggaacgcgatcattgcaaacactcagggggtccaagagtctgatcaccctgaagagggatacataaggtctggaattgtggtgatcctgaagaatgcaaccaatgcaaccatcaagcacgggaccgtcatataaaagcatagataggccttggaatcgcacctccagtcatctgaaaactggcatccattgatgtgggattttgatgcatgagttcgattcaagacggatagcgtagcctccatggcgaagtggtgtttttggtttagctatatgcctatatgcaataagctgcctgtggaagtcgcgcaaccttttgtgtaatttcaggtttatgtacttggtttgttttggaatgggaactctattattggtattctgaagtttgcacctaaaaaaaaaaaaaaaaaaa

SEQ ID NO: 14491 - protein, 514 aa, Oryza sativa (rice)
MQFMMPLDTNACAQPMRRAGEGAGTERLMERLNIGGMTQEKALRKRCFGDGVTGTARRVFTSDADRDTPHLRTQFSRKNYADASHVSAVILGGGTGVQLFPLTRTRATPAVPVGGCYRLIDIPMSNCFNSGINKNIFVMTQFNLTSLNRNIHHTYLVGGINLTDGSVQVLAATQMPDEPAGWFQGTADAIRKFMWILEDHIHKSIDNIVILCGDQLYRMNYMELVQKHVDTNADITISCAPIDGSRASDYGLVKFDHSGRVIQFLEKPEGADLESMVDTSFLSYAIDDKQKYPYIASMGIYVLKKDVLLDILKSKYAHLQDFGSEILPRALLEHNVKVACVFTEYWEDIGTIKSFFDANLALTEQPPKFEFYDPKTPFFTSPRYLPPARLDKCKCKIKDAIISDGCSFSECTIEHSVIGISSRVSSGCELKIYETEEETSKLLFEGKVPIGIGQNTKIRNCIIDMNARIGRNAIIANTQGVQESDHPEEGYIRSGIVVILKNATNATIKHGTVI

SEQ ID NO: 14492 - DNA, 1599 bp, Hordeum vulgare (barley)
  CDS (41)..(1552)
caaaccaagctcccggccgggcggattcattggttgcgcgatggacctgcgcgtcgctgcccccgcctccgtggccgccgccgcgcgccggggcgcgctcggatgcgcgcgcgtccggccgctccaaggccgccgccagtgccgcccctcggtgcgcgtctccgtcgcgaccacagagtccgccgccgccgccgccgccgtatccgcctcggcggacgaggacgcggagacgacgaacccgaggacggtggtggcggtcatcctcggcggcggcgccgggaccaggctcttccctctcaccaagcgcagggccaagccggcggtgccgataggcggcgcgtacaggctcatcgacgtgcccatgagcaactgcatcaacagcgggatcaacaaggtgtacgtcctcacccagttcaactccgcctccctcaaccgccacctcttcagggcctacaacttcagcaatggcgtcggcttcggagacggtttcgtcgaggttctggcagcaactcagaggcctggatcggagggaaagaggtggtttcagggtaccgccgacgcggttcggcaattcgcttggcttttcgatgatgccaaatctaaagacatagaggatgtattgattctttcgggcgatcacctctaccgtatggactacatggactttgttcagagtcatcggcagagagatgcaggcatcagcatctgttgcttgcctattgacgacagccgggcgtctgattttggtctaatgaagatagacgacacaggaagagttatttcatttagtgaaaaaccgaaaggagctgacttgaaagcaatgcaagttgacaccactctcctcggcttaccgaaggaggaagcagaaaagaaaccatacatagcttcaatgggggtatacatattcaagaaagagatacttctaaatcttttgagatggcgttttcccactgcaaatgattttggctctgaaataattcctgctgcagcaagagagattaatgtaaaggcatatcttttcaatgattactgggaagacattggaactattaaatccttcttcgaagcaaatcttgcccttgctgaacagccttcaaagttcagcttctatgatgctagcaaaccgatgtacacatcacggagaaacctaccaccatctatgatcagcggtagtaagatcactgattcgatcatttcccacggatgtttcttggataaatgcagggtagagcacagtgtcgttggaatccgttctcggataggctccaacgtacacctcaaggatacggtaatgctcggtgctgatttctatgaaactgatgcggaaagaggtgaccagctggctgaaggaaaggttccaattgggatcggggagaacacttcgattcaaaactgcatcattgacaagaatgcgaggatagggaagaacgtgaccattgctaacaccgagggtgtacaggaatcagacaggacatcagaaggcttccacatccggtccggcatcacggttgtgctgaagaactcagtgatcgcggatggattagtcatatgatctgaaagaagtgactctccagtctccagttaagcaagagaaataaa

SEQ ID NO: 14493 - protein, 503 aa, Hordeum vulgare (barley)
MDLRVAAPASVAAAARRGALGCARVRPLQGRRQCRPSVRVSVATTESAAAAAAVSASADEDAETTNPRTVVAVILGGGAGTRLFPLTKRRAKPAVPIGGAYRLIDVPMSNCINSGINKVYVLTQFNSASLNRHLFRAYNFSNGVGFGDGFVEVLAATQRPGSEGKRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDKNARIGKNVTIANTEGVQESDRTSEGFHIRSGITVVLKNSVIADGLVI

SEQ ID NO: 14494 - DNA, 2032 bp, Pisum sativum (garden pea)
  CDS (137)..(1669)
gtcacattcttctctttgtttctctagattctatattttagttgtgacctttcactactagcattgtttctctcttattctcttggtctgagtttgaacaaactcaaaaaaagcttagttttttgaggttactacaatggcttctggttgtgtgagcttgaaaaccaacacccattttccaaattctaaaaaaggttctttttttggggaaagaatcaaaggaagcttgaaaaacagttcatgggtcactacccagaagaagatcaaacctgcttctttttctgctattcttacttcagatgaccccaaaggttccctgaatttgcaagtgccttcatttctgagactaagagctgatccaaaaaatgtgatttccattgtgttgggaggagggcctggaacacatctctatcctcttaccaaacgagctgcaacacctgcggttcctgttggaggatgctataggcttatagacattccaatgagcaactgcatcaatagtggcatcaacaagatatttgtgctgactcagttcaactctgcttcactaaatcgtcacatcgctcgcacctatttcggaaatggtgtcaactttggagatggatttgtggaggttctggcggcgactcaaacaccaggagaagctgggaagaagtggtttcaaggaactgcagatgctgtgagacaatttacctggatatttgaggatgccaagaatataaacgtcgagaatgtattgatcttggcgggagatcatttatatcgaatggattacatggacctattgcagagtcacgttgatagaaatgccgatattacagtttcgtgtgctgccgttggtgacaaccgcgcatctgattatggattggtcaaggtagacgacagaggcaacatcatacaattttcagaaaaaccgaaaggcgctgatctgaaagcaatgcaagtagatacttctcgtcttgggttgtcgccacaagatgcattgaagtcgccatatattgcatctatgggagtttatgtgttcaagaaagatgttttactcaagcttctgaaatggaggtatcctacttctaatgacttcggatccgaaatcattccttccgctataagagaacacaatgtccaagcatactttttcggagactactgggaagatattggaacgataaaatccttctacgatgctaacctcgctcttactgaagagagtccaaagttcgagttttatgatccaaaaacaccgattttcacatctcctggattcctaccaccaacaaagattgacaactctcgggttgtggatgccattatctcccatggatgtttcctgagagattgtacaatccaacactccattgtaggtgaaaggtcgcgtttagattatggcgttgagcttcaggacactgtaatgatgggagctgactattaccaaactgaatccgaaatcgcttccctacttgcagaagggaaggtcccgattggcatcggaaggaataccaaaatcaagaactgcattattgacaagaatgcaaaaatcgggaaagaagttgtcatcgcgaacaaagaaggcgttcaagaagcagatagatcggaagatggtttctacatccgatcaggaatcaccatcataatggagaaagcaacgatagaagacggaactgtcatataaacaatggttagtagttatttcacgagctggtttccgtaaagcgccggaagaagcattgcaaggaacactccctcccatcttttgggattggtacaaaatgttatgttgaatagagaaagctgcatgtgtaaaataggagagctctttcactagatgtagaaatagaaatgaataaatgatgaaagtgaagatgcagaaaagttaaataaatggaagggttgagtgtgtgaaggtatcaagtttctatatcctctcccttgaaactgcaaaggacatgttttaaattattgtatcacttaattattgttttgaatggtggtaataagcattataatcacttatttgcttcaaaaaaaaaaaaaa

SEQ ID NO: 14495 - protein, 510 aa, Pisum sativum (garden pea)
MASGCVSLKTNTHFPNSKKGSFFGERIKGSLKNSSWVTTQKKIKPASFSAILTSDDPKGSLNLQVPSFLRLRADPKNVISIVLGGGPGTHLYPLTKRAATPAVPVGGCYRLIDIPMSNCINSGINKIFVLTQFNSASLNRHIARTYFGNGVNFGDGFVEVLAATQTPGEAGKKWFQGTADAVRQFTWIFEDAKNINVENVLILAGDHLYRMDYMDLLQSHVDRNADITVSCAAVGDNRASDYGLVKVDDRGNIIQFSEKPKGADLKAMQVDTSRLGLSPQDALKSPYIASMGVYVFKKDVLLKLLKWRYPTSNDFGSEIIPSAIREHNVQAYFFGDYWEDIGTIKSFYDANLALTEESPKFEFYDPKTPIFTSPGFLPPTKIDNSRVVDAIISHGCFLRDCTIQHSIVGERSRLDYGVELQDTVMMGADYYQTESEIASLLAEGKVPIGIGRNTKIKNCIIDKNAKIGKEVVIANKEGVQEADRSEDGFYIRSGITIIMEKATIEDGTVI

SEQ ID NO: 14496 - DNA, 2099 bp, Lycopersicon esculentum (tomato)
  CDS (214)..(1764)
atcacactcccctttgtccacttgatcactcaataacacaacttcttgtgattcacttacaattctagatctcctgaaaaactttttcttgattctacaccactagcaatttacattttctctttcactgattttggttacttatttgacattcttgttttcaagaatccaaaaatcatcactttccagaaatggatacttgttgtgcgggctatgaaatcgacggttcatttggggagagtgagcactggtggctttaacaatggagagaaggagatttttggggagaagatcagagggagtttgaacaacaatctcaggattaatcagttgtcgaaaagtttgaaacttgagaagaagattaaacctggggttgcttactctgtgatcactactgaaaatgacacagagactgtgttcgtagatatgccacgtcttgagagacgccgggcaaatcccaaggatgtggctgcagtcatattaggaggaggcgaagggaccaagttattcccacttacaagtagaactgcaacccctgctgttccggttggaggatgctacaggctgatagacatcccaatgagcaactgtatcaacagtgctattaacaagatttttgtgctgacacagtacaattctgctgccctgaatcgtcacattgctcgaacgtattttggcaatggtgtgagctttggagatggatttgtcgaggtactagctgcaactcagacacctggggaagcaggaaaaaaatggtttcaaggaacagcagatgctgtcagaaaatttatatgggtttttgaggacgctaagaacaagaatattgaaaatatccttgtattatctggggatcatctttataggatggattatatggagttggtgcagaaccatattgacagaaatgctgatattactctttcatgtgcaccagctgaggacagccgagcatcagattttgggctggtcaagattgacagcagaggcagagttgtccagtttgctgaaaaccaaaggtttgagcttaaagcaatgctagtagatactagtcttgttggattatctccacaagatgcgaagaaatccccttatattgcttcaatgggagtttatgtattcaagacagatgtattgttgaagctcttgaaatggagctatcccacttctaatgattttggctctgaaattataccagcagctattgatgattacaatgtccaagcatacattttcaaagactactgggaggacattggaacaattaaatctttctataatgctagcttggcgcttacacaagagtttccagagttccaattttacgatccaaaaacacctttttacacatctcctaggttccttccaccaaccaagatagacaattgcaagattaaggatgccataatttctcatggatgttttttgcgagattgcactgtggaacactccatagtgggtgaaagatcgcgcttagactgtggtgttgaactgaaggatactttcatgatgggagcagactactaccaaacagaatctgagattgcctccctgttagcagaggggaaagtaccgattggaattggggaaaatacaaaaataaggaaatgtatcattgacaagaacgcaaagataggaaagaatgtttcaatcattaacaaagatggtgttcaagaggcagaccgaccagaggaaggattctacatacgatcagggataatcattatatcagagaaagccacaattagagatggaacagttatatgaactagaaaagcatctcttgttgaactagtggaaatccaaatctcaacttgaagaaggtcaagggtgatgacctattttcccacgaaacctagcacattcagctccggaagaagctttctatgctcatgtgaaaagagcaagtataatcgagacacgtgtctaaaataaaactaaagttgctgcctagttcatgttctaagagtcacattatagtaagatagcattttgaagaactcaatagtttatctattgctcaacttaggcttttcgtattgtaaaaaactctagttcaaaaaaaatgcatcttttctctatttgttttataaaaaaaaaaa

SEQ ID NO: 14497 - protein, 516 aa, Lycopersicon esculentum (tomato)
MKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAENQRFELKAMLVDTSLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 14498 - DNA, 1850 bp, Lycopersicon esculentum (tomato)
  CDS (47)..(1597)
tataaacagccatttcagtactcttgattctcagaggaaaaaaaaaatgtctgtggctactgacgttagattcgcgctacttcgtaataaccctgcagcactgacagggacaaacttgaagatagtgaagttttgcaatggagaattgatggggaagaaactcaagtatacaaaatttcagttaaggagtaatgtagtgaagcctcatatctgcatgtcacttacaactgatattgcaggtgaggctaagttgaaggatcttgaagcaaagaaggaggatgcaagaacagtagtagcaatcattctaggagggggagggggaactcgtcttttccccctcaccaaacgtcgtgctaagcctgctgttccaataggaggagcatacaggctaattgatgtaccaatgagcaactgtattaacagtggcatcaacaaagtatacattctcactcagttcaactcggcctcacttaacaggcatattgctcgtgcgtacaactttggcaatggggtcacattcggagatggttatgtcgaggtcttagcagcaactcaaacaccaggtgaattaggtaaaagatggttccaaggtactgcagatgctgtgaggcaatttcactggctttttgaggatgcaagaagcaaggacatagaagatgtgctcattctctctggagatcacttgtatagaatggactacctgcactttgttcagagtcatcggcaaagtggtgcagacattaccatatcaagcttgccaatagatgacagtcgagcttcagattttggcttgatgaaaattgatgacacagggcgggtcatgtccttcagcgaaaagccaaaaggagatgatttgaaggcgatggcagtagacacaactgttctgggattatctccagaagaggctaaagagaaaccttacattgcttcaatgggagtttacgtcttcaagaaggatattctcctcaatcttttaagatggcgttttccaactgtaaatgacttcggttcagagatcatacctgcctctaccaaagaattctgtgtcaaggcttactacttgttcaatgattactgggaagatattggtacaatcagatccttttttgaagcaaaccttgcactcactgaacatccaccaagatttagtttctatgatgcaacaaagccaatatacacgtcaaggagaaacttacctccatcagcgattgataatagcaagattgttgattcaattgtatcacatggtagtttcttgaccaattgcttcgtggagcacagtgttgttggcatccgatcccgtataggcaccaatgttcacttgaaggacacagtgatgcttggtgctgactactatgaaactgatgctgagattgcttcacagctagctgaaggaaaagtgcctttaggaataggagagaataccagaataaaagagtgcatcattgacaagaatgcaagaattggaaaaaatgttgttattgccaactcagagggtgtgcaagaagcagacagatcctcagaaggattttacatacgatcaggcatcacagtcatattgaagaactcaacaatcccagatggaactgtgatatgacaagtgtgacaatgtctttttgtcttctctttcaagtagaattggcaccaagaaaattgtgaaatatgagaagtaaaagtttcagattatcaacttttccacatgcagcaagtaaatattgaactaaaggccgatgataagaagggttgtttctcccattgatgaattttgaactaagaataaaatgtctgttcaagggtgaactttttcaataaactagctgatgacactaacaaaatatggttttcacagt

SEQ ID NO: 14499 - protein, 516 aa, Lycopersicon esculentum (tomato)
MSVATDVRFALLRNNPAALTGTNLKIVKFCNGELMGKKLKYTKFQLRSNVVKPHICMSLTTDIAGEAKLKDLEAKKEDARTVVAIILGGGGGTRLFPLTKRRAKPAVPIGGAYRLIDVPMSNCINSGINKVYILTQFNSASLNRHIARAYNFGNGVTFGDGYVEVLAATQTPGELGKRWFQGTADAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASMGVYVFKKDILLNLLRWRFPTVNDFGSEIIPASTKEFCVKAYYLFNDYWEDIGTIRSFFEANLALTEHPPRFSFYDATKPIYTSRRNLPPSAIDNSKIVDSIVSHGSFLTNCFVEHSVVGIRSRIGTNVHLKDTVMLGADYYETDAEIASQLAEGKVPLGIGENTRIKECIIDKNARIGKNVVIANSEGVQEADRSSEGFYIRSGITVILKNSTIPDGTVI

SEQ ID NO: 14500 - DNA, 2019 bp, Lycopersicon esculentum (tomato)
  CDS (122)..(1696)
tctcctgaaaaactttttcttgattctacaccactagcaatttacattttctctttcactgattttggttacttatttgacattcttgttttcaagatccaaaaatcatcactttccagaaatggatacttgttgtgcggctatgaaatcgacggttcatttggggagagtgagcactggtggctttaacaatggagagaaggagatttttggggagaagatcagagggagtttgaacaacaatctcaggattaatcagttgtcgaaaagtttgaaacttgagaagaagattaaattcggggaagcttactctgtgatcactattgaaaatgacacagagactgtgttcgtagatatgccacgtcttgagagacgccgggcaaatcccaaggatgtggctgcagtcatattaggaggaggcgaagggaccaagttattcccacttacaagtagaactgcaacccctgctgttccggttggaggatgctacaggctgatagacatcccaatgagcaactgtatcaacagtgctattaacaagatttttgtgctgacacagtacaattctgctgccctgaatcgtcacattgctcgaacgtattttggcaatggtgtgagctttggagatggatttgtcgaggtactagctgcaactcagacacctggggaagcaggaaaaaaatggtttcaaggaacagcagatgctgtcagaaaatttatatgggtttttgaggacgctaagaacaagaatattgaaaatatccttgtattatctggggatcatctttataggatggattatatggagttggtgcagaaccatattgacagaaatgctgatattactctttcatgtgcaccagctgaggacagccgagcatcagattttgggctggtcaagattgacagcagaggcagagttgtccagtttgctgaaaaaccaaaaggttttgatcttaaagcaatgcaagtagatactactcttgttggattatctccacaagatgcgaagaaatccccttatattgcttcaatgggagtttatgtattcaagacagatgtattgttgaagctcttgaaatggagctatcccacttctaatgattttggctctgaaattataccagcagctattgatgattacaatgttcaagcatacattttcaaagactactgggaggacattggaacaattaaatctttctataatgctagcttggcgctcacacaagagtttccagagttccaattttacgatccaaaaacacctttttacacatctcctaggttccttccaccaaccaagatagacaattgcaagattaaggatgccataatttctcatggatgttttttgcgagattgcactgtggaacactccatagtgggtgaaagatcgcgcttagactgtggtgttgaactgaaggatactttcatgatgggagcagactactaccaaacagaatctgagattgcctccctgttagcagaggggaaagtaccgattggaattggggaaaatacaaaaataaggaaatgtatcattgacaagaacgcaaagataggaaagaatgtttcaatcattaacaaagacggtgttcaagaggcagaccgaccagaggaaggattctacatacgatcagggataatcattatagcagagaaagccacaattagagatggaacagttatatgaactagaaaagcatctcttgttgaactagtggaaatccaaatctcaacttgaagaaggtcaagggtgatgacctattttcccacgaaaacctagcacattcagctccggaagaagctttctatgctcatgtgaaaagagcaagtataatcgagacacgtgtctaaaataaactaaagttgctgcctagttcatgttctaagagtcacattatgtaagatagcattttgaagaactcaatagtttatctattgctcaacttaggcttttcgtattgtaaaaaactctagttcaaaaaaaatgcatcttttttctatttgtttttt

SEQ ID NO: 14501 - protein, 524 aa, Lycopersicon esculentum (tomato)
MDTCCAAMKSTVHLGRVSTGGFNNGEKEIFGEKIRGSLNNNLRINQLSKSLKLEKKIKFGEAYSVITIENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIIAEKATIRDGTVI

SEQ ID NO: 14502 - DNA, 2009 bp, Cucumis melo var. markuwa Markino (Oriental melon)
  CDS (154)..(1731)
tgcgagctccaccgcggtgcgccgctctagaactagtggatcccccgggctgcaggaattcggcacgagccgccttcttcatcactcacatttttcactcccttttcccctttctctcttcttctgcttttgatccgtttcctcttttgagatatggttgcgatggattcctgctttgtctctttgaaatccaatacccaattgatgaagggtaattggggaggtttggatcgttgtgagaatggatttatggtcgagaaagttagaggaggttttaatgaaaatgtttggattaagagtttgaaatatgagaagaaagctttgaagcttaccccaaatgttgcttatgctgtgacgcctaatgtttcaaagcagcctatgaccattcaagttccaacagttcctaaagtaaaagcgaatcccaaaaatgttgcttcaatcatattgggagggggtgctgggactcacctgtttccgcttactaaaagatcagcaacgcccgctgttccagccggaggatgctataggcttatagatattccaatgagcaactgcatcaacagtgggatcaacaaaatatttgtgcttacccagttcaactctgcttctttgaatcgtcatatctcgcggacatactttggaaatggtgtcacttttaaggaaggatttgtggaggttcttgcagccacacaaacatctggggaatccggtatgtactggttccaaggaactgcagatgctgtgagacaatttatttgggtatttgaggatgccaagaacagaaatgttgagaacattctaattttggcaggggatcacatgtacagaatgggctatatggactttgttcagaatcacattgatcgcaatgctgatatttcaatctcgtgtgcagctgtggatgacagccgcgcatcagactacggattggtgaaattagatagtagaggtcgaattatccagttttctgaaaagccaaagggtgccaatttgaatcgaatgcgagtagatacaacttcatttggtctgtctcgggaggagtctttgaagtctccttacattggatcaatgggagtttatgttttcaaaacggatgttttgctaaaccttttgaagtggagatatccttcatctaatgacttcggctctgaaatcattcctgcagctataaaggaccacaatgtccaagcatttatgtttagagattattgggaggacattggaacaataaagactttctatgatgcaaacttggcccttcacgggaacgtttctaagtttgaattttatgaccccaagacacctttctatacgtctcctcgattcttacccccgaccaagatcgacaggtgtcagattgtcgatgcaataatctcacatggatgctttttgagagaatgtagtatccaacattcgatagtcggtgaacggtcaagattagactatggtgttgaacttaaggatacgataatgatgggtgcagacaattaccaaaccgaatctgaaattacaggtctgctagcagagggaaaagtccctgtagggattggaccaaacacgaaaatcaggaagtgtataatcgataagaatgcaaaaattgggaaggatgttatcattatgaacaaagatggcgtccaagaagcagatcggcctgaacagggattctacattcgctcgggaatcaccattgtaatggaaaaggcaacaatcgaagatggcaccgttatatgaacagaactcaaaatcctcaatcttggtttggaagacatgttagaggaggaaggaaaatggtgtgaagttggctttcatgagactgcctaaactgtggcagctgaagaatcagcattgtagcttgagaaaaaggagaaaggatttgattatggacgattgagtttaaagcttcttttcagatctttagagatagcttttaagaggttcgacaaaaaggaagctccacatggagaagagagtctaaatcttagtgtaattctgttcaataagaatggcta

SEQ ID NO: 14503 - protein, 525 aa, Cucumis melo var. markuwa Markino (Oriental melon)
MVAMDSCFVSLKSNTQLMKGNWGGLDRCENGFMVEKVRGGFNENVWIKSLKYEKKALKLTPNVAYAVTPNVSKQPMTIQVPTVPKVKANPKNVASIILGGGAGTHLFPLTKRSATPAVPAGGCYRLIDIPMSNCINSGINKIFVLTQFNSASLNRHISRTYFGNGVTFKEGFVEVLAATQTSGESGMYWFQGTADAVRQFIWVFEDAKNRNVENILILAGDHMYRMGYMDFVQNHIDRNADISISCAAVDDSRASDYGLVKLDSRGRIIQFSEKPKGANLNRMRVDTTSFGLSREESLKSPYIGSMGVYVFKTDVLLNLLKWRYPSSNDFGSEIIPAAIKDHNVQAFMFRDYWEDIGTIKTFYDANLALHGNVSKFEFYDPKTPFYTSPRFLPPTKIDRCQIVDAIISHGCFLRECSIQHSIVGERSRLDYGVELKDTIMMGADNYQTESEITGLLAEGKVPVGIGPNTKIRKCIIDKNAKIGKDVIIMNKDGVQEADRPEQGFYIRSGITIVMEKATIEDGTVI

SEQ ID NO: 14504 - DNA, 2227 bp, Cucumis melo var. markuwa Markino (Oriental melon)
  CDS (346)..(1902)
gagaagctgaaagaatcggtcccatcccgtttgcgaaacactcttattgccgccgtgttcaactcccaaagcggccctctcatgagaaaaaaatcaagatcgccagacttttccatggctccccaaacccaaataatttaatcacgctaatttccatacctttcacattcatcttctccttcactcgatctttcatctttctcccattcccgcctttcttcttccctcctacactcttcattctacattctctcgtccttcttcttaggtgccactgatctaccccgttttgggtcacttcatttcaccaatggattcctttggcgtcgcctgaaccccaatacgatgcataagatcagtagtcaggagaagaatcaatgctttgggttttggggagacagtagtcttggaagaaacggaaggtggaaacagatacagaggaatgcctcctcgcggaacaattctgattcttcttcttctagcagggctagaagcttgcacccggagttgcttattctgttctcatgttcagaagttaatgaggaaacaacgactttacaggcccctatatttgaagctccaagagctgatccgaaaaaggttgcttcgattatactgggtggaggtgctggaactcgtttgtttcctcttaccagtcagcgagccaaaccagcggttcctattggaggttgttataggttgatcgacatacccatgagtaactgcatcaatagtggcatcgaaaagatatcgtctaacgcagttaactcattttctctcaatcgtcaccttgctcgtatttataattttggtaatggagtcaattttggcgatggattcgtggaggttctagctgccactcagacttcgggtgaaactggaaaaaaatggttccaaggaactgctgatgctgtcaggccatttatatggttatttgaggatgctcagaccaaaaatgttgagcacactctaattttgtctggcgatcacctttaccggatggactacatggattttgtgcagagacatattgacacaaatgcagatattactgtttcatgcatacccatggatgatagccgtgcatcagattacggtctcatgaaaatagatgatacaggacgtattatacatttttcagagaaaccaaagggatctgacctggaagaaatgcaagttgacactgcagttctaggactttcagatgaagatgctagaaaaaatccttatattgcttcaatgggagtctacatattcagaacagatcttctattaaagcttttgacatggagttatcctgcgtgcaatgactttggctcagaaattattcctgcggctgttaaagactacaaagttcaagcatatctattcaatgactactgggaggacattggaacagtaaaatcattttttgatgccaacttagcactaacggagcagcccccaaaatttgagttctatgatcccaagactccattttatacctcacctagatcttgccccccttctaaagttgaaaaatgcaggattgtagatgcaattatctcccacggttgcttcctccgagagtgtactgttgaaccacttattgttggcgtgcgctctcgactggagtatggtgtggagcttaaggataccatgatgatgggtgcttactactaccagacggaatctgaaattgcatctctccttgctgaaggaaagatcccaattggcattggagagaacaccaaaatcaggaattgcataattgacaagaatgccaagatcggaagaaatgtggttattgcaaatactgatgacgttcaagaagcagatagaccagaagaaggtttttatataaggtccggtatcacagtcacgttgaagaatgcaacaataaaagatggaaccattatttaaaatccaaaggcagcctcccattcaggtcaagagatagctaagagttggaaggaagcaattgctagaggctttcaacctacaatgctcggcaacgagtaatagcgtataacttcccttaatgtaaaatactagtttcttttcatatatgtaaaaagtaggaaggcaacacatttccatcctgagtaataacaactccttatatcataagagaacaattttcaaagccatttgacattagcttcttggatgagcaaatctcatctctgtgaaagagttactctcttaaaactcacaagttatattaagttgttaatatttgcttggc

SEQ ID NO: 14505 - protein, 518 aa, Cucumis melo var. markuwa Markino (Oriental melon)
MHKISSQEKNQCFGFWGDSSLGRNGRWKQIQRNASSRNNSDSSSSSRARSLHPELLILFSCSEVNEETTTLQAPIFEAPRADPKKVASIILGGGAGTRLFPLTSQRAKPAVPIGGCYRLIDIPMSNCINSGIEKISSNAVNSFSLNRHLARIYNFGNGVNFGDGFVEVLAATQTSGETGKKWFQGTADAVRPFIWLFEDAQTKNVEHTLILSGDHLYRMDYMDFVQRHIDTNADITVSCIPMDDSRASDYGLMKIDDTGRIIHFSEKPKGSDLEEMQVDTAVLGLSDEDARKNPYIASMGVYIFRTDLLLKLLTWSYPACNDFGSEIIPAAVKDYKVQAYLFNDYWEDIGTVKSFFDANLALTEQPPKFEFYDPKTPFYTSPRSCPPSKVEKCRIVDAIISHGCFLRECTVEPLIVGVRSRLEYGVELKDTMMMGAYYYQTESEIASLLAEGKIPIGIGENTKIRNCIIDKNAKIGRNVVIANTDDVQEADRPEEGFYIRSGITVTLKNATIKDGTII

SEQ ID NO: 14506 - DNA, 1961 bp, Arabidopsis thaliana (mouse-ear cress)
  CDS (160)..(1725)
aaaaaaaattacataataaatagagaagagattttggaagagagaaaatgcaatttagctcctcacgtattagcaatttaagttcttgtcttggtcttccctcgatttcaaacgacattaaccaaaaccagagaactacgaattattcgctaaaaaaagatggattcttgttgcaactttagcttggggacaaaaactgtcttggccaaagacagtttcaagaatgtagagaacaaatttttgggtgagaagatcaaaggaagcgtcttgaagcctttttcttcagatttgagttccaagaagttcagaaatcgaaaattgaggcccggtgttgcttacgctattgctacctcaaagaatgctaaagaggctttgaaaaatcaaccttccatgtttgagagaagaagagcagatcctaaaaatgtggctgcaatcattctaggaggaggcgatggagctaaactctttcctcttaccaagcgagcagcaacacctgctgttcctgtgggtggatgctataggatgatcgatatcccgatgagtaattgcattaacagttgcataaacaagattttcgtgctgactcagtttaactcggcttccctcaatcgccatttggctcgtacttattttgggaatggcataaactttggagatggttttgttgaggttctggctgctacacaaactcctggtgaagccgggaaaaagtggtttcaaggcacagctgatgctgtgagaaaatttctgtgggtgtttgaggatgctaagaacaggaacattgagaatataatcatcttgtctggagatcacctatatagaatgaactatatggactttgttcagcaccatgtcgatagtaaagccgatattactctttcgtgcgcgccggttgatgagagccgtgcgtcggagtatggactggtcaatattgatcgaagcgggcgtgtagtccatttctctgagaaaccaactggcatcgatctgaaatcaatgcaaaccgatactactatgcatggactgtctcatcaagaagcagcaaaatctccatacattgcgtcaatgggagtttattgtttcaaaaccgaagctttactgaagcttctgacatggcggtatccgagttccaatgactttgggtctgaaattattcctgcagctataaaagatcacaatgttcaaggatacatctacagagactattgggaagacatcggaactattaagagtttctatgaagctaatattgctcttgtcgaggagcatcccaagtttgagttttacgatcagaatacacctttctacacttctcctcggtttctaccacccaccaaaaccgagaagtgccggattgtaaattcggtaatctcacacggatgtttcttgggagaatgcagcatccaacgttccattattggtgaaagatcacgtcttgactatggtgttgagcttcaggatactcttatgttaggagcggatagttaccaaaccgaatctgagatcgcgtctctgcttgcggaaggaaatgttccaattggcattggccgagatacaaagatcaggaaatgcatcattgacaagaatgcaaagatcgggaaaaacgtggtgatcatgaacaaagatgatgttaaggaggctgataggccagaggaaggattctacattcgatctggaatcactgtggttgtcgaaaaggccaccattaaagacggtactgtgatatgaacaaaacgatctcaagaccgccgtggtgattttgaggtgtttggccggaagttaaaaagagagaccgttgtgattttgtcatgtaaattagaagaggagatagaagaatcatacaatttagaagcaaaagcaagtttaagctttacaataagagtgatcagccgatcacctatagctataatagtcactctcttttcataatgatcaataaataaagctatctatcttcttctgtt

SEQ ID NO: 14507 - protein, 521 aa, Arabidopsis thaliana (mouse-ear cress)
MDSCCNFSLGTKTVLAKDSFKNVENKFLGEKIKGSVLKPFSSDLSSKKFRNRKLRPGVAYAIATSKNAKEALKNQPSMFERRRADPKNVAAIILGGGDGAKLFPLTKRAATPAVPVGGCYRMIDIPMSNCINSCINKIFVLTQFNSASLNRHLARTYFGNGINFGDGFVEVLAATQTPGEAGKKWFQGTADAVRKFLWVFEDAKNRNIENIIILSGDHLYRMNYMDFVQHHVDSKADITLSCAPVDESRASEYGLVNIDRSGRVVHFSEKPTGIDLKSMQTDTTMHGLSHQEAAKSPYIASMGVYCFKTEALLKLLTWRYPSSNDFGSEIIPAAIKDHNVQGYIYRDYWEDIGTIKSFYEANIALVEEHPKFEFYDQNTPFYTSPRFLPPTKTEKCRIVNSVISHGCFLGECSIQRSIIGERSRLDYGVELQDTLMLGADSYQTESEIASLLAEGNVPIGIGRDTKIRKCIIDKNAKIGKNVVIMNKDDVKEADRPEEGFYIRSGITVVVEKATIKDGTVI

SEQ ID NO: 14508 - DNA, 1790 bp, Ipomoea batatas (sweet potato)
  CDS (68)..(1636)
agaacacgttctcgcttcacacactccaaagtccgcagagagctcagagtggtagcgcggcgttaaaatggcagcagcgacgatcggagctctgtcgtctccgtataccggcggcgttggggagagaattgacggtgatgttagcaaggcgtcgttccggaggttgtcgttcgcgtcgtctcatctctctggcgataagctgatgccattgcctcctcgacggcttcgttccggcggtaaatcctccgaggttcggactgctccgttcatcgtttctccaaaggctgtttccgattcgcagaattcgcagacttgtctagatcctgatgctagccgaagcgtcttgggaattatcctcggaggtggtgctgggaccagactctatcctctcacaaagaagcgggcaaagccagctgttccacttggagcaaattatcgtctaattgatatccctgtgagcaattgcttgaacagtaacatatccaagatctatgttcttacacaatttaactctgcatcacttattcgtcacctctcacgggcatatgcaagtaacatgggtggttacaaaaatgaaggcttcgtggaagttcttgctgctcagcaaagtcctgagaaccccaattggttccagggtactgctgatgcagtcagacaatatctatggctttttgaggagcacaatgttcttgaattcctggttctcgctggagatcacctataccgaatggattatgagagattcattcaagcccacagagaaacagatgcggatattacagttgctgcactgccaatggatgagaagcgtgccactgcatttggtctcatgaagattgatgaagaagggcggattattgaatttgcagagaaaccaaaaggagaacagttgaaagctatgaaggttgatactactcttttcggtcttgatgatcagagagctaaagagatgccttatattgcaagtatgggaatatatgttgtaagtaaagatgtgatggttaacttacttcgacaaaagttccctggagcaaatgattttggaagtgaagttattcctggtgcaacatccattggattgagagttcaagcttatttgtttgatggctactgggaggatattggtacaattgaagccttctataatgccaatttgggaatcacaaaaaagcctgtgccagatttcagcttctatgaccgatcagctcccatttacactcaacctcgatatttacctccttctaaaatgcttgatgctgatgtcacagacagcgttattggtgaaggttgtgtaatcaagaactgtaaaattcaccattctgtggttggacttagatcatgcatatcggagggagcaattatagaagatacattattgatgggagcagattactatgagacggatgctgacaggaggcttctggctgcaaagggaagtgttccaattggaattggcaggaattcacacatcaaaagagcaatcattgacaagaatgctcgtattgggaatgatgtgaagatcattaacaatgacaatgttcaagaagcagctagggaaactgaaggatatttcattaaaagtggaatcgtcacaatcatcaaggatgcattgattcccagtggaaccatcatctagaagtatttgaaaatcatatgtacatgattactgtagtgtagccgtttgagagactaatgatgcattctgttaaaccttcgttttagttttaaaattttaaataataaagcatcatcggcatctctatgctgctttttttttcccaaaaaaaaaa

SEQ ID NO: 14509 - protein, 522 aa, Ipomoea batatas (sweet potato)
MAAATIGALSSPYTGGVGERIDGDVSKASFRRLSFASSHLSGDKLMPLPPRRLRSGGKSSEVRTAPFIVSPKAVSDSQNSQTCLDPDASRSVLGIILGGGAGTRLYPLTKKRAKPAVPLGANYRLIDIPVSNCLNSNISKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTLFGLDDQRAKEMPYIASMGIYVVSKDVMVNLLRQKFPGANDFGSEVIPGATSIGLRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDTLLMGADYYETDADRRLLAAKGSVPIGIGRNSHIKRAIIDKNARIGNDVKIINNDNVQEAARETEGYFIKSGIVTIIKDALIPSGTII

SEQ ID NO: 14510 - DNA, 1823 bp, Ipomoea batatas (sweet potato)
  CDS (40)..(1611)
aacacgttacacactccatagcgatcgaagagagaggcaatggcggcagcaatcggagctccgaagctcgccccgtatacctgcacggcggagaggaacgacggctctgctcggcgtgctgcgaggttcaagagcctctcgttcgcgtcttctaatctctccggcgacaaactcggctcgttagtttctcggcgctgcagccgttccggagggaaatcgtcggagaggcgtaatgctccgattatcgtttcccctaaagctgtttccgactcccagaattcgcagacttgtctcgatcctgatgctagccgaagtgtcttgggaattattcttggaggtggagctgggacccggctctatcctctaacaaagaagagggcaaagccagctgttccacttggagcaaactatcgtctgattgatatccctgttagcaattgcttgaacagtaatgtttccaagatctatgttcttacacaatttaactctgcatcacttattcgtcacctctcacgggcatatgcaagtaacatgggtggttacaaaaatgaaggtttcgttgaagttcttgctgctcagcaaagtccagagaaccctaattggttccagggtactgctgatgctgtgaggcagtatctatggctgtttgaggaacacaatgttcttgaattcctagttcttgctggagatcatttgtaccgaatggattatgaaagattcattcaagcccacagagaaacagatgctgatattactgttgctgctctgccaatggatgagaagcgtgccactgcatttggtctcatgaagattgatgaagaagggcggattattgaatttgcagagaaaccaaaaggagaacagttgaaagctatgaaggttgatactactattttcggtcttgatgatcagagagctaaagagttgccttttattgcaagtatgggcatatatgtcattagcaaaaatgtgatgttaaacctacttcgagaaaagttccctggagccaatgactttggaagtgaagtcattcctggtgcaacatccattggaatgagagttcaagcttatttgtttgacggctactgggaagatattggtacaattgaggccttctataatgccaacttggggatcacaaaaaagccagtgccagatttcagtttgtatgaccgatcagctccaatctacactcagcctcgatatttacctccttctaaaatgcttgatgctgatgtcacggacagtgttattggcgaaggttgtgtgatcaagaactgtaaaattcaccattctgtggttggggttagatcatgtatatcagaaggtgcaattattgaagattcactactgatgggagctgattactatgagactgatgctgacaggaggcttctggcagcaaagggcagcatcccaattggcattggcaggaactcccacattaaaagagcaatcattgacaagaatgcccgtataggggacaatgtgaagatcattaatagtgatgatgttcaagaagctgctagggaaactgatggatatttcatcaagagtggaatcgtcactgtgatcaaggatgcattgatccccagcgggactgtaatataaagatgtaacaagagttcaggcacatatcctcaaaactgcttagcagaagaaggagctgcagtggtagttgtttattttgccatagaaaatctaacattttttgctggtaatgttatgttttcccataagagaaactgatgcatattatcctttaaagtttaaataccatcttagttaccaataaatgatgattatacaagtgtaaaaaaaaa

SEQ ID NO: 14511 - protein, 523 aa, Ipomoea batatas (sweet potato)
MAAAIGAPKLAPYTCTAERNDGSARRAARFKSLSFASSNLSGDKLGSLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTIFGLDDQRAKELPFIASMGIYVISKNVMLNLLREKFPGANDFGSEVIPGATSIGMRVQAYLFDGYWEDIGTIEAFYNANLGITKKPVPDFSLYDRSAPIYTQPRYLPPSKMLDADVTDSVIGEGCVIKNCKIHHSVVGVRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 14512 - DNA, 1122 bp, Caenorhabditis elegans
  CDS (1)..(1122)
atggttgtttcaccacttccatcaatgaaggcgctgattctagtcggaggatacggaacacggttgaggccgcttacactaacccagccaaaacctctggtcgaatttgccaacaagccgatgatgttgcatcagatggaagcgttggctgaagtaggagtcgatacagttgttctcgctgtcagttacagagcagaacagttggagcaagaaatgacagttcatgcagatagacttggagtcaaactgatattctctttagaagaggaacctctgggaactgctggcccactggctcttgctcgaaaacatttggaaggcgatgcaccgtttttcgttttgaacagcgacgtaatttgtgattttcccttcaaacaaatggttgaattccacaagaatcacggaaaagaaggaacaattgccgttacaaaagtagaagaaccatcgaaatatggagtagtagttttcgatcaagataaaggaaaaattgatgattttgtggagaaaccacaggaatacgttggtaacaagatcaatgcaggtctctacatttttagctccaaaattctcgaccgcatcccactgaaacctactagtatcgagaaggaaattttccccgaaatggcattctctggaaatttgtacgcttttgtacttcctggcttttggatggatgtaggtcaaccgaaagattttctcaaaggaatgtcccttttcctaaatcattgtcatactacaaaatccgataaactcgaaacaggatcaaacatacatccaacagctactattcgtggaaatgtgatggttgacccatcggctactgttggagaaaattgtgtgattgggccagatgtcgttattggtccacgtgtgaagatcgaaggtggagttcgaatcctgcactcgacaattctttccgattcgtcaattggcaactattcatgggtttctggaagtatagttggtcgaaaatgtcacattggaagctgggttcgtatcgagaatatttgtgttattggagatgatgtggttgtaaaggatgaattatatctcaacggtgccagtgtcttgccacacaagtcgattgctgtgaatgttccgtcgaaagacattattatgtaa

SEQ ID NO: 14513 - protein, 373 aa, Caenorhabditis elegans
MVVSPLPSMKALILVGGYGTRLRPLTLTQPKPLVEFANKPMMLHQMEALAEVGVDTVVLAVSYRAEQLEQEMTVHADRLGVKLIFSLEEEPLGTAGPLALARKHLEGDAPFFVLNSDVICDFPFKQMVEFHKNHGKEGTIAVTKVEEPSKYGVVVFDQDKGKIDDFVEKPQEYVGNKINAGLYIFSSKILDRIPLKPTSIEKEIFPEMAFSGNLYAFVLPGFWMDVGQPKDFLKGMSLFLNHCHTTKSDKLETGSNIHPTATIRGNVMVDPSATVGENCVIGPDVVIGPRVKIEGGVRILHSTILSDSSIGNYSWVSGSIVGRKCHIGSWVRIENICVIGDDVVVKDELYLNGASVLPHKSIAVNVPSKDIIM

SEQ ID NO: 14514 - DNA, 1092 bp, Schizosaccharomyces pombe
  CDS (1)..(1092)
atgaaggctctgattctcgtgggtggctttggtactcgtcttcgtcctttgactttaactttgcccaagcctcttgttgaatttggtaacaagccgatgatccttcaccaagtcgaagctttggcagctgctggtgtcacggatatcgtcttggctgttaattaccgtcccgaaatcatggtagaagctttgaaaaaatacgaaaaggagtataacgttaatattactttctccgttgagaatgagcctttgggaaccgctggacctttggctcttgctcgtgacattcttgctaaagaccactctcctttcttcgtcttgaatagtgatgttatttgtgagtatcctttcgcggatttggcagctttccataaggctcatggtgccgagggtactatcgttgttaccaaggttgaggagccttctaagtatggtgttgtcgttcattatcccaactcagaatccttgattgagcgctttgttgaaaagcctgttgagtttgtatccaacagaattaatggtggtatttacattctaaacccttccgttcttgaccgtattgaacctcgtcctacctcgattgaaaaggaagtctttcccgccatggtcaatgacaagcaattacactctttcgaccttgagggttattggatggatgttggtcaacccaaggattatcttaccggtacttgtttgtatttatcctccttgcgtaagcataagcctgaaatcttggccccagctagtagcaatatcatcggtaatgtgttgattgatccctcagcaaccattggcaaaaattgtaaaattggtcccaatgttgtgattggtcccaacgtaacgattggtgatggtgttcgtctccaacgttgtgccattcttaagtcttctcgcgttcgcgaccatgcctgggttaaatcgagtattgtaggatggaactctacccttggatcttggagtcgtttggaaaacgtgtccgtcttaggcgacgatgtcgttgtcaatgacgagatttacgtaaatggtggcagtattttaccccataagagcattagtgctaacattgaggttcctggtactattgtcatgtaa

SEQ ID NO: 14515 - protein, 363 aa, Schizosaccharomyces pombe
MKALILVGGFGTRLRPLTLTLPKPLVEFGNKPMILHQVEALAAAGVTDIVLAVNYRPEIMVEALKKYEKEYNVNITFSVENEPLGTAGPLALARDILAKDHSPFFVLNSDVICEYPFADLAAFHKAHGAEGTIVVTKVEEPSKYGVVVHYPNSESLIERFVEKPVEFVSNRINGGIYILNPSVLDRIEPRPTSIEKEVFPAMVNDKQLHSFDLEGYWMDVGQPKDYLTGTCLYLSSLRKHKPEILAPASSNIIGNVLIDPSATIGKNCKIGPNVVIGPNVTIGDGVRLQRCAILKSSRVRDHAWVKSSIVGWNSTLGSWSRLENVSVLGDDVVVNDEIYVNGGSILPHKSISANIEVPGTIVM

SEQ ID NO: 14516 - DNA, 1518 bp, Streptomyces coelicolor
  CDS (144)..(1337)
gcggtggaggagttcggctgggacgggtcgcgcgccgcacggtccggctgtacgaggagatcctcaagcaggcttaggccccgccggggcagccggggtgaacgagggtgaggggagcggccatgcgtcgtggaggtccttcgatgctcggcatcgtgctggcgggcggagagggcaaacgcctgatgcccctgaccgcggcacgcgccaaacccgcggtcaccttcggcggcacctaccggctcgtcgacttcgtcctgtccaacctggtcaacggcgacatcctgcggatctgcgtcctcacccagtacaagtcgcactccctggaccggcacatcaccaccacctggcggatgtccagcctgctcggcaactacgtcactccggtccccgcccagcagcgcctcggcccccgctggttcctcggcagcgccgacgccatcctgcagtccctgaacctggtgcacgacgaacagcccgagtacgtggcggtgttcggcgccgaccacgtgtaccggatggacccgcgccagatgctcgcccagcacatcgagtccggcgcgggcgtcaccgtcgccgggatacgggtcccgcgcgccgagtcgccgtccttggtgatcacgccgggctcggacgggcagaccgtcaccggcttcctggagaagccgccgaaccctcccggcctgggccacgaccccgggtgcgtcttcccgtcgatgggcaactacgtcttcaccaccaaggccctcgtcgaagccctgcaccgggacgccgaggacccggactccgtgcacgacatgggcggttcgatcctgccccagctcaccgaccggggcgaggccgcgctgtacgacttcagcgccaaccacgtccccggggagaccacccgcgaccaggggtactggcgggacgtgggcacgctggacgcctactacgacgcctacatggacctgatcgccgagcggcccgcgttcaacctctacaaccgggactggccggtctacacccactccacccagctctcgccggcccgcttcaacgccgggggcatcgccagcgagtcgatcatcagcgccggctgcctgatccgcggacaggtcacccggtccgtgctctccccgggggtggtggtcgaccccggcgcggtcgtgcagggctcggtgctacacaacgtgcacatcggccggggtgcggtggtgcgcggggcggtgctggacaagaacgtgcaggtgccgccgggcgcgacgatcggcgtcaacccgcagcgggacggcgagttgtacaccgtctccaagggcggcgtgatcgcgctgggcaagggacagcgggtgccgtgaggcacggacgaccgcgcggacggcggccccgggagcgtgcgacacccgtgatacgcgcgttgagcccggggccgttgtcatgtccctggacgccaagcggaatccgtgttgtcatgcctctgcaccgctgccgttacatcgatgtatgagatcgatgtcctgagccatcagccaccacccg

SEQ ID NO: 14517 - protein, 397 aa, Streptomyces coelicolor
MLGIVLAGGEGKRLMPLTAARAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSLVITPGSDGQTVTGFLEKPPNPPGLGHDPGCVFPSMGNYVFTTKALVEALHRDAEDPDSVHDMGGSILPQLTDRGEAALYDFSANHVPGETTRDQGYWRDVGTLDAYYDAYMDLIAERPAFNLYNRDWPVYTHSTQLSPARFNAGGIASESIISAGCLIRGQVTRSVLSPGVVVDPGAVVQGSVLHNVHIGRGAVVRGAVLDKNVQVPPGATIGVNPQRDGELYTVSKGGVIALGKGQRVP

SEQ ID NO: 14518 - DNA, 1260 bp, Mycobacterium leprae
  CDS (1)..(1260)
atgcccccctggcagcggtgggcagcggccgataggtttggagccatgagggaagtgccacaagtgctgggcattgttttggccggtggtgagggcaaacggttatatccgctgaccgcagaccgggccaaacccgctgttcccttcgggggcgcctatcggttggttgatttcgtactttctaatctagtcaacgcccgttacctgaggatttgtgttctcacacaatacaagtcgcattccctagaccgccacatttcgcagaattggcgattgtcgggccttgccggtgagtacattaccccggtgccagcacagcagcggttcggcccacactggtacactggctcggcggacgcgatctatcaatcactcaacctcatttatgacgaagaccctgactatctagtggttttcggagctgaccacgtgtaccggatggaccccgagcagatgctccggttccacatcggcagcggggccggtgccacggtggctggcattcgcgttccgcgcagcgacgctacagcgtttggttgcattgacgctgacgactccggccgtattcgccgtttcactgagaagccgctcaaaccgcccgggacaccggacgatcccgataagacgtttgtttcgatgggcaactacatcttcaccaccaaggtgctcgtcgacgcgattcgcgctgacgccgatgacgatcactcgtatcacgacatgggcggcgacatccttccgcggctggtggacggcgggatggccgcggtgtatgacttttcccaaaacgaagtgcctggcgctaccgactgggaccgcgcttattggcgcgacgttggtacgctggacgctttttatgacgcccacatggatctggtgtcgttgcgtccggtgtttaatctttacaacaagcgttggccgattcgtggcgaatcggaaaatctggcgccggcgaagtttgtcaacggtggttccgttcaggaatcggtggtgggtgcagggagtatcatttcggcggcttcggtacgtaattcggtgctgtcgtcgaatgtcgtggtcgacaacggcgcgatcgtggagggcagtgtcatcatgccgggtgctcgggttggccgcggcgcagtgatacgccacgcgatcttggataagaacgtcgtcgtcgggcctggcgagatggttggcgtggatcccgagagagatcgggaacactttgcgattagtgctggcggagtagtcgtggtcggcaagggtgtgtggatttag

SEQ ID NO: 14519 - protein, 419 aa, Mycobacterium leprae
MPPWQRWAAADRFGAMREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 14520 - DNA, 1095 bp, Arabidopsis thaliana (mouse-ear cress)
  CDS (1)..(1095)
atgaaagctcttattcttgttggaggttttggcactcgcttgagaccattgactctcagtctcccaaagccgcttgtcgatttcgctaataaacctatgattctacatcagatagaggcactaaaggcaattggagtggatgaagtcgtcttggccattaactacgagccagagcaactgctagtgatgtccaaattctcaaacgacgttgaggcaactctcgggatcaagatcacctgctcacaagagactgagcctttaggtacagctggtcctttggctttagccagggacaaactggttgatggctctggccaaccattctttgtccttaacagcgatgttattagcgactacccgcttgaagagatgattgcttttcacaatgctcatggaggagaggcctctataatggtgacaaaggtagatgagccttcgaaatatggagttgttgttatggaagaagccacagggagagtggaaagattcgtcgaaaaaccgaaactatttgttggtaacaagatcaatgctgggatttatcttctaaatccttcagttcttgatcggattgagctaagaccaacatcaatagagaaagagatcttccctcaaatcgcagaagcggaaaagctctatgcaatgctacttcccggattctggatggacattggtcaaccacgagactacattactggtctaagactttacttagactctctgaggaagaaatctccttcaaagttagccactggtccacacattttgggaaatgttcttgtggatgaaaccgcagagattggtgaaggatgtttgattggccctaacgttgctataggccctggctgtgttgttgagtccggggttagactatcgcactgcacggtaatgcgtggggtacacgtgaagagatatgcgtgtatctcgagtagtatcattgggtggcactcgacggtcggacaatgggctcgggtcgagaacatgtccatacttgggaaaaatgtttacgtgtgcgatgagatatattgtaatggaggggttgtgttgcataacaaagagatcaaatcagacatcttgaaaccagatatagtgatgtga

SEQ ID NO: 14521 - protein, 364 aa, Arabidopsis thaliana (mouse-ear cress)
MKALILVGGFGTRLRPLTLSLPKPLVDFANKPMILHQIEALKAIGVDEVVLAINYEPEQLLVMSKFSNDVEATLGIKITCSQETEPLGTAGPLALARDKLVDGSGQPFFVLNSDVISDYPLEEMIAFHNAHGGEASIMVTKVDEPSKYGVVVMEEATGRVERFVEKPKLFVGNKINAGIYLLNPSVLDRIELRPTSIEKEIFPQIAEAEKLYAMLLPGFWMDIGQPRDYITGLRLYLDSLRKKSPSKLATGPHILGNVLVDETAEIGEGCLIGPNVAIGPGCVVESGVRLSHCTVMRGVHVKRYACISSSIIGWHSTVGQWARVENMSILGKNVYVCDEIYCNGGVVLHNKEIKSDILKPDIVM

SEQ ID NO: 14522 - DNA, 1731 bp, Arabidopsis thaliana (mouse-ear cress)
  CDS (56)..(1624)
ctcttttatcttcccctctcttcaaacccttcaagagacaatctttcctgcgaaaatggtggtctctgctgactgcagaatctccctctctgcccctagctgcatacgtagtagctccacgggattgactaggcacattaagcttggcagcttctgcaatggtgagctcatggggaagaagctcaacttgtctcagcttccaaacattcgtcttcgatcttctactaacttctctcagaagagaattttaatgtctctaaatagtgtagctggggagagtaaggtacaagaacttgagactgagaaaagggatccaaggacagttgcttccattattcttggaggtggagcaggaactcgactctttcctctcacaaaacgccgcgccaagcctgccgttcctatcgggggagcctataggttgatagatgtaccaatgagcaattgtattaacagcggaatcaacaaagtctacatactcacacaatataactcagcatcattgaacaggcatttagcccgtgcttacaactccaatggacttggctttggagatggctatgttgaggttcttgcggccactcaaacgccaggagaatctggtaaaaggtggttccaaggtacagcagatgcggttcggcaattccattggcttttcgaggatgcaagaagcaaggacatagaggatgtattgatcctttctggagatcacctctacaggatggattacatggattttatacaggatcatcggcagagtggcgcggatataagcatttcctgcataccaatagatgacagacgtgcctcagattttgggcttatgaagatagatgacaaaggaagagttatctcattcagtgaaaaacctaaaggagacgacctgaaagcaatggcagtagacacaactattttaggactttccaaggaggaagctgaaaagaaaccatacatagcttcaatgggagtttatgttttcaaaaaagaaatactgttaaatctcttgagatggcgtttccccacagcaaacgactttggttcagagattatacccttctcagctaaagaattctatgtgaatgcttatctctttaatgactactgggaagatataggaacaataagatctttcttcgaggcgaatcttgcactcactgagcatcctggggcatttagtttctacgacgcggcaaaaccaatatatacatcaaggagaaacctgccaccatcaaaaatagacaactctaagctcatcgattcaatcatttctcatggaagcttcttaaccaactgcttgattgagcatagcattgtgggaattagatcaagagtaggcagtaatgttcagttgaaggacactgtgatgcttggggcagattactacgaaactgaagcagaagttgcagcactacttgctgagggaaacgttcccattggaataggagagaacacaaaaattcaagaatgcataatagacaagaatgctagagttggaaagaatgtaatcatcgcaaactcggagggaatacaagaagcagataggtcatccgatggattttacatcagatctggcattactgtaatcttgaagaactcagtaattaaagatggagttgtgatatgatacttttaagatctaattgtaagaactgagaactaaaaaatgcagagcataaaagtcaacaataaattacaaagaaatttatttgatagtgatgacacttcacatat

SEQ ID NO: 14523 - protein, 522 aa, Arabidopsis thaliana (mouse-ear cress)
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRQFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 14524 - DNA, 2450 bp, Physcomitrella patens
  CDS (736)..(2058): n means a or g or c or t/u
gcgcgccaggacaggcagaggacgagacaagggggaccgaggtccagagatcagctcgcaggacctcgaaactgagctctagtagcgtagaattagcgcaagggtggtgtaggtgaacagagcgacgagaccattctcgtcatcgtagttataagacgcatacgagattccgcagtgtcgagagtcgggtaccgagcccgcgcgagagtgaggatttgctacaggccttccttttatttgtcgacattattgtccgagtaggttgtggctgaagttgcggtggaacaggttgtgtgtagaactcgaagcagtcaagtttgcctgtcgaatttctcaaacttactacagttcttctcaaacaagaagtttgttagccgcgatggcagcaacagggactttcgcctccacccgttacaccgcactggcgaggccagctcgctgcgaagcagtcggctacgatgccaccatgcggtcgggctttaagggggacctcaagcctgcatcttctgggttcttggctggtggcggtcgtctggctctcgtcaccagcgttggtcccaaacgcacagttgccagagccaagaccatcggccttgaagtctccgctgtgttggccgaacgcccaatgggggctctgaccagacaagtaacacgggagatggagaaagaaatggagagggaaagggagaaggagaaatcgagggagagcatgagctcgaaggagcaggtgactacatgacgaaggtgttctcaatcatcctgggaggaggggcaggcactcgactccaacccctcactcttcgccgagcaaagccagcggttccacttgggggtggctatcgattgatcgatgtgcccatgagcaactgcattaacagcgggattaacaagatttatgttctcactcagttcaattctacgtcttcgatcaaccgccaccttgccaacacttacaatttcggcaacggttgcaacttcggtgatggttacgtggaggtcctggctgctgcccagaggcctggcttcggcggtgacaggtggttcgaaggtactgcggacgcagtgaggcagtacatgtggttgcacttggaagatgccaaaaacaaagacgtcgaagatgtggtgatcctgtccggggatcacctgtaccgcatggattaccgagatttcgtccagaaacacaaggattccggagctgatgtgactgtttcttgcatacccatggacgatagtcgtgcttctgattttggcttgatgaagatcgacggaaaggggcgaatcaaccacttttctgaaaagccgaaaggaaaggacctgcagtcgatgcaagtggacaccactgtactcggcctgtccgcggaggaggctcaaaagaagccatacatcgcttccatgggcatttacgtcttcaagaagagcgtgctcgccaagctgctcaggtggaggtatcccctcgccaacgactttggctccgagatcatccctaaggctgccaaggagttcaatgtgaacgcctacctctttaacgattactgggaagacattggaaccatcaaatccttcttcgacgcgaacttggcgctccgcagccagagaatccccaacttcagtttctacgacgctgaaaagcccatttacacatccgcccgctacttgcccccaaccaagattgagaagtgtagagtgaaggattcaattgtctcccacggatgcttcttgcgggaatgcagtgtagaggattccgtcattggaatccgatcccggctcgaggctgggtgcgatgtcaagcgcgccatggtgatgggagctgactcctatgaaaccgatcccgaagcggctgctttgttggcggaaggaaaggtacctttgggcgtcggcgagaactcaaagctgaggaattgtattgtggacaagaatgcaagaattggcaaggatgttgtcattgcgaacactgacaatgtcttggaagcggagagacaaagtgaaggtttttacatccgttccggaattgtagtagtatacaagaacgcggttatcaagcacggaactgtaatctaaattacgaatctttctccatatcgtgaaaactgcttccttgcaacgccggtccctggtgagctgatccttggacctcatcatcgacggtgaaaaagatatcagtacttatccgagttgtgagattctcagctcgtgattactgatcctcttcctcttgccaccctgaagattgccgcgcaggatctggtttgtgtcggtatatcagatcagtagttcttacataagactgaattgaaatgtacaaagagatcagatcatcgggagtggaaccgttcagaggaagaaacctaccgnatagtcaagtggacgaagattatggtatcaattttggagtgtaaagtgtgagcgacttctactgtccttgtatcataccccattgaagtaaagaattg

SEQ ID NO: 14525 - protein, 440 aa, Physcomitrella patens
MTKVFSIILGGGAGTRLQPLTLRRAKPAVPLGGGYRLIDVPMSNCINSGINKIYVLTQFNSTSSINRHLANTYNFGNGCNFGDGYVEVLAAAQRPGFGGDRWFEGTADAVRQYMWLHLEDAKNKDVEDVVILSGDHLYRMDYRDFVQKHKDSGADVTVSCIPMDDSRASDFGLMKIDGKGRINHFSEKPKGKDLQSMQVDTTVLGLSAEEAQKKPYIASMGIYVFKKSVLAKLLRWRYPLANDFGSEIIPKAAKEFNVNAYLFNDYWEDIGTIKSFFDANLALRSQRIPNFSFYDAEKPIYTSARYLPPTKIEKCRVKDSIVSHGCFLRECSVEDSVIGIRSRLEAGCDVKRAMVMGADSYETDPEAAALLAEGKVPLGVGENSKLRNCIVDKNARIGKDVVIANTDNVLEAERQSEGFYIRSGIVVVYKNAVIKHGTVI

SEQ ID NO: 14526 - DNA, 1582 bp, Zea mays
  CDS (10)..(1566)
ggaggagatatgcagtttgcacttgcattggacacgaactcaggtcctcaccagataagatcttgtgagggtgatgggattgacaggttggaaaaattaagtattgggggcagaaagcaggagaaagctttgagaaataggtgctttggtggtagagttgctgcaactacacaatgtattcttacctcagatgcttgtcctgaaactcttcattctcaaacacagtcctctaggaaaaattatgctgatgcaaaccgtgtatctgckatcattttgggcggaggcactggatctcagctctttcctctgacaagcacaagagctacgcctgctgtacctgttggaggatgttacaggcttattgatatccctatgagtaactgcttcaacagtggtataaataagatatttgtgatgagtcagttcaattctacttcgcttaaccgccatattcatcgtacataccttgaaggcgggatcaactttgctgatggatctgtacaggtattagcggctacacaaatgcctgaagagccagctggatggttccagggtacagcagactctatcagaaaatttatctgggtactcgaggattattacagtcacaaatccattgacaacattgtaatcttgagtggcgatcagctttatcggatgaattacatggaacttgtgcagaaacatgtcgaggacgatgctgatatcactatatcatgtgctcctgttgatgagagccgagcttctaaaaatgggctagtgaagattgatcatactggacgtgtacttcaattctttgaaaaaccaaagggtgctgatttgaattctatgagagttgagaccaacttcctgagctatgctatagatgatgcacagaaatatccataccttgcatcaatgggcatttatgtcttcaagaaagatgcacttttagaccttctcaagtcaaaatatactcaattacatgactttggatctgaaatcctcccaagagctgtactagattayagtgtgcaggcatgcatttttacgggctattgggaggatgttggaacaatcaaatcattctttgatgcaaacttggccctcactgagcagccttccaagtttgatttttacgatccaaaaacacctttcttcactgcaccccgatgcttgcctccgacgcaattggacaagtgcaagatgaaatatgcatttatctcagatggttgcttactgagagaatgcaacatcgagcattctgtgattggagtctgctcacgtgtcagctctggatgtgaactcaaggactccgtgatgatgggagcggacatctatgaaactgaagaagaagcttcaaagctactgttagctgggaaggtcccrgttggaataggaaggaacacaaagataaggaactgtatcattgacatgaatgctaggattgggaagaacgtggtgatcacaaacagtaagggcatccaagaggctgatcacccggaagaagggtactcgtactacataaggtctggaatcgtggtgatcctgaagaatgcaaccatcaacgatgggtctgtcatatagatcggctgcgtktgcg

SEQ ID NO: 14527 - protein, 518 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDYSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPVGIGRNTKIRNCIIDMNARIGKNVVITNSKGIQEADHPEEGYSYYIRSGIVVILKNATINDGSVI

SEQ ID NO: 14528 - DNA, 2027 bp, Cucumis melo
  CDS (99)..(1676)
cacgagctgatctctgcttctttttcattttttccggcgacttgctaatcggagaagattaccggatatcgttgttttggatttgaattgatcgtctaatggcgtcttctatggctgcagttggagttctcagactcccgacgtcgtcgtcgtcgtcgtcttcatcgtccaatggtggaaccaaccgtgctaggagaactagccttcgaagcctctcattcggtgcgtctcaaatttctggtgataagattgactttagaggttttggtttgggatcacgacgtgtttctggtggtagagtggctccctcgatcgtttctcctaaagcggtttctgattccaagaactctcagacttgcctcgatcccgatgctagccggagtgtgcttgggattattctgggcggtggtgctggaactcggctctatccgcttactaagaaacgagcgaaggctgctgttcctcttggagcgaactatagaaagattgatattcctgttagcaactgtctcaacagcaatatttcaaagatttatgttctcacgcaattcaattctgcttctcttaatcgtcatctttcccgagcttatgcagtaatatggtggttacagaatgaaggatttgttgaggttctagccgctcagcagagtccagagaatccaaattggttccagggcacagctgatgcagttagacagtacttgtggttatttgaagagcagaatgtgttggagtatcttgttcttgctggcgatcatttgtatcgaatggattacgagagatttattcaagcacacagggagactgatgcagatatcactgtagctgctctaccaatggatgaaaagcgtgcaactgcatttggtttgatgaagattgatgaagagggacgcataattgagtttgcagagaaaccgaaaggagagcaattgaaagcgatgaaggttgatactactattttgggtcttgacgatgagagagcgaaagagatgccgtacatagctagcatgggtatatacgttatcagcaaggatgtgatgctcaatcttcttagagataaatttcccggagcaaatgattttgggagtgaagttattcctggtgcaacttccattggaatgagggtgcaagcttacttgtatgatggttactgggaagatattggtaccattgaagctttttacaatgcaaatctggggatcacaaagaagccagtaccagattttaccttctatgatcgttcgtctccgatctacacccaacctcgttatttgccgccatcaaaaatgcttgatgccgatatcacggacagtgttattggtgagggatgtgtcattaagaactgcaagattcaccactctgtcgtgggcattcgaacttgcatatccgaaggtgcaatcatagaagatacgttactgatgggtgcagattattatgagacggatgccgaccgtaggttattggcggcaaagggtagtgtaccaattggaattggtagaaactctcacatcaagagagctatcattgacaaaaatgctcgcatcggtgaaaatgttaagatagtgaatggagacaacgtgcaagaagcagcaagagagacagatggttacttcataaagagtgggattgtgacagttatcaaggatgctttgattcccagcggcactatcatctaaaccaccagaacacatcacacttcactcaactggtgccactctctctctctctctctctctctctctctctctctctctctcaattttgtgtctgccttggttcaatcccacccattatgtccacatgcattcccttttggtagtaaatggcaaaggcttaggaagagaatccctcactccgagagtccacactatacccactgttacttttaacttatgatgatgattatgtaaatgtctccccccctccccccccctcccctcccctcctctgctttgaatagtttcatttccttttcttttaacccataaataaattcaatttcctggggcaaaagtggtattatgaat

SEQ ID NO: 14529 - protein, 525 aa, Cucumis melo
MASSMAAVGVLRLPTSSSSSSSSSNGGTNRARRTSLRSLSFGASQISGDKIDFRGFGLGSRRVSGGRVAPSIVSPKAVSDSKNSQTCLDPDASRSVLGIILGGGAGTRLYPLTKKRAKAAVPLGANYRKIDIPVSNCLNSNISKIYVLTQFNSASLNRHLSRAYAVIWWLQNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPVPDFTFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGENVKIVNGDNVQEAARETDGYFIKSGIVTVIKDALIPSGTII

SEQ ID NO: 14530 - DNA, 2161 bp, Ipomoea batatas
  CDS (251)..(1804)
ggatccgggtaccatgggttgctagaagggaagtttcgttttcctttcttaagcgcaagagctcaagggtgcacagcaattgccacctttttttgccctgtgagggtggtcactacttttttcttggattctcacttctgggtactaggaattttcacttgtttggggaccgctgtgtttatgatcttggcgctttagctttgcagatcccattcgtgaacttctagtggggactagggagtgatctgtgatggaattttgtgcaactttgaaatcttctgctcacttgccaagagagactgagttttttggggggaggatcagaggcagtctaaacaacaatgtcttactcagtcagtccaggaaaagtttgagacttgatggaaataagaggaagatcaagcctggggttgctttttctgttctcacaagagaaaatggaacagagactttgactgtagaagcaccgatattggagaggcgtcgggcaaaccctaagaatgtggctgcaatcatactgccaggcggtgcagggacacacctattccctctcaccaatcgagctgcaacccctgctgttccacttggaggatgctataggttgatcgacattccaatgagcaactgcatcaacagcggggttaacaagatctttgtgctgacccagttcaattcagcttctcttaaccgtcacatttcccgtaccgtctttggcaatggtgtgagcttcggagatggatttgttgaggtgctggctgcaacccaaacacaaggggaaacggggatgaagtggtttcagggaactgcagatgctgttagacagtttagctgggtttttgaggacgcgaagaacaaggacattgataatatagttattctgtcaggagatcaactttatcgcatggattacatggacttagtgcagaatcacatcgaacgcaattctgatattactctttcatgtgccacagttggggatagccgagcatcagactttgggctggtgaaaattgaccgtagaggccgagttgtccagttttgcgagaaacctaaaggcactgaacataaagcaatgcaagtagatactactctcttgggattgccacggcaagatgcgagattaaatccttatattgcttgcatgggggtttatgtgtttaagacagatgtccttttgcggctcctgaggtggagatatcccacatccaacgactttggatccgagattcttcctgctgctgtgatggagcacaatgttcaagcttacattttcagagactactgggaggacatcgggacaataaaatctttctacgacgctaacttggccctaactgaagagttcccgaagtttgagttctatgatccaaagacacctttctacacatcccccagattcctcccgccaaccaaaatcgataactgcaagatcaaggatgcaataatctcccacgggtgtttcttacgagagtgcactgtggaacactccatcattggtgaaaggtcacggctagattgtggtgttgaactgaaggatactttaatgatgggagcagatacctatgaaacagaatctgaaattgcctcgcttctggcagatggaaaagtcccgattggggttggagaaaacacaaaaattaggaatgctatcatcgacaagaatgtaaggattgggaaacacgttgtcatcacgaataaagatggtgttcaagaatcagaccgccccgatgaaggcttctacatcagatcagggattactattataatggagaaagcaaccattcgtgatggaaccgtcgtatagtatcagcggagcaggcaccggtgggatcacaggagaacgattcatgggacgttatgtttcagtctaggatgatcgcgttttgaagaaacaaaagtggcagccaagatgttttgttgaagtttacctggacttgtgaaaagaggaagcagagggcagttgaagcagagggaatatgaataaaactgaggaatgctaccatatctggtgcattcttgctattgtacaatatcatatcatatcatatgtaagatatagtataatttcgatgataataatgtaaggttggccatttggctatggtaaggttggccatttggctatggtggtaaaaagttcttgatgcccaaaagaaaaaaa

SEQ ID NO: 14531 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILPGGAGTHLFPLTNRAATPAVPLGGCYRLIDIPMSNCINSGVNKIFVLTQFNSASLNRHISRTVFGNGVSFGDGFVEVLAATQTQGETGMKWFQGTADAVRQFSWVFEDAKNKDIDNIVILSGDQLYRMDYMDLVQNHIERNSDITLSCATVGDSRASDFGLVKIDRRGRVVQFCEKPKGTEHKAMQVDTTLLGLPRQDARLNPYIACMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKHVVITNKDGVQESDRPDEGFYIRSGITIIMEKATIRDGTVV

SEQ ID NO: 14532 - DNA, 2105 bp, Lycopersicon esculentum
  CDS (154)..(1710)
ctttacaacaacacagaaatctcaagagagtccacaggctttacaacgccactgtgttgtgttatgaacgcactgtaacctagtaataattttgtttataccaaatactttttgaggaaaagttgggtgtttgaaaaagcttaattcagagcaatggatgcgttgtgtgcgggcactgcacaatcagtggcaatttgcaaccaagagagcacattttggggacagaagattagtggaagaagattgataaacaagggttttggggtccggtggtgcaagagctttacaactcaacaaaggggtaggggtgttacctctgctgttctcacccgtgatataaacaaagagatgctgccatttgaaaattcaatgtttgaggaacaaccaacggcagatccaaaagctgttgcctctgtcattctaggtggtggtgttggaactcgtctttttcctcttacaagcagaagagctaaaccagctgttcctattggtggttgttaccggctaattgatgtaccaatgagtaactgcattaacagtggcatacggaaaattttcatcttaacacagttcaattccttttccctcaatcgtcaccttgcccgcacgtataattttggaaatggagtgggttttggagatggatttgtggaggttttagctgcaacccagactccaggggatgcaggaaaaatgtggttccaaggcactgctgatgctgtgcggcaattcatatgggtatttgagaatcagaagaacaagaatgtcgagcacataataattttgtctggtgaccatctttaccgaatgaactacatggactttgttcagaagcatattgacgcaaatgctgatattacagtttcatgtgttccaatggacgatggtcgagcttcagattttggattgatgaaaatagatgaaacaggacgtatcatccaatttgctgaaaaaccaaaaggccctgctttgaaggtaatgcaagttgacacatctatcctcggactatctgagcaagaggcgtccaattttccttacattgcatccatgggtgtttatgtattcaaaactgatgttttactaaaacttctcaagtcagcgtacccttcatgcaatgattttggctctgaaattatcccttctgctgtgaaagatcacaatgtccaggcatatttgtttaatgattactgggaggatattggaacagtgaagtctttctttgatgccaacttggccctcacaaagcagcctccaaagtttgacttcaatgacccgaagaccccgttctatacttctgctaggttcttacctcctacaaaagttgacaaaagcaggatagtggatgcaataatttcacatggcggctttctgagggaatgtaacattcagcactccatagttggtgtacgatcacgcttagactatggtgttgagtttaaggataccatgatgatgggtgcagattattatcaaactgaatccgagattgcttcactattagcagaaggaaaggttccaataggggtcgggccaaacactaagatacagaaatgcataattgacaagaacgcaaagataggaaaagatgtggttattctgaacaagcaaggtgttgaagaagctgataggtcagcagaaggattttacattaggtccgggattaccgtcataatgaagaatgcaaccattaaagatgggacagtcatatgaaaatcttgctaagtgttcttgctagttgggaaataaagtaggctggtatggtctagtgatatgaaaactagtgatatgatgaatgtgctactagggcttttctgacattgtttactttctacctatgacatattcactttcttggacttgatgaaacacatttccaagtgaacctcagtcctccatcttttaagtgttcagctgccagcagcttagtgagtgtctttgccgcctcgcttcagtttccaccatttacatagggggtttgacatggggtttgctggaaaattatattgtatatataggttagatattactttttgtacttggtatgttaattattggtatcgagattaataatgcattgactaataatgtcgggtttattttttatc

SEQ ID NO: 14533 - protein, 518 aa, Lycopersicon esculentum
MDALCAGTAQSVAICNQESTFWGQKISGRRLINKGFGVRWCKSFTTQQRGRGVTSAVLTRDINKEMLPFENSMFEEQPTADPKAVASVILGGGVGTRLFPLTSRRAKPAVPIGGCYRLIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFAEKPKGPALKVMQVDTSILGLSEQEASNFPYIASMGVYVFKTDVLLKLLKSAYPSCNDFGSEIIPSAVKDHNVQAYLFNDYWEDIGTVKSFFDANLALTKQPPKFDFNDPKTPFYTSARFLPPTKVDKSRIVDAIISHGGFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 14534 - DNA, 1814 bp, Pisum sativum
  CDS (82)..(1605)
cattcacacactctttgttctaaaccacacaagaacaaacatagtaacataaacacataaaaacaaacaacagtttcttcaatgtcttctattgttacttcaagtgttatcaacgttccacgttcttcttcttcatcaaagaacctctcattctcatcatcacaactctccggtgacaagattcttacagtttcaggtaagggtgcaccaagaggaagatgcacccgcaagcatgtgattgttactcctaaagctgtttctgattcacagaactctcaaacttgccttgatcctgatgctagcagaagtgtgcttggaattatacttggaggtggtgctggtactcgtctttatccactcaccaagaagagagcaaaacctgctgttcctcttggagctaactatagactcattgatattcctgttagcaattgcttgaatagcaacatttctaagatctatgttcttactcaattcaattccgcctcactcaatcgacatctttctcgcgcttatgcgagtaatttgggtggttacaaaaatgagggttttgttgaagttcttgctgctcagcaaagtcctgagaatcctaattggtttcagggtactgcagatgctgtgaggcaatatttatggctttttgaagagcataatgttttggagtacttaattctggcgggtgaccatttgtatcgaatggattatgagaaatttatccaagcacatagggaatctgatgctgatatcaccgtggctgcgttgccaatggatgaaaagcgtgcaactgctttcggtttgatgaagatcgatgaagaggggcgtataattgagtttgcagaaaagccgaaaggagaacagttgaaagctatgaaggttgatactacgattttaggtcttgacgatgaaagagcgaaagaaatgccttttattgctagcatgggtatatatgttatcagcaaaaatgtgatgctagaccttctccgcgacaagtttcccggtgcaaatgactttgggagtgaagtgattcctggtgctacttctgttggaatgagagtgcaagcttacttatatgatggctactgggaagacattggtaccattgaggctttctataatgcaaatcttggaatcaccaaaaagcctgtgcctgatttcagtttctatgatcgttcatctccgatttacacccaaccgcgatacttgcctccatctaagatgcttgatgctgatattactgatagtgttatcggagaaggatgtgtgattaagaactgcaagattttccactctgtggtcgggctgcgatcttgcatatcagaaggtgcaattattgaagacactttgttaatgggggcagattattacgagacagaagctgataaaaggtttttggctgctaaaggcagtgttccaattggtatcggcaaaaactcgcatatcaaaagagcaattgttgacaagaacgcgagaatcggagaaaacgtcaagataattaacagtgacaatgttcaagaagctgctagggaaacagaaggctatttcatcaaaagcgggatcgtcacaataatcaaggatgccttgattcctagtggaactgtcatatagaagactgaaactcatcttttgtttcataatggtgagtgagactttgaagttcatgttgcatgatatatttatttttcgataaaggcttgtaaataatagctgaagagagaaccttcttgtgttttggaaactagtactggtaaagtttgttgatcaattgaataaaagtcgttttattttccacctctaaaaaaaaaaaaaaaaaaaaa

SEQ ID NO: 14535 - protein, 507 aa, Pisum sativum
MSSIVTSSVINVPRSSSSSKNLSFSSSQLSGDKILTVSGKGAPRGRCTRKHVIVTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSVGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVI

SEQ ID NO: 14536 - DNA, 1035 bp, Bacillus thuringiensis serovar konkukian str
  CDS (1)..(1035)
atgggagaaaaaatgttagggattattaatgcaacgggaagttttccttccttaaagaaagtaacagggcatcgttcactagcggcgttaccgtttgggggccgttatcgactcattgatttcatgctttcaaatatggtgaattctaatattcatagtgtggcagtttttacaagccataaaaaccgttcactaatggatcacgttggttcaggcaaacagtgggatttagatagaaaacgagacggactgtttttattcccgccaaattgccaatgtgatcaagatgaatttggatcttttgcacattttagaagacatattgattattttctaagaagcagagaagagtacgtcgtgattacgaatagccatctcgtaacagcattaaattttcaagcagtgttagagcgacatatacatacggcagctgatattacggaagtttgccatgaaggggtttcgcttcaaacatacgtgttaaagaaacaattattgttagacttatttgaggcatataaagatatggagcaatatagcttattcgatgtagtgagagaaaagcgggggaaatcactgcatattgctacgtatgagcatacaggatatgtagctattattgattcgattgaaagctactataaacatagcttagaaattttgcaacctgctatttggaagcaagtatttaagaaagaagcaccaatctttacgaaagtaaaagatgaaccaccaactcgttatgtaaagggtgcagctgtgaaaaatacaatgattgcaaacggcagtattattgaaggtgaagtagaaaatagtgttgtctcccgttctgttaaaattgggaaaggttcaattgttcgtaatagcattattatgcaaaagagccaaattggagataactgtataatagacggtgttattattgataaagacgtgaaaattggtgacggtgttgtcttaaaaggaaacgccgatgagccatacgttgtagaaaaaggaagcgttcaaaacagtacgattaatagttattcttaa

SEQ ID NO: 14537 - protein, 344 aa, Bacillus thuringiensis serovar konkukian str
MGEKMLGIINATGSFPSLKKVTGHRSLAALPFGGRYRLIDFMLSNMVNSNIHSVAVFTSHKNRSLMDHVGSGKQWDLDRKRDGLFLFPPNCQCDQDEFGSFAHFRRHIDYFLRSREEYVVITNSHLVTALNFQAVLERHIHTAADITEVCHEGVSLQTYVLKKQLLLDLFEAYKDMEQYSLFDVVREKRGKSLHIATYEHTGYVAIIDSIESYYKHSLEILQPAIWKQVFKKEAPIFTKVKDEPPTRYVKGAAVKNTMIANGSIIEGEVENSVVSRSVKIGKGSIVRNSIIMQKSQIGDNCIIDGVIIDKDVKIGDGVVLKGNADEPYVVEKGSVQNSTINSYS

SEQ ID NO: 14538 - DNA, 1504 bp, Lycopersicon esculentum
  CDS (142)..(1227)
ctaaacacactcactcccctcccctccccttctgggcttctggtgtttgcttggctctctctctctctctgacttgagtccactcattcttcaattcagtctttggattttctcgatctacaggaatattggtatctcaagatgaaggcacttatccttgttggagggttcggtactcggctcaggccactcaccctcagcgtcccaaagccacttgtcgaatttgctaacaaaccaatgattttgcatcagatcgaggctctcaaggctgttggagtaaccgaagttgtactggctattaactaccaacctgaggtgatgctgaacttcttgaaagaatttgaggcaagccttggaatcaagatcacctgttctcaagaaactgaaccacttggcactgctggtcctcttgctttggctagagataagctgatagatgactctggtgaaccattttttgttcttaacagtgatgttatcagtgaatatccatttaaggagatggttcaattccacaaatcccatggtggtgaggcttctttgatggtgaccaaggtggatgagccttctaaatatggtgttgtcgtcatggaagaatccacagggcaagtagagagatttgtggagaagccaaagttatttgttggcaacaagatcaacgctggattttacctactgaacccttctgtcctagacagaattcaattacggccaacatctattgagaaagaggtttttccgaaaattgcagcagagaagaaactgtatgcaatggtgctacctggattttggatggacgttggccaaccaagagattacattactggcctcagactctatctggattctttaaagaaacactcttcacctaaattggcttcaggaccacacattgtcggaaatgtcatagtggatgaatctgctaagatcggagagggttgtttgataggaccagatgttgcaattggttctggttgtgtgattgagtctggagttagactctcccgttgcactgtgatgcgaggagtccgcatcaagaaacatgcatgcatctcaggtagcatcattggttggcactctactgttggacaatgggctcgtgttgagaacatgaccattctcggagaagatgttcatgtttgtgatgaaatttacagcaatggtggtgtagttttgccccacaaggagatcaaatccagcatattgaaacctgaaatcgtgatgtgagatatatttgttagcactaggaaaaatataagtttatgtattcagtttcttcatgatgtcacgtattcctgttttggttggtttccagttctcctcttcttcaagtgttaaaacgtcagtcctgagaatttgagtgatgtaaacttttcttggtgaaatttttgttatgttgtgaaaggtatgagatattgtaagactgggaaatgtgtaatttttgttatgtatagataaataacaatccctcttatttgttaaaaaaaaaaaaaaaaaaaaaaaa

SEQ ID NO: 14539 - protein, 361 aa, Lycopersicon esculentum
MKALILVGGFGTRLRPLTLSVPKPLVEFANKPMILHQIEALKAVGVTEVVLAINYQPEVMLNFLKEFEASLGIKITCSQETEPLGTAGPLALARDKLIDDSGEPFFVLNSDVISEYPFKEMVQFHKSHGGEASLMVTKVDEPSKYGVVVMEESTGQVERFVEKPKLFVGNKINAGFYLLNPSVLDRIQLRPTSIEKEVFPKIAAEKKLYAMVLPGFWMDVGQPRDYITGLRLYLDSLKKHSSPKLASGPHIVGNVIVDESAKIGEGCLIGPDVAIGSGCVIESGVRLSRCTVMRGVRIKKHACISGSIIGWHSTVGQWARVENMTILGEDVHVCDEIYSNGGVVLPHKEIKSSILKPEIVM

SEQ ID NO: 14540 - DNA, 1146 bp, Mycoplasma mobile 163K
  CDS (1)..(1146)
atggtaaaaaaggaaatgattgcaatgattcttgcgggtggtcaaggtacaagattaaaaaatcttacaaaaaaaatcgctaaaccagcagttccttttggagcaaaatatagaataattgattttacattgtcaaattgcattaatagcggaattgacacagtaggtgttttaactcaatatagacctctttcattattaaaacacataggttcgggaattccttttgacttaaatagactaaatggtggagttgttttgctaagtccatatgtaaaagaatccgaaggttattgatatgcaggaacagctcatgcgatttttgaaaatattgattttatgaatgaatatgatcctacttatgctttaattttgagtggagatcatatttataaaatggattattctaaaatgttagattttcataaagaaaaaaatgctaatgtaacaatagcaaccattaatgtatcttttgaagaagcttcaagattcggaattttaaatacaaacgaaaataatatggttgaagaatttgaagaaaaacctaagattcctaaatctacaaaagcttctatgggtgtttatatttttaattaccaactattaaaagatacttttgaagagttaaaaagtaaaggtaataattttcaagatttcggacataacatattaccttatatcttaaaaaaatatagtaaaatatttgcctatgaatttaatggttattgaaaagatgttggaacaatttctactttttatgaggctaatttagatctaataaaaaatcataaaaatttagacttaagagaaaaaaattgaactatttttacaaaaagttcatctcattcgcctcaatatataacaagtggtggtaatgtggtaaattctttagtagcaaacggagcaaaaatagaaggacatgtttcaaattcagtaatttttgaaaatgttaaaattggtaaaaatacaattattgaagattctgtaataatgtcaaatgcaataattggtgaaaattcttttattaaaaaaacaattattatggaaaatacagtagtaaaagaaaagatggttttaaattcattaaataatcaatcattgaatgaagaagatggaatcattttatatgatgggaaggaaaaataa

SEQ ID NO: 14541 - protein, 381 aa, Mycoplasma mobile 163K
MVKKEMIAMILAGGQGTRLKNLTKKIAKPAVPFGAKYRIIDFTLSNCINSGIDTVGVLTQYRPLSLLKHIGSGIPFDLNRLNGGVVLLSPYVKESEGYWYAGTAHAIFENIDFMNEYDPTYALILSGDHIYKMDYSKMLDFHKEKNANVTIATINVSFEEASRFGILNTNENNMVEEFEEKPKIPKSTKASMGVYIFNYQLLKDTFEELKSKGNNFQDFGHNILPYILKKYSKIFAYEFNGYWKDVGTISTFYEANLDLIKNHKNLDLREKNWTIFTKSSSHSPQYITSGGNVVNSLVANGAKIEGHVSNSVIFENVKIGKNTIIEDSVIMSNAIIGENSFIKKTIIMENTVVKEKMVLNSLNNQSLNEEDGIILYDGKEK

SEQ ID NO: 14542 - DNA, 1086 bp, Picrophilus torridus DSM 9790
  CDS (1)..(1086)
atgagtttaaaggctgttgttatggctggcggcaagggcacaaggctaagaccaataacatattcaataccaaagccacttgtgccaatagctggaaaaccatgtgttagctatttaatggattcattttatgatgcaggtataaaggatgcaatagtaacgactggctacaagtttgaatcactgataaacggtataatagaggcgaaaaaaccagatcagaacgtattattttcagttgagagggagccggccggcaccgcaggcagtgtaaagctcatatcaaattttattgatgacacaatagttgttggcagcggtgatatattatacgattttgatataaagagcataatagatttccataaaaaaaagaatgccagcgtcacaatagttcttacaagggtcgatgacccaagccagtttggaatcgttgacctaaaggatgatgtaataaccagattccttgaaaaaccggccgcaggtgaggcattttcaaatatagtaaatgctggaatatacgttatagaacctgaggtattaaaatacatagataaaatcccatttgattttgcaaaggagctctttccaagattgatgcgccatggaacgccaatctatgggtatcttggaaatggtacatggcttgatacaggaaggccaaatgatcttataaagggaaaccagatcatggttaacaaatacggttttaaatacgattcgaaaaacatcaccggtaaaaatataataaaaaccacatcagatctgtcagatgatattatagattcatcttatataggcacaaacctgcagataggcaaaaataccgttataaaaggttctgcaatatacaacggtgttgttttgggcaacaatgttcacatagaggattcaataataatggatgcaagcaggatcatggacaataccgtgataaaaaaatcggttataatgaggaactgcgtaataggagaggattctgaaatcattgaaagcgtcatatcaccggatcttgatctgcatggaaaatccagggtttataatgtttcacttgcatcaaagattataacagatgagcaagtataa

SEQ ID NO: 14543 - protein, 361 aa, Picrophilus torridus DSM 9790
MSLKAVVMAGGKGTRLRPITYSIPKPLVPIAGKPCVSYLMDSFYDAGIKDAIVTTGYKFESLINGIIEAKKPDQNVLFSVEREPAGTAGSVKLISNFIDDTIVVGSGDILYDFDIKSIIDFHKKKNASVTIVLTRVDDPSQFGIVDLKDDVITRFLEKPAAGEAFSNIVNAGIYVIEPEVLKYIDKIPFDFAKELFPRLMRHGTPIYGYLGNGTWLDTGRPNDLIKGNQIMVNKYGFKYDSKNITGKNIIKTTSDLSDDIIDSSYIGTNLQIGKNTVIKGSAIYNGVVLGNNVHIEDSIIMDASRIMDNTVIKKSVIMRNCVIGEDSEIIESVISPDLDLHGKSRVYNVSLASKIITDEQV

SEQ ID NO: 14544 - DNA, 1218 bp, Photobacterium profundum
  CDS (1)..(1218)
atgggtggcgttttaggtatgattttagcaggcggagaaggctctcgtttgcgtccattaacagattcacgtacaaaacccgcagttccatttggtggtagctaccgcttaattgattttgcattgaataattttgtaaatgctgattttttaaaaatttatgttctaacccaattcaaatctcagtctttatatgtgcatatgaaaaaaggctggaatatcacgggcattacggatcgttttattgatccaattccagcacaaatgcgaatgggcaagcgttggtacgatggtactgctgatgcgatttaccaaaatttaagctttattgaacttgctgaacctgagcatgtttgtatttttggtagtgatcatatttacaaaatggacattaagcagatgcttaattttcataaagaaaaagaagcggaattaacggtttctgcattgcgtatgcctttatcagaagcgagtgcttttggtgttatcgaggttgatgaaaacggctgcatggttggttttgaagaaaagccaactaaccctaagtctattcctggcgacccagaaaatgcacttgtttctatgggtaactatatattcaataaagatacgctatgtactgaacttgaagaagatgcagcaaaagaagattcaagccacgactttggtaaagacatcatccctaagctatttccacttggtaaagtctatgtttatgattttacaaccaacattattccaggtgagaagaataccggttactggcgcgatgtaggtacgattgaagcgtactggcaagcacacatggatttactttctgaagatgcgccgttctctttgtataaccgtcaatggcagctacacactcattacccaccgcttccacctgcaacaattttagacagcgaaaacagtaaagttgatattaacaactgtatgatttcagctggtagctacattcgtggcgcacaaatacataaatcaattttaggcttccgtaccaatgttgaccataacacaatgatttcagaatctgtgattttgggcgatgtgaaaatcggtgcgaattgctcaatacgtaaagcgattattgataaaaatgtacacattgctccaggaacggtaatcggtgaaaatcctgaagaggataagaaaaactaccacgtttctgatgaaggtattgtcgtaatcccgaaaggagcgaaaattggctactaa

SEQ ID NO: 14545 - protein, 405 aa, Photobacterium profundum
MGGVLGMILAGGEGSRLRPLTDSRTKPAVPFGGSYRLIDFALNNFVNADFLKIYVLTQFKSQSLYVHMKKGWNITGITDRFIDPIPAQMRMGKRWYDGTADAIYQNLSFIELAEPEHVCIFGSDHIYKMDIKQMLNFHKEKEAELTVSALRMPLSEASAFGVIEVDENGCMVGFEEKPTNPKSIPGDPENALVSMGNYIFNKDTLCTELEEDAAKEDSSHDFGKDIIPKLFPLGKVYVYDFTTNIIPGEKNTGYWRDVGTIEAYWQAHMDLLSEDAPFSLYNRQWQLHTHYPPLPPATILDSENSKVDINNCMISAGSYIRGAQIHKSILGFRTNVDHNTMISESVILGDVKIGANCSIRKAIIDKNVHIAPGTVIGENPEEDKKNYHVSDEGIVVIPKGAKIGY

SEQ ID NO: 14546 - DNA, 1209 bp, Corynebacterium glutamicum
  CDS (101)..(1189)
tgaaatggatttgctgcggccccggaattacccttttcgcggccgtcatcaaatttgtacccccttaaagacaccctaaacacgagtgaaataggaacacatgactttaactgacaacagcaaaaacgttgatgctgtcatcttggtcggtggcaaaggtacccgactgcgccccctgaccgtcaatactccaaagccaatgctgccaactgctggccacccattcttgacccaccttttggcccgcatcaaggccgcaggcatcacacacgtcgtgctgggaacgtcattcaaagctgaagtcttcgaggaatacttcggagatggctccgaaatgggcttggaaattgaatatgtcgtcgaggatcagcctttgggcactggtggtggcatccgaaacgtctacgacaagctgcgtcacgatactgcgattgtgttcaacggcgatgtgctctccggtgcggatctcaacagcattctggacacccaccgcgaaaaggacgcagatctgaccatgcatctcgtgcgcgtagctaaccctcgtgcgtttggttgcgtccccaccgatgaggatggtcgcgtcagcgaattccttgaaaagaccgaagatccaccaaccgatcagatcaacgccggctgctacgtgttcaagaaggaactcatcgagcagatcccggcaggccgagcagtttccgtcgagcgcgaaaccttccctcagctgttggaagaaggcaagcgagtcttcggccacgtcgacgcttcctactggcgcgacatgggcaccccaagcgacttcgtccgcggctcggctgacctggtccgcggcattgcgtactccccattgctcgaaggcaaaacaggagagtcgcttgtcgacgcctccgccggcgttcgcgacggcgtcctgctgctcggcggaaccgtagtcggccgcggcactgagatcggtgccggctgccgcgttgacaacactgttattttcgacggcgtcaccattgaaccaggtgcggtcattgaaaattccatcatttcctcgggagcacgcatcggtgctaatgcgcacatctccggttgcatcattggcgagggcgcacaggttggtgctcggtgtgaactcaacgcagggatgcgcgtcttcccaggcgttgtgatcccagacagcggaattcgtttttcgtctgatcagtaggcatttttagcccttttgga

SEQ ID NO: 14547 - protein, 362 aa, Corynebacterium glutamicum
MTLTDNSKNVDAVILVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 14548 - DNA, 1419 bp, Parachlamydia sp
  CDS (1)..(1419)
atgatagtctttgcttttaataaaagctatgctacggttcattttttgaccgaactttaccccatgggcgagaaaatgaatacattaacaatgttaaggcagcgttcttctcaagttgtagaaacttctgattctcaatcagttgatatgcgtcaagtggctagtttaattttaagtgggggagaaggaacacgtttacaccccctaactttagcacgttgcaagccagctattaattttggtgggaaatatcgactcattgatgttcctatctctaattctttacatgcaggttgcaaaaaagtatttctactgacgcaatttctttcgtcttctttgcatcaacatgtttttcaaacatacatgcaaggaccaggcgctggttctattgaaattttaacagcagaacaaaaaccttccaagaagaattggtttcaaggaaccgctgatgcagttcgtcaaaatattgattatcttttagaaagtccttttgaatattttttaattttatcgggagatcaactttataatatagattttcaggaaatggttcattttgctaaaaaaaatgattccgatgttgttgttgcaactatcccagtcaatactcaagatgctaaacggatgggaatattaaaagttgatgaacaaaattctattacatctttttatgaaaagccgcaagataacgatttattacaacaattgcgaagtccatcgaatattcttgaaaaagcaggagtcgcgccgacaggcgaacgagtttatttgggatcaatgggaatttatttattcaaacgaaaggcattagttgagcttctttctgaagatattcgagaagattttggtaaacatttgattcccacaaaagttgcctctgggaaaatctcagcctatctttacacagggtactgggaagatatcggaacgattgaaacattttatcaggccaatcttgctttaactgaaaccaaccctgtttttaactttcacaatgaggcacgtcctatttacacatatcgatatgatttaccacctgctaaatttactacttgccaaattcaaaaaagtattctctgtgaaggctctattatcgaagcagacgaaattactcatagccttttaggtccgcgaacagtcattggttctggggcaatcattcgtgattcttatttaatgggaaatgattattatgtttctcctgtaaatgatcattgtaaacttccgtctgaacctcagattggagaaaattgtattatcaaaaaagctattatagataaaaatgttcgtattggaaaaggcgtccagttgattaataagcaacagttgactcgctacgaaagtgagcttgtttttattagagatggtatcatcgttgttccacgcggatcagtccttccagacggatttattttataa

SEQ ID NO: 14549 - protein, 472 aa, Parachlamydia sp
MIVFAFNKSYATVHFLTELYPMGEKMNTLTMLRQRSSQVVETSDSQSVDMRQVASLILSGGEGTRLHPLTLARCKPAINFGGKYRLIDVPISNSLHAGCKKVFLLTQFLSSSLHQHVFQTYMQGPGAGSIEILTAEQKPSKKNWFQGTADAVRQNIDYLLESPFEYFLILSGDQLYNIDFQEMVHFAKKNDSDVVVATIPVNTQDAKRMGILKVDEQNSITSFYEKPQDNDLLQQLRSPSNILEKAGVAPTGERVYLGSMGIYLFKRKALVELLSEDIREDFGKHLIPTKVASGKISAYLYTGYWEDIGTIETFYQANLALTETNPVFNFHNEARPIYTYRYDLPPAKFTTCQIQKSILCEGSIIEADEITHSLLGPRTVIGSGAIIRDSYLMGNDYYVSPVNDHCKLPSEPQIGENCIIKKAIIDKNVRIGKGVQLINKQQLTRYESELVFIRDGIIVVPRGSVLPDGFIL

SEQ ID NO: 14550 - DNA, 1263 bp, Rhodopseudomonas palustris
  CDS (1)..(1263)
atgagtcaaggtgtcaccgctccgttcgcccgtcatgcgatggcttacgtgctggcggggggacgcggcagccggctgatggagctcaccgactggcgtgccaaacctgcggtttatttcggcggcaaatcccgcatcatcgattttgcgctgtcgaatgcgctgaattcgggtatccgccgcatcgcagtggcgacgcagtacaaggcccacagcctgattcggcatctgcagcgcggctggaacttcttccgcccggagcgcaacgagagtttcgacattctgccggccagtcagcgcgtctcggaagagatgtggtaccgggggacggccgacgccgtttttcagaacatcgacatcatcgagagctacgatccgaagttcatcgtgctgctggcgggcgaccacgtctacaagatggactacgagaagatgctgcagcagcacgtcgagcaaggcgccgacgtcacggtcggctgcctcgaagtgccgcgcgccgaagcgaccgcgttcggcgtgatgcacaccgatacgaccgaccgcatcatctcgttcctggaaaagccggccgatccgccagcgatgcccggcaaggccgacaagtcgctggtcagcatgggcatctacgtgttcgagaccaagttcctgctcgacgagctgcgccgtgacgccgccgatccgaattcgtcgcacgatttcggtaaggacatcatcccctacatcgtcaagcacggcaaagcggtggcgcatcacttcgacaagtcgtgccgccggtcgagttcggaggccgtcagctattggcgcgacgtcggcacggtcgacgcgtattgggcggccaatatcgatctcaccgacattgtgccggagctcgacctgtatgatcgcgagtggccgatctggacctatggcgagatcaccccgccggcgaaattcgtccacgacaaggaaggccgccgcggcgaggccgtatcgtcgctggtgtctggcggctgcatcatctcgggcgcgtcgctgcgacactcgctgctgttcaccggcgttcgcgttcactcgttctcccatgtcgagaacactgtggtgctgccttacgccgacatcggccgctcgtgccggctgaaaaatgtggtgatcgatgccgaggtcaagctgccggccggtctggtggtcggtgaagatccagagtttgacgcgaagcgcttcaggcgcaccgaaaacggcatctgtctgattacccgcgcgatgatcgagaagctcgacgcatga

SEQ ID NO: 14551 - protein, 420 aa, Rhodopseudomonas palustris
MSQGVTAPFARHAMAYVLAGGRGSRLMELTDWRAKPAVYFGGKSRIIDFALSNALNSGIRRIAVATQYKAHSLIRHLQRGWNFFRPERNESFDILPASQRVSEEMWYRGTADAVFQNIDIIESYDPKFIVLLAGDHVYKMDYEKMLQQHVEQGADVTVGCLEVPRAEATAFGVMHTDTTDRIISFLEKPADPPAMPGKADKSLVSMGIYVFETKFLLDELRRDAADPNSSHDFGKDIIPYIVKHGKAVAHHFDKSCRRSSSEAVSYWRDVGTVDAYWAANIDLTDIVPELDLYDREWPIWTYGEITPPAKFVHDKEGRRGEAVSSLVSGGCIISGASLRHSLLFTGVRVHSFSHVENTVVLPYADIGRSCRLKNVVIDAEVKLPAGLVVGEDPEFDAKRFRRTENGICLITRAMIEKLDA

SEQ ID NO: 14552 - DNA, 1284 bp, Corynebacterium diphtheriae
  CDS (1)..(1284)
atgtttttgtgtcttattgttggcaaacctgcccgcggggcggaaattctcgatagattgggctttgtgaggagtaaacagaacgttttagcaattgtccttgccggtggagaaggtaagcggctgttcccgctcaccgaagatcgtgccaagccagctgttcctttcggcggtacgtaccggcttatcgatttcgtgttgtctaacttagtcaatgccggatatttaaagatttgtgtgctgactcagtacaagtctcattcccttgaccgccatatttcccaggcgtggcagttcagtggccctaccagtcagtacattgcgtcggtgccggcgcagcagcgtttggggaagcgctggtacatgggctccgcggatgcaattttgcagtcgttgaacttggtgtacgacgagcgtcctgattatgttttggtgtttggtgctgaccacgtttaccgcatggatcctgagcaaatggtggcagaccatattgcttcaggtaaggccgtgaccgttgctggaattcgtgtgcctcgttcggaagcgagcgcatttggttgcattcaagcagatgaaaataacaacatcactgagtttttggaaaagccagcggatcctcccggtacgcctgatgatccgtcgatgacgtttgcctccatgggaaattacgtcttttctacagatgccctcattcaggcgttgaaagaagacgaaaacaatcccgattccgagcacgatatgggtggagacatcatcccatatttcgtgagcatgggtcaggcgaatgtttacgacttcaacaagaatgttgtgcctggttccaccgaccgtgatcgggcttactggcgcgacgttggtaccgtcgacgccttctacgaggcgcatatggatttgatctctgtgcacccagtgttcaacctctacaaccagcagtggcctattcgttccaccgagcgtggcgacctgccaccagcgaagttcgttcagggtggtatcgcacaggcttctatggttgcccaaggctccatcgtgtccggttctactgtgcgtaactcggttgtctctactgatgttgtggtggaagaaggcgccacagtcgaaggctccgtgattatgccaggtgcgcgcatcggcaagggggcagtggtgcgtcactgcatcttggataagaacgtggtcgtttccgacggtcaagtcattggcgttgatcgtgagcgcgatgaacaacgcttccagatcagcccaggtggcgtggtagtcgtcggtaagaacttcgtcgtataa

SEQ ID NO: 14553 - protein, 427 aa, Corynebacterium diphtheriae
MFLCLIVGKPARGAEILDRLGFVRSKQNVLAIVLAGGEGKRLFPLTEDRAKPAVPFGGTYRLIDFVLSNLVNAGYLKICVLTQYKSHSLDRHISQAWQFSGPTSQYIASVPAQQRLGKRWYMGSADAILQSLNLVYDERPDYVLVFGADHVYRMDPEQMVADHIASGKAVTVAGIRVPRSEASAFGCIQADENNNITEFLEKPADPPGTPDDPSMTFASMGNYVFSTDALIQALKEDENNPDSEHDMGGDIIPYFVSMGQANVYDFNKNVVPGSTDRDRAYWRDVGTVDAFYEAHMDLISVHPVFNLYNQQWPIRSTERGDLPPAKFVQGGIAQASMVAQGSIVSGSTVRNSVVSTDVVVEEGATVEGSVIMPGARIGKGAVVRHCILDKNVVVSDGQVIGVDRERDEQRFQISPGGVVVVGKNFVV

SEQ ID NO: 14554 - DNA, 1089 bp, Corynebacterium diphtheriae
  CDS (1)..(1089)
atgactgaaacaacactgcgcagcgacacagatgctgtgatccttgttggaggtaagggcactaggttgcgtccgctgactgtgtcgactccaaagcccatgctgcctacggcaggtgtgccgttcctttcgcatttgcttgcgcgtatcaaggctgccggtatcacgcatgtggtgctgggtacgtcgtttaaggcggaggtgtttgaggactacttcggtgatggtgctgatctcggcttggagattgagtacgtggtggaggataagccattgggtaccggtggcggcattcggaacgtgtatgacaagcttcgtgctaacaccgtgatggtgtttaacggcgatgttcttggcggcactgatcttggtggaatccttgatgctcaccatgccaaaaacgctgatttgaccatgcatttggtacgagttccagatcctcgtgcgtttggttgtgtgcccactgatgctgagggacgagtttctgctttcttggaaaagaccgaggatccaccaacggaccagattaatgctggttgctatgtgttccgtcgtgagctgatcggtgagatccctgcagatcgagtggtgtctgtggagcgcgagactttcccacgcttgctggaggagggacgccgcgtgttcggttatgtagacaatgcatattggcgcgacatgggtactccttctgacttcgtgcgtggttcgtcagatttggttcgtggtattgcgccgtcgccgttgttggaaggtaagacgggggagtgccttgtcgacgaatccgctggtgttagcgatggtgcgttgcttttgggcggtaccgtgattggtcgcggcactgaaatcggtgcgggctgtcgtttggacgacaccgtggtgtttgatggtgtgaccattgagccgggtgctgtgattgaagattcgattattgggcatggtgctcgtattggagccaatgctcgcattaccggctgtgtgattggtgaaggcgcggaaatcggtgcacgttgtgagcttcgcgacggcatgcgtgtgtggccaggagttgtgattccaactgctggtatccgttttagttcggatgcctaa

SEQ ID NO: 14555 - protein, 362 aa, Corynebacterium diphtheriae
MTETTLRSDTDAVILVGGKGTRLRPLTVSTPKPMLPTAGVPFLSHLLARIKAAGITHVVLGTSFKAEVFEDYFGDGADLGLEIEYVVEDKPLGTGGGIRNVYDKLRANTVMVFNGDVLGGTDLGGILDAHHAKNADLTMHLVRVPDPRAFGCVPTDAEGRVSAFLEKTEDPPTDQINAGCYVFRRELIGEIPADRVVSVERETFPRLLEEGRRVFGYVDNAYWRDMGTPSDFVRGSSDLVRGIAPSPLLEGKTGECLVDESAGVSDGALLLGGTVIGRGTEIGAGCRLDDTVVFDGVTIEPGAVIEDSIIGHGARIGANARITGCVIGEGAEIGARCELRDGMRVWPGVVIPTAGIRFSSDA

SEQ ID NO: 14556 - DNA, 1563 bp, Ostreococcus tauri
  CDS (1)..(1563)
atggtgaagacggcgagctcgagcagcggacggttcgagagccgcgcgagcgcgtcgatgacgtcgcgcgcgcgggagatggagcagacgttggaggtgcaggcggagggtgagggtgttgaagatgagatgcgtgagatcgcggtggatgcgcgcgcgccgcgagtgcgaagagatcgggcgaagacggcgtcgagagagctcaagcggagatttcagtcgcgagacgcgcggtgcgtcatcctcgcgggtggggcggatgagacgaatccgttgacgcgaagacgcgcgaggagtgcggtgcacttggctgggacgtatcgcgtgatcgatttcccgatgaccaacctcatcaactcggggatgcgtcagttgtacgtcttgacgcagttcaacagtcactcgctcgtgacgcacgtgaacaaggcgtttccttcggaattattcggaggcgaagtgaatggtttcgttgaagttttaccgacgagccaaactcgcgagcatggggagacgtggtcgttgggaagcgcggattgtgtcgcgagacacttgtcgagcggctcgctgaccaagtacacgtacgagatgcgcatggaggatgagtgtttacgacagctcggctcgctcgatgagtgcttgatgagtgagctcgacgggacaaccatcattttgtccgcggaggcgctttactcgatgaatttcgccgagctcttggagcagcacttcttgaagggagcagatgtcacaattgctacgtgcaatcaaatctcctctgaccaggcaaacgcctttggaatcctggacgttgacgagatgacagctcaagtgaattgcttcattgagaagccgacgaaggctcaattggaagagttcatgcagtgcacgacggaagagctcgaaagctgcaagctcgacgccaacatgggcgtgtacgttttcaacaactccgccctattggagttgttgacggcgtcaaagtctggcgtggcgccagggggaccgacacgagttcggttgggttacgacgtgaaggctttcagacattccgattactggaaaccgctccgaagtcttcgcgacctttacgaggcgaatatatccatcgccgtcggcggcgacgccgcttcacttctcacacacgggcgtcaggtgtacactaagccgaactttttgccgcccaccacgttccatggttcagtttacaccgagaaaacaattttctcggatggatgtctcgttcaggacggttcacgcatcgtgaactccgtcattggcgcgtgcacctctatcgacaagaacgtcgatctggaaggcgtcgtcgtcgtcgggcgcgacgaaataatgaaacgatccggcggtgtgaacagcgtccccgacatcggtgcgaacaccatcattcgcaagtgcatcatcgattctgatgccaccattggcgcgaacgtgcgtatcgtgaacgcggctgggattgaagaactcgatcgcaccgatgaaggatacgttatcaccgaaggcatcgtcaccatcctgggtggtgcgattattccggacggtttcgtcatctaa

SEQ ID NO: 14557 - protein, 520 aa, Ostreococcus tauri
MVKTASSSSGRFESRASASMTSRAREMEQTLEVQAEGEGVEDEMREIAVDARAPRVRRDRAKTASRELKRRFQSRDARCVILAGGADETNPLTRRRARSAVHLAGTYRVIDFPMTNLINSGMRQLYVLTQFNSHSLVTHVNKAFPSELFGGEVNGFVEVLPTSQTREHGETWSLGSADCVARHLSSGSLTKYTYEMRMEDECLRQLGSLDECLMSELDGTTIILSAEALYSMNFAELLEQHFLKGADVTIATCNQISSDQANAFGILDVDEMTAQVNCFIEKPTKAQLEEFMQCTTEELESCKLDANMGVYVFNNSALLELLTASKSGVAPGGPTRVRLGYDVKAFRHSDYWKPLRSLRDLYEANISIAVGGDAASLLTHGRQVYTKPNFLPPTTFHGSVYTEKTIFSDGCLVQDGSRIVNSVIGACTSIDKNVDLEGVVVVGRDEIMKRSGGVNSVPDIGANTIIRKCIIDSDATIGANVRIVNAAGIEELDRTDEGYVITEGIVTILGGAIIPDGFVI

SEQ ID NO: 14558 - DNA, 2065 bp, Fragaria ananassa
  CDS (202)..(1725)
cctcttcctacttccttgtgaaacaatccaaacagactaaaaaaaaaaccatttctactccagctcccaaaatttcggtgatctcaactccaaaacccacaaaagtggaatcctcttcttcttctctggtttgctttaccactctcaaaaaaaccatttattactgatcagttacaatcgttacactgagacaattttgaaatggattcatggtgtgtgaccctgaagccaaacacccatttgagacagccaactcaagctggcctttgttgtggggctaatggctttctgggtcagaggatcagagagagttttggtaacaggggttgggtacatgggagtgagaagacaagacctggtgttgttagttctgttgttacaacaaaggactttgagacgaccctgaaagtcccaacttaccacagaccaagagtggacccaaagaatgttgcttcgatcatattgggaggaggggcatttactcagctctttcctcttaccagaagagcagccacacctgcagttcctgttggtggatgctaccggcttattgacattccgatgagcaattgcatcaacagcaacataaacaaaattttcgtgctaacccagtttaattccacttctctcaatcgccaccttgctcgcacctattttggaaatggtatcaacttcggggatggatttgtggaggttctagcagccactcaaacatctggggaagcaggaatggattggttccaaggaacagcggatgctgtgaggcaatttgtatgggtatttgaggatgctaagaataggaacgttgaaaatatactgattttgtctggggatcatctttatcgaatggactatatggactttgtgcagagtcacgttgatagcaatgccgatatcacactttcatgtgcagttgtgggtgacagccgtgcatctgattatggtttggtgaagatagacagcagaggtaaaatcatccagtttgctgaaaaaccaaggggagctggtctaaaagcaatgcaatcagatacaacacttcttggattctccccacaagatgctctaaaatccccatatgttgcatcgatgggagtgtatgtatttaagacggatattttactagaacttctgaaaaagagttatccaaattcgaacgacttcggatctgaaatcattcctgcagcagtggaagagcgcaatgtccaagcatatatattcatagactactgggaggatatcggaactatacagtcattttatgatgctaacttggccctgactgaagagttcccaaagtttcagttttatgacccaaagacacctttcttcacttctcctcggttcttaccaccaaccaagattgacaattcccgggttgtggatgcaataatctcacatggatgtttcttgcaagaatgtttcgtccaaagttcaatagtgggtgaacgctcacggttagattatggtgttgagctgaaggattccataatgatgggtgcagacagttaccaaactgaatctgagattgcagctctgcttgcgcgagggaaagttccaataggtattggaaggaatacaaagattaggttgtgtatagtcgacttgaatgcaaagattggaaaggatgtgatcataatgaacaaagatggcattcaagaagcagataggccagaagaggggttctacatccgtgaggaatcattatcgttgtggagaagggaataatagaagatggaaaagttatataaattaatgcctgttactttctcaagtacaatgacagcggagttaaaaggtggttctggcaaaagaactggaaaacagtgtgcattggcagctaggggatagcttctgccagactttgtcttcgaaacaggaaacaggcaaggtatctcctttcagttcttccggtacttgaactagaaacatccttgatccttcagttcttgtcaaatgggaacatgtgctcattagacagttagtttcgctagatgtacaaaaataagttaacagggctgacacgctggttgtattcatcatctttcttgtcaaaaaaaaaaaaaaa

SEQ ID NO: 14559 - protein, 507 aa, Fragaria ananassa
MDSWCVTLKPNTHLRQPTQAGLCCGANGFLGQRIRESFGNRGWVHGSEKTRPGVVSSVVTTKDFETTLKVPTYHRPRVDPKNVASIILGGGAFTQLFPLTRRAATPAVPVGGCYRLIDIPMSNCINSNINKIFVLTQFNSTSLNRHLARTYFGNGINFGDGFVEVLAATQTSGEAGMDWFQGTADAVRQFVWVFEDAKNRNVENILILSGDHLYRMDYMDFVQSHVDSNADITLSCAVVGDSRASDYGLVKIDSRGKIIQFAEKPRGAGLKAMQSDTTLLGFSPQDALKSPYVASMGVYVFKTDILLELLKKSYPNSNDFGSEIIPAAVEERNVQAYIFIDYWEDIGTIQSFYDANLALTEEFPKFQFYDPKTPFFTSPRFLPPTKIDNSRVVDAIISHGCFLQECFVQSSIVGERSRLDYGVELKDSIMMGADSYQTESEIAALLARGKVPIGIGRNTKIRLCIVDLNAKIGKDVIIMNKDGIQEADRPEEGFYIREESLSLWRRE

SEQ ID NO: 14560 - DNA, 1872 bp, Fragaria ananassa
  CDS (34)..(1599)
ccactctgaaaaatacttcctcccatttcttccatggcttcctcttcaatggcagcgaacggtgttcccacgttgagactgtccacgtccaacattgccacgaatcaaacccagaaaacgaatagagggctttccttcagcggctctcatctatcgggcaccaaaatcccgactcctgccacgtgtttaaggacctgtagtccttccccgtccaccagaagggccccactggtggtgtctccgaaagctgtttcggattccaagaactcggagacgtgtcttgatcccgacgcgagcagaagtgtgttggggattatattgggaggcgacggacggacgaggctgtacccgctgacgaagaagcgcgcaaagccggctgttccgttgggagcgaattaccggctgattgatattccggtcagcaactgcctcaacagcaacgtttccaagatctacgtcctcacccagttcaactccgcttctctcaatcgtcatctctctcgtgcttacgccagcaacatgggagggtacaagaacgaaggctttgtcgaggttctcgctgcgcagcagagtccggagaatcccaattggttccagggtactgcggatgctgtgaggcagtgtttgtggctgtttgaggagcacaatgtgttggagtttttggttcttgccggggaccatttgtataggatggactatgagaagttcattcaggctcatagagagactgatgcggatatcactgtggctgctcttcccatggatgagaagcgcgctactgccttcggtttgatgaagattgatgatgagggtcgcattattgagtttgctgagaagcctaaaggggagcaactcaaagctatgaaggtagatacaaccatattgggtcttgacgatgagagagctaaagagatgccttacatcgccagtatgggtatatatgttgtgagcaaaaatgtgatgttagatctgcttcgtgagaaatttcctggagcaaatgattttgggagtgaagtcattcccggtgcaacttccatcggcttgagagttcaagcttatttgtacgatggctactgggaagacatcggtaccattgaagctttctataatgccaatctgggaataactaaaaagccaattcctgatttcagcttctacgatagttcatccccaatctatacccaacctcggtatttgcccccatccaaaatgcttgatgctgatatcacagatagtgttattggcgaaggttgtgtgataaagaactgtaaaattcaccattctgttattgggcttcgttcttgcatatcggaaggtgctgttattgaagacacattactgatgggggcagactactatgagacggatgtcgacaggaggctcatggctaagaaaggctctgttccaattggtatcggaaagaattctcacattaagagagctataattgacaagaatgctcggattggggacaatgtgaagattatcaagagtgacaatgtgcaagaaacagcaagagaaacggatggatatttcatcaaaagcgggattgtcacagtgatcaaagatgcctggattcctagtggaactgttatctaatctccatttttccactcgtttaaattttgcagatcaccaaggctttttctgtactagttacaaggctgggagaactatgatgctctctttggtccaagcaacttagcaaatctactttggggttctgtcttctcatcatgcaatgtatatttcacggtactacaatgtaattagaggaagagacctcggatattttcttatttttctctagtagatgttctatctctatctgaaataaagtctgtcattacttaaaaaaaaaaaaaaaaaaaa

SEQ ID NO: 14561 - protein, 521 aa, Fragaria ananassa
MASSSMAANGVPTLRLSTSNIATNQTQKTNRGLSFSGSHLSGTKIPTPATCLRTCSPSPSTRRAPLVVSPKAVSDSKNSETCLDPDASRSVLGIILGGDGRTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQCLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPYIASMGIYVVSKNVMLDLLREKFPGANDFGSEVIPGATSIGLRVQAYLYDGYWEDIGTIEAFYNANLGITKKPIPDFSFYDSSSPIYTQPRYLPPSKMLDADITDSVIGEGCVIKNCKIHHSVIGLRSCISEGAVIEDTLLMGADYYETDVDRRLMAKKGSVPIGIGKNSHIKRAIIDKNARIGDNVKIIKSDNVQETARETDGYFIKSGIVTVIKDAWIPSGTVI

SEQ ID NO: 14562 - DNA, 1245 bp, Thermus thermophilus
  CDS (1)..(1245)
atggtcaaggtggaagtgctgggaatgattcttgccggaggccagggtagccggctttaccccctcacggccaagcgggccaagcctgccgtgcccttcggggccaagtaccgcatcattgacttcgtcctcaacaacttcgtgaactccggcatctacgccatctacgtcctcacccagtacaaggcccagtccctcacggagcacatccagcgctactggcgcttcggggcctttttggaggaccacttcatcctcctcgtgcccgcccagatgtaccgctacgaggagctcggacccgtctggtaccggggcacggcggacgccatctaccagaacctccacctggtgcacaaccacgcccccaaggcggtggccgtcttcggcggggaccacatcttcaagatgaacatccgccacatggtggagtaccactacgacacccgggccgacatcaccatcgccgcctaccccgtccccgtggccgaggccacccgcttcggcgtgctgcaggtggacgaggagtggcgcatcaccgagttccaggagaagccagaggagcccaagcccattcccggccgccccgacacagccctcgcctccatgggcaactacatcttccgcaccgaggccctctttgagcttttggaggcggacgccagggacgagaccagcgcccacgacttcggcaaggacgtcatcccccgggcccttagggaggggtacagggtctacgcctacgacttccaccgcaaccccatccccggccaggaggggccgaacctctactggcgggacgtggggaccctggacgcgtattacgaggccagcatggacctggtgaaggtggtccccgagtttgacctcttcaacccggagtggcccctccgcaccgccaacctcttcagccccccggccaagttcgtccacgagaccggggagcgggtggggcgcgccctgaatagcctcctcgcgggcggggtcatcgtgagcggggggacggtgcgggagtccgtcctcttccgccgggtgcgggtgaactcctatagcctggtggagcgctccgtcctctttgacgacgtggaggtggggcgctactgccgcatcaggaacgccatcattgacaagaacgtgaagatccctccccacaccgagatcggctacgacctggagctggaccgggcccggggcttcaccgtcacccccgagggcgtggtggtggtgcccaagggctaccgcttttag

SEQ ID NO: 14563 - protein, 414 aa, Thermus thermophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDTALASMGNYIFRTEALFELLEADARDETSAHDFGKDVIPRALREGYRVYAYDFHRNPIPGQEGPNLYWRDVGTLDAYYEASMDLVKVVPEFDLFNPEWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 14564 - DNA, 1047 bp, Thermus thermophilus
  CDS (1)..(1047)
atgaaagggctcatcctggccgcgggaagaggcacgaggctccgtcccctgacccacacccgccccaagcccgccatccgggtagcggggcggcccatcatccactacgccgtggagaacctcctggaggccggggtccgggagatcggggtcgtggtctccccggagacggagcgggacctgaaggtggccctcgagggctaccccgtccgctacgtccttcaggaggaaccccaggggctggcccacgcggtggacgtggcccgggacttcctgggggaaagccccttcgtcctctacctgggggacaacctcttccaaaagggcatccggcgcttcctggaggccttcaagcccggcgtgagcgccgtcatcgccctggtgcgggtggaagacccaaggcagttcggcgtggccgtcctggagggcaaccgggtggtgcggcttttggaaaagcccaaggatcccccctcggacctggcggtggccggggtctacgtcttctcccccgaggttttggaggtcgtccggggcctcaagccctccgcccggggagagtacgagatcaccgacgccatccagggcctcattgaccggggcaaaacggtggtgggcgtggaggtggagggctggtggaaggacacgggccgccaccaggacctcctggacgcgaaccggctcctcctcgaggagctcacccccaaggtggagggggacgtggtggagagccagctcacgggccgggtggtggtggagaagggggcgaaggtggtgcggagcaccgtgatcggccccgcccacatcggcgcgggcgccgtggtggaggaggccttcgtgggccccttcacctccgtggggccccgggcccgggtggtgcggtcggaggtggagtactccctcctggaggaggaggccgtggtggaggaggtccgcctccgcctccaggagtgcatcctcggcgtccgggccgaggtgaagagccgggacggcctcccccgggcccaccgcctcatcctcggggacctctcccaggtggagctggcctga

SEQ ID NO: 14565 - protein, 348 aa, Thermus thermophilus
MKGLILAAGRGTRLRPLTHTRPKPAIRVAGRPIIHYAVENLLEAGVREIGVVVSPETERDLKVALEGYPVRYVLQEEPQGLAHAVDVARDFLGESPFVLYLGDNLFQKGIRRFLEAFKPGVSAVIALVRVEDPRQFGVAVLEGNRVVRLLEKPKDPPSDLAVAGVYVFSPEVLEVVRGLKPSARGEYEITDAIQGLIDRGKTVVGVEVEGWWKDTGRHQDLLDANRLLLEELTPKVEGDVVESQLTGRVVVEKGAKVVRSTVIGPAHIGAGAVVEEAFVGPFTSVGPRARVVRSEVEYSLLEEEAVVEEVRLRLQECILGVRAEVKSRDGLPRAHRLILGDLSQVELA

SEQ ID NO: 14566 - DNA, 1131 bp, Bacillus cereus
  CDS (1)..(1131)
atggctcaaaaacaaaagtgcgtagcaatgttactagcagggggaaaaggtagtcgattaagtgcattaacaaaaaatttagccaagccagctgttccatttggtggtaaatatcgcattattgattttacgctaagtaactgcgcaaattctggtattgaaacggttgggattttaacgcaatatcaaccactcgaacttcataattatatcggaatcggcaatgcgtgggatttagaccgagtaagcggtggagtcacagtattacctccttatgcggagtcttcaggtgtgaagtggtacacaggtacggcaagtgccatttatcaaaacttaaactatttaagtcaatatgaaccagagtatgttctcattttatcaggcgaccatatttataaaatggattacagtaaaatgctagattaccatattgagaaagaagcggacgtttccatttctgttattgaagtgccttgggatgaggcgagtcgtttcggtattatgaatacgaacgaagagatggagattgttgaatttgaagagaaaccgcaatttccaagaagtaatcttgcatcaatgggaatttacatttttaactgggcaattttgaaagagtatttagaaatggatgcaagaaaccctgaatctagtaatgatttcggaaaagatgtacttccgcttttattagatgaagggaagaagttaatggcgtatccgtttgaagggtattggaaagatgttggaacggtgaaaagcttatgggaagcgaatatggatttacttcgcgatgaaacatcactgaatttaaatgatcgtaattggcgtatttattctgttaatccaaacgaaccacctcaatatatcgctgaaaaggcaaaagtagaagaatcacttattaacgaaggatgcgtcattgaaggggacgtgaagcattctgtactattccaaggagttacggtggaagaaggtagtatggttattgattctgtcgttatgccgggagcgaagattggtaaaaatgttgtgattgaaagagcgatcgttggatcagaaatggttattgaagatggaacaattattcgtccagaaaaaaatgtcgacgatgtagtactcattgctgaagggaaatag

SEQ ID NO: 14567 - protein, 376 aa, Bacillus cereus
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 14568 - DNA, 1035 bp, Bacillus cereus
  CDS (1)..(1035)
atgggagaaaaaatgttaggaattattaatgcaacgggaagttttccttccttaaagaaagtaacagggcatcgttcactagcggcgttaccgtttgggggccgttatcgactcattgatttcatgctttcaaatatggtgaattctaatattcatagtgtagcggtttttacaagtcataaaaaccgctcgttaatggaccacgttggttcaggaaaacagtgggatttagatagaaaaagagacggactgtttttattcccgccaaattgccaatgtgatcaagatgaatttggatcttttgcgcattttagaagacatattgattattttctaagagctagagaagaatacgtcgttattacgaatagccatctcgtaacagcattgaattttcaagcggtgttagagcgacatatacatacggcagctgatattacggaagtttgccatgaaggggtttcgcttcaaacgtacgtgttaaagaaacaattactgttagatttattcgattcatataaagatgtggagcaatatagcttattcgatgtagtgagagaaaagcgcggaaaatcactacatattgctacgtatgagcatacaggatatgtagctattattgattcaattgaaagctactataaacatagcttagaaattttgcaacctgctatttggaagcaactatttaagaaagaagcaccaatctttacgaaagtaaaagatgagccgccaactcgttatgtaaagggtgcagtcgtgaaaaatacaatgattgcaaatggtagtattatcgaaggtgaagtagaaaatagtgttgtctcccgttctgttaaaattgggaaaggttcaattgttcgtaatagcattattatgcaaaagagccaaattggagataactgtataatagacggtgttattattgataaagatgtgaaaattggtgacggtgttgtactaaaaggaaacgccgatgagccatacgttgtagaaaaaggaagcgtgcaaaacagtacgattaatagttattcttaa

SEQ ID NO: 14569 - protein, 344 aa, Bacillus cereus
MGEKMLGIINATGSFPSLKKVTGHRSLAALPFGGRYRLIDFMLSNMVNSNIHSVAVFTSHKNRSLMDHVGSGKQWDLDRKRDGLFLFPPNCQCDQDEFGSFAHFRRHIDYFLRAREEYVVITNSHLVTALNFQAVLERHIHTAADITEVCHEGVSLQTYVLKKQLLLDLFDSYKDVEQYSLFDVVREKRGKSLHIATYEHTGYVAIIDSIESYYKHSLEILQPAIWKQLFKKEAPIFTKVKDEPPTRYVKGAVVKNTMIANGSIIEGEVENSVVSRSVKIGKGSIVRNSIIMQKSQIGDNCIIDGVIIDKDVKIGDGVVLKGNADEPYVVEKGSVQNSTINSYS

SEQ ID NO: 14570 - DNA, 1275 bp, Treponema denticola
  CDS (1)..(1275)
atgtcaaaagttctttccataatattgggaggcggaaaaggaacacgtctttatccgcttaccatgcatagatctaaaccggctgtaccttttggaggcaagcatcgaattatcgatatacctctttccaattgtataaattccggctttaggaatatttatattgtaacacaatttaactcggcttctttgcatattcacattgcaaaagcctacacttttgatacgttttcaaacggatttgtagaaattcttgcagccgagcaaactttcgacaatacgggctggtatgaaggaacggccgactccataagaaaaaaccttcatcattttcggcatcaaaatccatcccattatttaatccttgcaggcgatcaactctaccgcatggatttaaaaaagtttttaaattttcataaagaatcggaatccgatattaccgtagcctgtactccggtcacacgagaggatgcatcaggtttcggtattatgaaggttaattcggattctttaattaccgagtttatggaaaaaccgggagccgacaaaaacatagatgattggaaaattcccgaaaagtctcttatcaaaccgaatgatcccaataaacaatatctggcttccatgggtatttatattttcagtgcgaagattatggaagaatgtttagacagtgatcataccgatttcggaaaagaagtaattcctgccgccataaacggaaaatataaggtttctgccttccctcataacggatattggtccgacataggaaccatcaagtctttttatgatgcaacgcttgacctgacggaaataacacctaaattcgacttttatgatgctgaaaggccaatatacacccataacagaaatctacctccatcaaaggtaaactatgcacacttgagcagatctatctgcagcgaaggctgtgtcataacgaattccacaataaatcattccgtaataggggtcaggtcaatcatagaaacaggcagctttgtagaagattctatctgcatgggggcggactattacgaaacacatgaagaaaaggaaacccgactaaaagaaggaagccccggcttaggtataggaaatcattgccgcatacgttctgcaataatagacaaaaatgtgcgtataggaaataacgtatccataggtatggaccaaacacctcccgacggcgactacggtttctatcatgttgtcggcggaatatacgttatagtaaaaaattccgtaatacctgataatacttcaatataa

SEQ ID NO: 14571 - protein, 424 aa, Treponema denticola
MSKVLSIILGGGKGTRLYPLTMHRSKPAVPFGGKHRIIDIPLSNCINSGFRNIYIVTQFNSASLHIHIAKAYTFDTFSNGFVEILAAEQTFDNTGWYEGTADSIRKNLHHFRHQNPSHYLILAGDQLYRMDLKKFLNFHKESESDITVACTPVTREDASGFGIMKVNSDSLITEFMEKPGADKNIDDWKIPEKSLIKPNDPNKQYLASMGIYIFSAKIMEECLDSDHTDFGKEVIPAAINGKYKVSAFPHNGYWSDIGTIKSFYDATLDLTEITPKFDFYDAERPIYTHNRNLPPSKVNYAHLSRSICSEGCVITNSTINHSVIGVRSIIETGSFVEDSICMGADYYETHEEKETRLKEGSPGLGIGNHCRIRSAIIDKNVRIGNNVSIGMDQTPPDGDYGFYHVVGGIYVIVKNSVIPDNTSI

SEQ ID NO: 14572 - DNA, 1077 bp, Mycobacterium paratuberculosis
  CDS (1)..(1077)
atgggaactcccgaagtcgacgtggtgatcctggtgggcggcaagggcacccggctgcggccgctgaccctgtcggcgcccaagccgatgctgcccaccgccgggctgccgttcctcacccatctgctgtcccggatcgccgcggccggcatcgagcacgtcatcctgagcacgtcgtatcaggccgcggtgttcgaggcggaattcggcgacggctccaagctgggtctgcagatcgagtacgtgaccgaggagcggccgctgggcaccggcggcggcatcgccaacgtcgccggccagctgcggcacgacaccgtgatggtgttcaacggcgacgtgctctccggtgccgacctgggccagatgctcgacttccacgccgcgcagcaggccgacgtcaccctgcacctggtccgggtgagcgatccgcgcgcgttcggctgcgtgaccaccgaggacggccgggtcaccgcgttcctggagaagacccaggacccgccgaccgaccagatcaacgccggctgctacgtcttcgcccgccgcgtcatcgaccggatcccgcgcggccgcgaggtgtcggtggagcgcgaggtgttccccgcgctgctgtccgatcccgatgtcaaggtgtgcggctacgtcgacgccacctattggcgcgacatgggcacccccgaggacttcgtgcgcggctcggcggatctggtgcgcggcatcgcgccgtcgccggccctgcacggccaccgcggcgagcagctggtgcacgacggcgcggcggtgtcgccgggcgccgtgctgatcggcggcaccgtcgtcggccggggcgccgagatcggccccggcgtccggctggacggcgcggtgatcttcgacggcgtcaaggtggaggccggcagcgtgatcgagcgctcgatcgtcgggttcggcgcgcgcatcggcccgcgggcgctgatccgcgacggggtgatcggcgacggcgccgacatcggggcgcgctgcgagctgctgcgcggcgcccgggtgtggcccggcgtgtcgatccccgacggcgggattcgctactcctccgacgtctga

SEQ ID NO: 14573 - protein, 358 aa, Mycobacterium paratuberculosis
MGTPEVDVVILVGGKGTRLRPLTLSAPKPMLPTAGLPFLTHLLSRIAAAGIEHVILSTSYQAAVFEAEFGDGSKLGLQIEYVTEERPLGTGGGIANVAGQLRHDTVMVFNGDVLSGADLGQMLDFHAAQQADVTLHLVRVSDPRAFGCVTTEDGRVTAFLEKTQDPPTDQINAGCYVFARRVIDRIPRGREVSVEREVFPALLSDPDVKVCGYVDATYWRDMGTPEDFVRGSADLVRGIAPSPALHGHRGEQLVHDGAAVSPGAVLIGGTVVGRGAEIGPGVRLDGAVIFDGVKVEAGSVIERSIVGFGARIGPRALIRDGVIGDGADIGARCELLRGARVWPGVSIPDGGIRYSSDV

SEQ ID NO: 14574 - DNA, 1215 bp, Mycobacterium paratuberculosis
  CDS (1)..(1215)
atgagggaagcaccacacgtgctgggcatcgtcctggccggcggtgagggcaagcggctgtatccgctgaccgcggatcgcgccaaacccgcggttcccttcgggggcgcctatcggctgatcgacttcgtgctgtccaacctcgtcaacgcccgctatttgcggatctgcgttctcacgcagtacaagtcgcattcactggaccgtcacatctcgcagaactggcggttgagcggcctggccggcgagtacatcaccccggtgccggcccagcagcggctcggcccgcgctggtacaccggctcggccgacgcgatctaccagtcgctgaatttgatctacgacgaagaccccgactacatagtggttttcggcgccgaccacgtgtaccggatggaccccgagcagatggtccggctccacatcgacagcggggccggcgcgacggtggccggcatccgggtgccgcgcagcgaggccaccgccttcggctgcatcgactccgacgagtcgggccgcatccgcaagttcgtggagaagccgctggatccgccgggcaccccggacgatcccgagacgacgttcgtgtcgatgggcaactacattttcaccaccaaggtgctgatcgacgcgatccgcgccgacgccgacgatgaccattccgatcacgacatgggcggtgacatcatcccgcggctggtcgacgacgggatggccgcggtctacgacttcagcgacaacgaggtgcccggcgccaccgaccgggaccggggctactggcgcgacgtggggacgctggacgcgttctacgacgcgcacatggacctggtgtcggtgcatccggtgttcaacctgtacaacaagcgctggccgattcgcggcgagtcggagaacctggccccggccaagttcgtcaacggcggctccgcgcaggagtcggtggtgggcgcgggcagcatcatctcggcggcctcggtgcgcaactcggtgctgtcgtccaacgtggtggtcgacgacggggcgatcgtggagggcagcgtgatcatgcccggcgcgcgggtggggcgcggcgcggtggtgcgccacgccatcctggacaagaacgtggtcgtcgggcccggcgagatggtcggggtggacctggaaagagaccgggagcgcttcgccatcagcgccggcggcgtggtcgcggtgggcaagggcgtctggatctaa

SEQ ID NO: 14575 - protein, 404 aa, Mycobacterium paratuberculosis
MREAPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRLHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 14576 - DNA, 2511 bp, Geobacter sulfurreducens
  CDS (1)..(2511)
atgaaagccgtgatcatggccggcgggttcggtacccgcatccagcccctgacgagcagcattccgaaaccaatgatccccctcctcaaccgtccgatcatgcttcacatcgtggagctgctcaaaaaatacgagatcaccgacttggtcatgctcctgtaccatcagccggcggtcatcaagaacttcttccgcgacggcacggatttcggcgtcaagatcacctatgtgaccccacttcaggacatggggaccgccggtgccgtcaagtgcgccgagaagtatctggacgaacggttcatcgtcatcagcggcgacctcctcaccgacttcaaccttcagaaaatcatcgacttccacgaggagaaagaggccttggccaccatcaccctcacctcggtaaaagatccgctccagttcggcgtggtcattaccgacaaggaaaagcggatctcccagttcctggagaaacccggctggggcgaggtgatctccgacaccatcaataccggcatctacgttctggagccggaaattttctcccatatcccggccgaggagaactacgacttctcccaggacctcttcccgaagctgctggagaagcagcagtccctgttcggctacaccgccaaaggatactggcgggatatcggcaacaccgactcctaccgtgaggcccaccacgacatcttcaaagggaaggtgaacgtaaggatcgacgagccgaagcaggatctggtgggcaaggatctgcggctcggctccgacgtgaacctggacgagcatgtgaccctggaggggacggtggtcatcggtgataactcccaggtcttcgagagcgcccacatcaaggatacggtgattggacgcaactgcaccatcgaggcgggggtacggctctcccgctgtgtgatctgggataatgtctacgtaaagcggggggcgaagctgaacgacagcgtcctctgcggcaacgtccgcgtggggaacggcgtggtgatggaggagggggtcatcgtggccgacgacacctccatcggcgaagagtcctacatcaagcgcgacgtgaagatctggccgcgcaaggtgatcgaggccggggccaccgtcaccggcaacctgatctggggtgagaagtggaaaaaagccctgttcgagggggccctcatcaagggtctcaccaacatggaactcacccccgagttcgtggctaagctgggctgcgcctacggcacgacccttcccaaggggagcttcgtgatttccggccgcgacgcttaccgctcctcccggatgctcaagcggagcttcatcggcggccttctctcctccggggtcaacgtccgcgacctgaccatggtcccgatgcctgtgctgcgctacaagctccgttccttcggggaggtgggcggcatccagttccgacaggctctggatgaccccgcctccaccgaaatcatcttcctggacggcgacggcctcgacttctccagctcaatgggcaaaaacgtggaacggatcttcttcaaggagaacttccgccgggcccaccacacggagccgggggggctcacggaaatcccccagcaggtgatggatttctatcgtgagggattcctgcacgccatcggcaagacgccgctccagaaaaaagcgttcaaggtggtcatcgacttcaaccactcgccggccagccaactcctccccggcatccttactcagatggggtgcgaagtcatcagcctcaacgcgtacgtggacgaggagcggggggtccaggccctgtcggatcgggggcagagtctctcgcagctttccaagatcgtcgccactctggaggcgaacgccggcttctggctcgaccccaccgtggagggagtcatcatggtcgacgaaaccgggacggtccacgagggggccgacatcctgctgctgatggtcgggctcgcccttaaggccggcgaaaaaggggtgttcgccataccggtctcggcaccctcggccatcgaacggatggcccaggaacggggctgcgccgttacccgcaccaagagcgccgaccgctccatgatcgaggcggccctctcctcggaggtcatcctggccggttccatggatggccgcttcgccttcccccggttccaggcagccttcgacggcatgttcgccatcgccaagtccatcgagatggcggcccgcagcggagcgtccatctcggcaactgccgcggaaatcccccgtcgggccttccttcacacccgggtcccctgcgtctgggacatgaagggtggaatcatgcgtaagatgagcgaggacagcctcgacaaggaggcaagcttcatcgacgggatcaaggtccatttcggcgaggactgggccctcgtcctccccgaccagtaccagccccacgtccacatcgtggccgaggcccgggaccccaaggccgcccagaaactgctgaccgagtaccagaaaaaagtggagcagtggaagaaggagctgtcataa

SEQ ID NO: 14577 - protein, 836 aa, Geobacter sulfurreducens
MKAVIMAGGFGTRIQPLTSSIPKPMIPLLNRPIMLHIVELLKKYEITDLVMLLYHQPAVIKNFFRDGTDFGVKITYVTPLQDMGTAGAVKCAEKYLDERFIVISGDLLTDFNLQKIIDFHEEKEALATITLTSVKDPLQFGVVITDKEKRISQFLEKPGWGEVISDTINTGIYVLEPEIFSHIPAEENYDFSQDLFPKLLEKQQSLFGYTAKGYWRDIGNTDSYREAHHDIFKGKVNVRIDEPKQDLVGKDLRLGSDVNLDEHVTLEGTVVIGDNSQVFESAHIKDTVIGRNCTIEAGVRLSRCVIWDNVYVKRGAKLNDSVLCGNVRVGNGVVMEEGVIVADDTSIGEESYIKRDVKIWPRKVIEAGATVTGNLIWGEKWKKALFEGALIKGLTNMELTPEFVAKLGCAYGTTLPKGSFVISGRDAYRSSRMLKRSFIGGLLSSGVNVRDLTMVPMPVLRYKLRSFGEVGGIQFRQALDDPASTEIIFLDGDGLDFSSSMGKNVERIFFKENFRRAHHTEPGGLTEIPQQVMDFYREGFLHAIGKTPLQKKAFKVVIDFNHSPASQLLPGILTQMGCEVISLNAYVDEERGVQALSDRGQSLSQLSKIVATLEANAGFWLDPTVEGVIMVDETGTVHEGADILLLMVGLALKAGEKGVFAIPVSAPSAIERMAQERGCAVTRTKSADRSMIEAALSSEVILAGSMDGRFAFPRFQAAFDGMFAIAKSIEMAARSGASISATAAEIPRRAFLHTRVPCVWDMKGGIMRKMSEDSLDKEASFIDGIKVHFGEDWALVLPDQYQPHVHIVAEARDPKAAQKLLTEYQKKVEQWKKELS

SEQ ID NO: 14578 - DNA, 1930 bp, Oryza sativa
  CDS (136)..(1680)
gaagctaccccactagacaatctgtccactcaccactggcctcacttccttgatctcttctcgtcttctccaccccgcacgcggccacccccgcagggaccccgtgacccgcgcccgcgcccgcgcctcaccgcaatggcgatggcggcagccatgggcgtggcctccccctaccacgccgcccacgccgccgcatccacatcgtgcgactcgctccgcctcctcgtcgcggaaggccggccgcggcggccgcgaggggtggcctcctcctcctcctcctcctcttcggcggggaggcggaggcggccgctcgtcttctccccgcgcgcggtgtccgactccaagagctcgcagacctgcctcgacccggacgccagcacgagtgtgcttggaatcattcttggaggtggtgcagggactagattgtatcccctcaccaagaagcgtgccaagcctgccgtgcctctgggtgccaactacaggcttattgatatccctgtcagcaactgtttgaacagcaacatatccaagatctatgtgctgacacaattcaactctgcctctctgaaccgtcacctgtcaagagcctatgggaacaacattggcgggtacaagaatgaagggttcgttgaagtcctcgctgcacagcagagcccagataatcctaactggtttcagggtactgcagatgctgtaagacagtacttatggctatttgaggagcataatgttatggagtttctaattctggctggagatcacctttaccgcatggactatgaaaagttcattcaggcacacagagaaacagattctgatattactgttgctgccctgccaatggatgagaaacgtgcaactgcattcggcctcatgaaaattgacgaggaagggagaatagttgaatttgcagagaaaccaaaaggagaacaattgaaagcaatgatggttgacactaccatacttggccttgacgacgtgagggcaaaagaaatgccttatattgctagcatgggtatctatgtgattagtaaaaatgtaatgcttcagctcctccgtgaacaatttcctggagctaatgactttggaagtgaagtcattccaggtgcaacaaacatcggaatgagggtacaagcttacttgtatgatggttactgggaagacattggtaccattgaggcattctataatgcaaatctgggaataacgaaaaagcctgtaccagatttcagtttctatgaccggtctgctccaatttatacacaacctcgacacttgcctccttcgaaggttcttgatgctgatgtgacagacagtgtcattggtgaaggttgtgttattaaaaactgtaagatacaccattcagtagtgggactccggtcctgcatttctgaaggcgcaataatagaggactcattactcatgggagctgactactacgagactgaagcagacaagaaactccttggtgaaaaaggtggcattcccattggtattgggaagaattgccacattagaagggcaatcatcgacaagaatgctcgtattggagataatgtgaagataatcaatgttgacaatgtccaagaagctgcaagagagactgatggatactttatcaaaagtggcattgttaccgtgatcaaggatgctttgctccctagcggaacagttatatgaagtagctgcgtaatatgtgatggggcatcggcgacgagcaccaggcgggcattataagaagaataaaagcagttcaaggcactttattccctttttttttcttctgttcttcctctattgtgttaggataaatgaatggtagaagcaactgtttttcagatgttttgggagtgaatgataccgtgcttgaattttccatgttttgctttgcctctgcttgaaaatgaatccagcaatcccatgtgtttct

SEQ ID NO: 14579 - protein, 514 aa, Oryza sativa
MAMAAAMGVASPYHAAHAAASTSCDSLRLLVAEGRPRRPRGVASSSSSSSSAGRRRRPLVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 14580 - DNA, 1215 bp, Vibrio vulnificus
  CDS (1)..(1215)
atgcaggacattttgacagtgatactggccggaggcatgggatcacgactcagtccattaacggatgacagagcaaaacccgcggtgccatttggtggaaaataccgcattatcgatttcacgcttaccaactgcttgcactccggcctgcgtaaaattctcgtcctcacccagtacaaatcgcattcgttgcaaaaacatcttcgtgatggttggtctattttcaatcctgaactgggcgaatacatcacctccgtaccacctcaaatgcgcaaaggtggcaaatggtacgaaggcacagccgatgccatctatcacaacttgtggttgctcgaacgcagtgaagccaagtacgtcatggtgttatccggtgaccacatctaccgaatggactacgcaccgatgctggaggaacacatcgccaataatgcggcgctgacggtcgcttgcatggatgtgaattgtaaagaagccaaagcctttggtgtcatgggcattgatgagcaccatcgcgttcattcgtttgtcgagaaaccgcagaatccaccccatttacccaatgatcccgagcgaagcttggtctcgatggggatttacatattcagtatggaggtgttgcagcaagcactgatagaagacgccgacaatgacgcgtcatcccatgattttggtaaagatatcattcctaagctcatcgatactgggtctgtgtttgcctacaagttctgcggtagtaaagggcgggtcgataaagattgctattggcgcgacgtaggcaccattgattcattttatcaggcaaacatggaccttttagagccgattcctccgatgaacctttaccaaaaagactgggggatccgtacctatgaaccccaatatccaccagcaagaaccgtttcatcaggttcaggaaatgaaggtattttcattaactcaatgatttcaaacggtgtgattaattcggggggatccgtgcagcactccattgtttcttcgaatgtcagaatcaacgacagtgcgacaattgtggatagtattatttttgacgatgttgaaattggtgaaggatgccagttggtcaactgcatcatcgacaaacatgtcaaagtcccgccctacactcaaattggcttgaaccgattagaagacgcgcaacgtttcaaaatttcagagaatggcattgttgttgtacctgaaagctatcaattctaa

SEQ ID NO: 14581 - protein, 404 aa, Vibrio vulnificus
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDEHHRVHSFVEKPQNPPHLPNDPERSLVSMGIYIFSMEVLQQALIEDADNDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSMISNGVINSGGSVQHSIVSSNVRINDSATIVDSIIFDDVEIGEGCQLVNCIIDKHVKVPPYTQIGLNRLEDAQRFKISENGIVVVPESYQF

SEQ ID NO: 14582 - DNA, 1287 bp, Gloeobacter violaceus PCC 7421
  CDS (1)..(1287)
atgcggcaggtgacggcgatcatattggggggtgggcgcggcacccgcctgtatccactgaccaaacgccgggccaaaccggcggtgcccatcggcggcaagtaccgcctcatcgacattccggtcagtaactgcatcaattcgggcatccagcacatctacatcctcacgcagttcaattccgcctccctgaaccgccacgtctcccagacctaccagttctcgcgcttcagcgacggcttctgtgagatcctggccgccgagcagaccgacgagaaccccaactggtttcaaggcaccgccgacgcggtgcgccagtacctgtggctgcttgaacccagcggttcgaccgagtatttgattctttcgggcgatcacctctaccggatggattacagcaagttcgtccgccgccaccgcgagaccaacgccgatgtgacgattgccgtgctgccctgcgaccttgagcgcgcgagcgacttcggcctgatcaaaaccgacgccgacggccgggtggtgcagtttaccgaaaaaccgaaaggggccgagcttgagcgcatgcgcgtcgacaccaccaccctggggctcaccctcgaagaagccgagcgccgccccttcgtcgcctcgatggggatctacgtctttcgccacgatgtgatgctcaagctgttgcgcgacgacccaagccgcaccgacttcggcaaagaaatcctgcccgcctgcctcgacgattacaacgtgcaggcgtacctgttcgacgattactgggaagatatcgggaccatcgaggcgttctacaaggcgaatctggccctcaccagccagaacgcgccgcccttcagtttctaccacccggcgccgatttatacccggccgcgctatttgccccccagcaagctcatcgactgccagatagccgaatcgatcatcaccgagggctgcatcatcaagcaggcgcgcatcttccactcggtattgggtctgcgctcgcgcatcgagtcgggggtgcgcatcgaagattcgctattgatgggagccgatttttacgagacgcccatccagcgcgaggagtcgctgcgccgcggcctgccgccggtgggcatcggcgagcgctgcgtgctgcaaaaggcgatcatcgacaagaacgcccgcatcggcaacgacgtgcgcatcctcaacaaggagcggcccgactcggcggaccaccccgagcggggcttctacatccgccacggcatcgtcatcgtccccaaggacaccgtcatccccgacggcaccgtgatctag

SEQ ID NO: 14583 - protein, 428 aa, Gloeobacter violaceus PCC 7421
MRQVTAIILGGGRGTRLYPLTKRRAKPAVPIGGKYRLIDIPVSNCINSGIQHIYILTQFNSASLNRHVSQTYQFSRFSDGFCEILAAEQTDENPNWFQGTADAVRQYLWLLEPSGSTEYLILSGDHLYRMDYSKFVRRHRETNADVTIAVLPCDLERASDFGLIKTDADGRVVQFTEKPKGAELERMRVDTTTLGLTLEEAERRPFVASMGIYVFRHDVMLKLLRDDPSRTDFGKEILPACLDDYNVQAYLFDDYWEDIGTIEAFYKANLALTSQNAPPFSFYHPAPIYTRPRYLPPSKLIDCQIAESIITEGCIIKQARIFHSVLGLRSRIESGVRIEDSLLMGADFYETPIQREESLRRGLPPVGIGERCVLQKAIIDKNARIGNDVRILNKERPDSADHPERGFYIRHGIVIVPKDTVIPDGTVI

SEQ ID NO: 14584 - DNA, 984 bp, Gloeobacter violaceus PCC 7421
  CDS (1)..(984)
atgaaagcattcgtgctcgccgccggcaagggtacgcgcctgcgccccttcaccgacgccctgcccaagccgctgatgcccgtgatgaacaagcccgtcatggcccacatcctgggactgtgccgcaagcacggcctcgaccaggtcgttgcgaacctgcactacaaaggcgaaaagatcagcgagtatttcggcaacggctcccaataccaggtgtcgctgggctactcccgcgaggagcaactgttgggcaccgcgggcggtgtgcgccgccaggcggactttttggccggcggcccctttctggtcatctccggcgacgtgatgaccgatttggatctgaccgccctgctgcagttccacaaacaatccggcgccgtggccaccatggccgtcaaagaagtcggagacccgagccgcttcggggttgtggtgagcgacagtcacggcaaagtcgaaagtttccaagaaaaacccatccggggcaccgagcgctcgcggtgggccaacaccggcatctatgtgctggagccggaggtgttcaattacatccccgaggcgaccttcttcgacttcggcaacgacctgtttccgatgctggtggccgagggagcaccggtctttgcgatgcgcacaggagcctactggtcggatgtcggtaccctggcgcagtatctgtacacgcactgggaattgttgacccatcccgagattgtccagcgcatcggcgaagggacggtcgtcgaaccgggggcggtgatctccgaccaggcgctcatcggccgccactgcaccatcgaaaaaggggcgcgggtgctgggctacagctgcgtgagcgacgggtgcgtgattcgtgccggctcggtcgtggtcgacagtgtgatgtggacgagtgagcagctgggcgagcggctcagcggcgacctggtgcgctcgatctggggcgacggcaagcacgtctgcctcggcatccccaacctctag

SEQ ID NO: 14585 - protein, 327 aa, Gloeobacter violaceus PCC 7421
MKAFVLAAGKGTRLRPFTDALPKPLMPVMNKPVMAHILGLCRKHGLDQVVANLHYKGEKISEYFGNGSQYQVSLGYSREEQLLGTAGGVRRQADFLAGGPFLVISGDVMTDLDLTALLQFHKQSGAVATMAVKEVGDPSRFGVVVSDSHGKVESFQEKPIRGTERSRWANTGIYVLEPEVFNYIPEATFFDFGNDLFPMLVAEGAPVFAMRTGAYWSDVGTLAQYLYTHWELLTHPEIVQRIGEGTVVEPGAVISDQALIGRHCTIEKGARVLGYSCVSDGCVIRAGSVVVDSVMWTSEQLGERLSGDLVRSIWGDGKHVCLGIPNL

SEQ ID NO: 14586 - DNA, 972 bp, Gloeobacter violaceus PCC 7421
  CDS (1)..(972)
atgaaagccttcatcctggcggcgggcaagggaacccgcctgcgtccgctcaccaacctggtgcccaaacccctggtccctgtactgaatcggccggtgatgggtcgcatgctcgatctgtgccgcgagcacggtttttgtgaagcgatggccaacttgcactatcagggcgaaaagatcgagcgggcctttggcagtggctacgagtacggcgtcgatctcgcttactcccacgagacgcagctgttgggcaccgcgggcggggtgcgccgccaggcggcttacctgcagggcggcaccttcgtggtcacctcggcggacgtggtgaccgatctcgatttttccgaactgttggcttttcaccgcacccggggggcgctggccaccatcgccaccaccgtcgtgagcgacccgtcgcgctttggggtgctggtgtgcgacccggacgggcgcgtgcgctcctttcaagaaaaacccgcccccggcaccgcgcgctcgaatctggtcaacatgggcatctacatgctcgaaccggaaatttttgacttcattcccgccgcagaagaattcgacttcggctcgcaactgtttccgatgctggtggctaaaggggcgcccatctacgcgctggagaccaaagcctactggtcggacatcggcaccctcagccagtacctgcacacccactgggatctgttgagccaaccggggctgcagtcgcgcatcggccgccacacggtcatcgagccgggggcgcgcatctcgcccactgccctggtgggggatcactgctacatccactccaccgccatcatcgagggcaactcctgcatcggcgacggcaccatcctcaatcacggcgcccgggtgctcgactcggtggtctggtcggcggcagcctttcgcctgagcgtcgccgatacggtcgtgcgctcggtgcgcgccgacgattgctgcatcgccattagttag

SEQ ID NO: 14587 - protein, 323 aa, Gloeobacter violaceus PCC 7421
MKAFILAAGKGTRLRPLTNLVPKPLVPVLNRPVMGRMLDLCREHGFCEAMANLHYQGEKIERAFGSGYEYGVDLAYSHETQLLGTAGGVRRQAAYLQGGTFVVTSADVVTDLDFSELLAFHRTRGALATIATTVVSDPSRFGVLVCDPDGRVRSFQEKPAPGTARSNLVNMGIYMLEPEIFDFIPAAEEFDFGSQLFPMLVAKGAPIYALETKAYWSDIGTLSQYLHTHWDLLSQPGLQSRIGRHTVIEPGARISPTALVGDHCYIHSTAIIEGNSCIGDGTILNHGARVLDSVVWSAAAFRLSVADTVVRSVRADDCCIAIS

SEQ ID NO: 14588 - DNA, 984 bp, Gloeobacter violaceus PCC 7421
  CDS (1)..(984)
atgaaagcatttgtgcttgccgccggcaaaggcacccgcctgcgccccttcaccgacgccctccctaaacccctgatgcccgtcatcaacaaaccggtcatggcccacatcctcgggctgtgccgcaagcacggcttcgacgagatcgtcgccaacctccactaccgcggtgaaaaaatcgtcgagcgcttcgcggacggacacgaccatggtgtctgcctgcagtactcctgggaagaacagctcctcggcaccgccggcggcgtgcgcaggcaggcgggctttttggccggcggcccctttttggtcatctctggcgacgtgatgaccgacttggacctgggcgccctggtgcgcttccacaaacaatccggcgctgtcgccaccatggcggtcaaagaagtcggcgacccgagccgtttcggcgtcgtggtcgcggaccccgacggccgtgtgcgcagctttcaggaaaaaccggccaaaggcaccgagcgctcgcgcctggcgaatacgggcatctacgtgttggagccggaggtgttcgagtacatccccgaggcggcctttttcgatttcggcaacgacctgtttccgctgctggtctgcaagggggctccggtctatgcgatgggcacgggggcgtactggtcggatgtcgggacgctctcgcagtatctgtacacgcactgggagctgttgacccatccggagatcgcccagcgcatcggcgaagggacggtggtgcaagccggggcggtggtctccgaacaggccctgataggctccggctgcacgatcgagaagggtgcgcgggtgctggggtatagctgcgtgagcgacgggtgcacgatccgcgcggacagcgtggtggtggacagtgtggtgtggacgagcgagcggtggggacacaagctcaaaggcgacctggtgcgttcgatctggggcgacgggatgcaggtctcactcggactgcccaatctctaa

SEQ ID NO: 14589 - protein, 327 aa, Gloeobacter violaceus PCC 7421
MKAFVLAAGKGTRLRPFTDALPKPLMPVINKPVMAHILGLCRKHGFDEIVANLHYRGEKIVERFADGHDHGVCLQYSWEEQLLGTAGGVRRQAGFLAGGPFLVISGDVMTDLDLGALVRFHKQSGAVATMAVKEVGDPSRFGVVVADPDGRVRSFQEKPAKGTERSRLANTGIYVLEPEVFEYIPEAAFFDFGNDLFPLLVCKGAPVYAMGTGAYWSDVGTLSQYLYTHWELLTHPEIAQRIGEGTVVQAGAVVSEQALIGSGCTIEKGARVLGYSCVSDGCTIRADSVVVDSVVWTSERWGHKLKGDLVRSIWGDGMQVSLGLPNL

SEQ ID NO: 14590 - DNA, 984 bp, Gloeobacter violaceus PCC 7421
  CDS (1)..(984)
atgaaagcatttgtgctcgccgccggcaaaggcacccgcctgcgccccttcaccgacgccctccctaaacccctgatgcccgtcgtcaacaaaccggtcatgacccacatcttggccctgtgccgcaaacacggcttcgaccagatcgtcgccaacctccactaccgcggtgaaaaaatcgccgagcgcttcgcggacggacaccgccacggcgtcgagctgcgctactcctgggaagaacaactcctcggcaccgccggcggcgtgcgcaggcaggcggactttttggccggcgacgcctttttggttatctccggcgacgtgatgaccgatttggacctgggcgccctggtgcgcttccacaagcaatccggcgccgtcgccaccatggccgtcaaagaagtcggcgacccgagccgcttcggcgtcgtcctcaccgaccccgacggccgcgtcgagagctttcaagaaaagcccgccaagggcagcgagcgctcgcgtctggcgaacacgggcatctacgtgctggagcctgaggtgttcgagcacatccccgaggcggcctttttcgatttcggcaacgacctgtttccgctgctggtctctaagggagcaccggtatatgcaatgcgcacgggggcgtactggtcggatgtcgggacgctctcgcagtatctgtacacgcactgggagttgttgacccatcccgaattgaagcagcgggtgggggcgaacacggtggtcgagtccggggcggtggtctccgaacaggctctgatcggttccgggtgcacgatcgagaagggtgcgcgggtactggggtacagctgcgtgagcgacgggtgcacgatccgcgcgggcagcgtggtggtggacagcgtggtgtggacgagcgcgcggtggggccacaagctcaagggcgacctggtgcgttcgatctggggcgacgggatgcaggtctcactcggactgcccaatctctag

SEQ ID NO: 14591 - protein, 327 aa, Gloeobacter violaceus PCC 7421
MKAFVLAAGKGTRLRPFTDALPKPLMPVVNKPVMTHILALCRKHGFDQIVANLHYRGEKIAERFADGHRHGVELRYSWEEQLLGTAGGVRRQADFLAGDAFLVISGDVMTDLDLGALVRFHKQSGAVATMAVKEVGDPSRFGVVLTDPDGRVESFQEKPAKGSERSRLANTGIYVLEPEVFEHIPEAAFFDFGNDLFPLLVSKGAPVYAMRTGAYWSDVGTLSQYLYTHWELLTHPELKQRVGANTVVESGAVVSEQALIGSGCTIEKGARVLGYSCVSDGCTIRAGSVVVDSVVWTSARWGHKLKGDLVRSIWGDGMQVSLGLPNL

SEQ ID NO: 14592 - DNA, 1296 bp, Synechococcus sp
  CDS (1)..(1296)
atgaagcgggttttggccatcattctcggcggcggtgccgggactcgtctctacccgctcaccaagatgcgcgccaagccggccgtccccttggccggtaagtatcgactgattgatatccccatcagcaactgcatcaactcgaacatcaacaagatgtacgtgatgacgcagttcaacagtgcgtctctcaatcgtcacctcagccagacgttcaacctgagcgcatccttcggtcagggattcgtcgaggtgcttgctgcccagcagacgcctgacagtccatcctggtttgaaggcactgccgacgctgtgcggaagtaccagtggctgttccaggaatgggatgtcgatgaatacctgatcctgtccggtgaccagctgtaccggatggattacagcctgttcgttgaacatcaccgcagcactggtgctgacctcaccgttgcagcccttcctgtggacccgaaacaggccgaggcgttcggcttgatgcgcacggatggtgacggagacatcaaggagttccgcgaaaagcccaagggtgattctttgcttgagatggcggttgacaccagccgatttggactcagtgcgaattcggccaaggagcgtccctacctggcgtcgatggggatttatgtcttcagcagagacactctgttcgacctgctcgattccaatcctggttataaggacttcggcaaggaagtcattcctgaggccctcaagcgtggcgacaagctgaagagctatgtctttgacgattattgggaagatatcggaacgatcggagcgttctacgaggccaacctggcgctcacccagcaacccacaccccccttcagcttctacgacgagaagttcccgatctacactcgtccccgctatttacccccgagcaaactggttgatgctcagatcaccaattcgatcgttggcgaaggctcaattttgaagtcatgcagcattcatcactgcgttttgggtgttcgcagtcgcattgaaaccgatgtggtgctgcaagacaccttggtgatgggcgctgacttctttgaatccagtgatgagcgtgccgtgcttcgcgagcgtggtggtattccggtcggggtgggccaaggtacgactgtgaagcgcgccatcctcgataaaaacgctcgcatcggatccaacgtcaccatcgtcaacaaggatcacgtcgaggaagctgatcgttccgatcagggcttctatattcgtaatggcattgttgttgttgtcaagaacgccaccatccaggacggaactgtgatctga

SEQ ID NO: 14593 - protein, 431 aa, Synechococcus sp
MKRVLAIILGGGAGTRLYPLTKMRAKPAVPLAGKYRLIDIPISNCINSNINKMYVMTQFNSASLNRHLSQTFNLSASFGQGFVEVLAAQQTPDSPSWFEGTADAVRKYQWLFQEWDVDEYLILSGDQLYRMDYSLFVEHHRSTGADLTVAALPVDPKQAEAFGLMRTDGDGDIKEFREKPKGDSLLEMAVDTSRFGLSANSAKERPYLASMGIYVFSRDTLFDLLDSNPGYKDFGKEVIPEALKRGDKLKSYVFDDYWEDIGTIGAFYEANLALTQQPTPPFSFYDEKFPIYTRPRYLPPSKLVDAQITNSIVGEGSILKSCSIHHCVLGVRSRIETDVVLQDTLVMGADFFESSDERAVLRERGGIPVGVGQGTTVKRAILDKNARIGSNVTIVNKDHVEEADRSDQGFYIRNGIVVVVKNATIQDGTVI

SEQ ID NO: 14594 - DNA, 1290 bp, Rhodopirellula baltica
  CDS (1)..(1290)
atgatcatggacttgaacaatacaatcgcgttgattcttggcggtggccgcggaactcgattgttcccgctcacaaagatccgcgccaaacccgctgtgcccttggctgcgaagtatcggttgatcgacattccgatcagcaactgcatcaatagcggcctgaatcgcgcttatgtattgacgcaatttttgtcagagagtcttcaccgtcaccttcggcagacgtacacgtttgaccacttcagcggtggcttcgttgaactgttggccgctcagcaaacggtcaattccggcaccgattggtaccaaggcaccgccgacgcggtccgcaaaaacttggtccatttgcgtgagagctggatcaagcacgtgttgatcctttcgggcgatcagctgtaccgaatggattttcgcgacatgatgaagactcacattgagtccggagccgcagcgaccatcgccggcatccctgtgactcgaaaagacgcttcggcgttggggatcatgcaagtcgacgataccggacgcgtgaccggcttcgtcgaaaagccgcaaacggaagaagagatcgcgaaggttcgcatggaacccagctggatcgacgctcgcggcatcgaaagccaaggacgtgatttgttagccagcatggggctgtatattttcgacaaagacctgatggtcgacatgctcgagaacagcctgcacagcgacttcgggaaagaggttttccccgaagctatcaacactcacaaggttcagttgcacctgtttgatgggtactgggaagacatcggaaccatccgatcgttctacgaagcgaacctatcgctcgctagcaagaacccaccgtttgatattcgcaaccgccattcgccaatctacagtcggccacgctttttgccgccgacgatcatgggcgatgccaagatcacgggcagtttgatcgcggatggctgccgaattggcgacaatgtcacgatcgaaaacagcgtcattggtctgagaaccgtgatcggcgacaacgtaacgatcaaggacagcgttgtgatgggagctgactttatcgagatgcgcggcgctgaacgcgacggcaaattgccggttggcgtcggtgcgggaagcgtgatccagggtgcaattctggacaagaattgccgcgttggcgaaaacgttcggatcttgaacgaagccaaggttgatcatcaaggtgaagacgatgacctgcaaattcgcgatggtatcagcatcgtgatcaaagacggtcagatccctgacggtttcagctgctag

SEQ ID NO: 14595 - protein, 429 aa, Rhodopirellula baltica
MIMDLNNTIALILGGGRGTRLFPLTKIRAKPAVPLAAKYRLIDIPISNCINSGLNRAYVLTQFLSESLHRHLRQTYTFDHFSGGFVELLAAQQTVNSGTDWYQGTADAVRKNLVHLRESWIKHVLILSGDQLYRMDFRDMMKTHIESGAAATIAGIPVTRKDASALGIMQVDDTGRVTGFVEKPQTEEEIAKVRMEPSWIDARGIESQGRDLLASMGLYIFDKDLMVDMLENSLHSDFGKEVFPEAINTHKVQLHLFDGYWEDIGTIRSFYEANLSLASKNPPFDIRNRHSPIYSRPRFLPPTIMGDAKITGSLIADGCRIGDNVTIENSVIGLRTVIGDNVTIKDSVVMGADFIEMRGAERDGKLPVGVGAGSVIQGAILDKNCRVGENVRILNEAKVDHQGEDDDLQIRDGISIVIKDGQIPDGFSC

SEQ ID NO: 14596 - DNA, 1341 bp, Rhodopirellula baltica
  CDS (1)..(1341)
atgcagcctgaacatgttgcgggtgccaacatgcccaacgcggtaggaaaccacgatccaatgatgcgacaaacagtaacggtgattctggccggaggtcgtggttcacgactcgaaccactcacacgggatcgcgcgaagccagcggtccccattggtggtgcctaccgcatcatcgacttcgtgctgagtaattgcttgaacagcgatatgcggcgattgttgctgctgacgcagtacaaagctcaatcgctggaccggcacatcaatgtggcgtggcggaactacttctgccgcgaattgggcgaattcatcgacgttgtgccgccgcaacaacgcatcgatgacaattggtaccaaggcaccgccgacgcggtttaccaaaacatttacgcaatcgaacgtgaagctcccgagtacgtggtgattttggcaggtgaccacctgtacaagatgaactacgaatcgatggtcaatttccatcatcgcaaaggtgctgatgtcacagtgggcgctttgcgtgtcagccgtgaagaagcgagacagttcggcgtgatgcaggtcgacaccgacaatcggttggtggaattccaggaaaaaccagaaaacccgcgtccaacgctcgacgatcccgacgtctgtttggcatcgatgggcatctacgtcttcaacacccgattcttgttcgagcgtttgtgtgacgacgcgactcaaccggacagcgatcacgactttgggaaaaacatcatccccggtgcgatcgaagacagccaagttttcgcgttccccttcaccgatgaaaatcgcaaacgagatgcgtattggcgtgacgtcggtacgctggaagcctactacgaagccaacatggacttggtcggcgttgatccacagttgaacctttacgaccgacagtggccgattcgctccttccaaccacaactgccaccgccaaagtttgtctttggaagcgaaggtcgatcgtcacgccgaggcgaagcactcgattcgatcgtctgccaaggtgcaatcatcagcggcggctgcgtccgacgaagcgtcatcggcaccggctgccgcatcaacagctacgctcaagttgaagacagcattctttttgatgatgtcaacgttggacgacacagtcgcattcgacgtgcaatcattgacaaaggagttcaaatcccaccagaaacggaaattggatatgatctggcactggatcgtgctcgtgggctaacagtgaccgatagtggactcgttgtgattgcgcgcggcgagatgatcgcttcgccggtgtccaccaatggatcgcacgatccaacatctagcctgacttcctaa

SEQ ID NO: 14597 - protein, 446 aa, Rhodopirellula baltica
MQPEHVAGANMPNAVGNHDPMMRQTVTVILAGGRGSRLEPLTRDRAKPAVPIGGAYRIIDFVLSNCLNSDMRRLLLLTQYKAQSLDRHINVAWRNYFCRELGEFIDVVPPQQRIDDNWYQGTADAVYQNIYAIEREAPEYVVILAGDHLYKMNYESMVNFHHRKGADVTVGALRVSREEARQFGVMQVDTDNRLVEFQEKPENPRPTLDDPDVCLASMGIYVFNTRFLFERLCDDATQPDSDHDFGKNIIPGAIEDSQVFAFPFTDENRKRDAYWRDVGTLEAYYEANMDLVGVDPQLNLYDRQWPIRSFQPQLPPPKFVFGSEGRSSRRGEALDSIVCQGAIISGGCVRRSVIGTGCRINSYAQVEDSILFDDVNVGRHSRIRRAIIDKGVQIPPETEIGYDLALDRARGLTVTDSGLVVIARGEMIASPVSTNGSHDPTSSLTS

SEQ ID NO: 14598 - DNA, 1296 bp, Prochlorococcus marinus subsp
  CDS (1)..(1296)
atgaagcgtgtgttggcaatcatcctcggaggaggaaaaggttctaggctttatcccttaacaaaaatgagggctaaacctgcagttcctttagcaggtaaatatcgtttaattgatatcccaattagtaattgtattaattctgggattaataaaatgtacgttttaactcagtttaatagtgcttctcttaacagacatattgggagaacctacaatttaagtgctccttttgggcaaggatttgtggaggtactagctgctcagcaaactcctgatagtccaaagtggtttgaaggtactgctgatgcagtaagaaaatatcaatggttgtttcaagagtgggatgtggacgaatatttaatattgtcgggtgatcagctctatagaatggactatagtttatttgttcaacaccatagagataataaagctgatttaacagtagctgccttacctgttgatgaatctcaggctgaaggttttgggcttatgagaacagatgatttgggtaatattaaagaatttagtgaaaagccaactggtgagaaattaaaatcaatggcggttgatacctctaagttcggtttaaccaaggaatcggcatcagagaaaccgtatcttgcctctatgggcatttatgttttcagtagaaagacactttttgatctcttaaataagttccctagttatacagattttggtaaagatataatccctgaggcattaagtagaggggatacattaaagagttatgtttttgatgattattgggaagatataggaactataggagcattttttgaatcaaacttagcattaacacaacaaccaaaacctccgtttagtttttatgatgaaaaatttcctatatatactaggcctagatatcttcctccatcaaaacttgtagatgctcaaattactgattcaatagtttgtgaaggaactattttgaaatcttgtagcatcttgcattgtgtcttaggggtgagaagtagaattgaaagtgattctgttattgaagatactcttgtaatgggatctgatttttttgaatcgctagaagagaggattgaattaagaaaaggtggtggtacgcctcttggagtaggagaaggttcaactataaaaagggcaattcttgataagaatgcaagaattggagataatgtggtgatagtaaataaggatagagtagaagaagcagataaaccagatgtaggattttatattagaaatggaattgttgttgtagttaaaaatgcaactattgctaacggaacaattatttaa

SEQ ID NO: 14599 - protein, 431 aa, Prochlorococcus marinus subsp
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNKADLTVAALPVDESQAEGFGLMRTDDLGNIKEFSEKPTGEKLKSMAVDTSKFGLTKESASEKPYLASMGIYVFSRKTLFDLLNKFPSYTDFGKDIIPEALSRGDTLKSYVFDDYWEDIGTIGAFFESNLALTQQPKPPFSFYDEKFPIYTRPRYLPPSKLVDAQITDSIVCEGTILKSCSILHCVLGVRSRIESDSVIEDTLVMGSDFFESLEERIELRKGGGTPLGVGEGSTIKRAILDKNARIGDNVVIVNKDRVEEADKPDVGFYIRNGIVVVVKNATIANGTII

SEQ ID NO: 14600 - DNA, 1296 bp, Prochlorococcus marinus
  CDS (1)..(1296)
atgaagcgtgttttggccatcattctcgggggaggagctggaacgcgcctctaccccctcaccaagatgcgggccaagccggccgtacctcttgcaggcaaatatcgtctgattgacatcccaatcagcaactgcattaactccagcatcaacaagatgtatgtgttgacgcagttcaacagcgcttctctgaatcggcaccttggacagagctacaacctcagtgctgcctttggtcaaggttttgtagaagttcttgccgcacagcagaccccagaaagtccttcatggtttgaggggactgcggatgcagttcgtaaatatcagtggttgtttcaggaatgggatgtcgatgaatatctgatcctctctggtgatcagctctaccgtatggattacagcctttttgtggagcaccatcgtcgctcaggtgctgatctcacagtggcggctcttcccgttgatgcagaacaggctgagggatttggtctcatgcgaacggatagcgatggcaacatccaagagttccgtgaaaagcccaagggtgaatccctcaaggccatggccgtcgatacctctcgatttggcttgtcagctgagtcagcaaggaacaagccctatctcgcctcaatggggatctatgtgttcagtcgcgccactctcttcgatttgctgcataagaacccttctcacaaggatttcggcaaggaggtgattcctgaggccctagctcgaggtgaccggcttcaaagctatgtgttcgatgagtactgggaagacatcggcacgataggagctttttatgaggcaaatttggctctcacccagcagcccaatccacctttcagtttctatgacgagaagttcccgatctatacaagaccccgttatctaccgccaacaaaactggtcgatgcgcaaatcacggaatcaattattggagagggatccatcctcaaatcctgcagtattcatcattgcgtccttggtgtgcgaagccgagttgagagcgatgtggtcctgcaagattccctggtgatgggctctgatttctatgaatcatccgaggaacgcactcttctaaggcaaggaggaggcatcccgctcggcgttggccaaggcaccaccgtgaagggtgcgatcctcgacaagaacacacgcatcggcaacaacgtcacgatcgtcaacaaggatcacgttgaggaagccgatcgtgctgatgagggcttctacatccgcaatgggatcgtggtagtggtcaaaaatgccaccatttctgatggcaccgtgatttga

SEQ ID NO: 14601 - protein, 431 aa, Prochlorococcus marinus
MKRVLAIILGGGAGTRLYPLTKMRAKPAVPLAGKYRLIDIPISNCINSSINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESARNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGQGTTVKGAILDKNTRIGNNVTIVNKDHVEEADRADEGFYIRNGIVVVVKNATISDGTVI

SEQ ID NO: 14602 - DNA, 1296 bp, Prochlorococcus marinus
  CDS (1)..(1296)
atgaagagagtactggcgatcattcttggggggggcaaaggttcccgcctttatcccttaactaaaatgagggctaaacctgctgtacctttagcgggcaaatatcgcttgatagatattccaataagcaattgtattaattcgaatatcaccaagatgtacgtcttgactcagttcaacagtgcttctcttaataggcatcttgctcagacatataatcttagttctccttttgcgcaaggttttgtagaagttttagccgcgcaacagactcccgaaagtccttcatggtttgaaggcacagccgatgctgtaaggaaatatcaatggttatttcaagagtgggatgttgatgagtatctaatactttctggtgatcaactttatcggatggattacagtttattcgtagagcatcatcgtgaaacaggcgcagatttaacagttgcagcacttccagtagatggagcacaggcagagggttttgggttaatgcgaactgacaatgatggaaacataagagagtttaaggagaaaccctctggagaagctcttaaagcaatggctgtagatacttcacgttttggactttctccagattctgcaaaagaaagaccatatcttgcttctatgggtatttatgtctttagccgctctacgctttttgatttacttaataagtacccatcttataaagactttgggaaggaagttatcccagaagccttaagtaggggtgatgctctaaaaagctatgtttttgatgcttattgggaagatattgggactattggagccttctatgaatctaatttggctttaactcaacagccgacgcctcctttcagtttctatgatgaaaaattccctatatatactcgggcaagatatttacctccttcaaaattagttgatgctcaaataacagattccattgtgggagaaggatctattctcaaatcttgcagtattcatcattgcgttttaggcgttagaagcagaattgagagtgatgtagttctcgaagattcacttgttatgggttcagatttctatgaatcagctgaagaaagaattgctttaagaaaaggaggtggaattcctcttggagtaggtcagggaacgaccgtcaaaagggcgattttggataagaatacacgaattggagagaatgtcacaatcataaataaagatcgcattgaggaagctgatcgagctgatcagggcttctatattcgcaatggaatagttgttgttgttaaaaacgccagcattcttgatggaacgattatctag

SEQ ID NO: 14603 - protein, 431 aa, Prochlorococcus marinus
MKRVLAIILGGGKGSRLYPLTKMRAKPAVPLAGKYRLIDIPISNCINSNITKMYVLTQFNSASLNRHLAQTYNLSSPFAQGFVEVLAAQQTPESPSWFEGTADAVRKYQWLFQEWDVDEYLILSGDQLYRMDYSLFVEHHRETGADLTVAALPVDGAQAEGFGLMRTDNDGNIREFKEKPSGEALKAMAVDTSRFGLSPDSAKERPYLASMGIYVFSRSTLFDLLNKYPSYKDFGKEVIPEALSRGDALKSYVFDAYWEDIGTIGAFYESNLALTQQPTPPFSFYDEKFPIYTRARYLPPSKLVDAQITDSIVGEGSILKSCSIHHCVLGVRSRIESDVVLEDSLVMGSDFYESAEERIALRKGGGIPLGVGQGTTVKRAILDKNTRIGENVTIINKDRIEEADRADQGFYIRNGIVVVVKNASILDGTII

SEQ ID NO: 14604 - DNA, 1065 bp, Streptomyces sp
  CDS (1)..(1065)
atgaaggccctcgtgctgtccggcggagcgggcacccgcctgccccccttcagctactcgatgcccaagcagctcatccccatcgccaacaagcccgtcctcgaacacgtcctggagaacatccgcgcggtgggcatcaccgaggtcggcgtcatcgtcggcgactgggccgacgagatcgcccaggtgatcggcgacggctcccggctggggctgcgcatcaccctgatcccccaggagaagccgctcggcctcgcgcactgcgtcgccctcgcccggcccttcctcggcgacgacgacttcgtgatgtacctcggcgacaacatgctcccgggcgggatcgacacgatcgccgccgacttcaccgcccgacggcccgacgccctggtcgtcgtccacaaggtgcgcgaccccccggccttcggcgtggccgaactcgcccccgacgggagcgtgctgcggctcgtggagaagcccgagcggcccaggagcgacctggccctcatcggcgtgtacttcttcaccgccgccatccacgaggccgtcgccgccatcgagcccggcgcccgcggcgaactggagatcaccgacgccgtccagtggctcgtcgcccacggctcgcacgtcgcggccagcgagtacgacgggtactggaaggacaccggccgggtcgaggaggtcctcgcctgcaaccgggagctgctcggcgaccagacggcccgggtggacggcgaggtcgacgcggccagccgggtgaccggccgcgtcgtgctggaggcgggagcccgcctcgtgcgttccacggtcaccggaccggccgtcatcggcgccggcacggtgatcgaggacagcgcggtcggaccccacacctccatcggccggggctgtctcctgcgcgacacgaccctgaccgactccatcgtcatggacggggcctccatcaccgccgtgaccggcctgcagggctcgctgatcggccgcaacgccgtcgtcggcgccggcgccgagggcgacgggcaccgtctcgtgatcggcgaccacacccgtatcgaggtggcggcatga

SEQ ID NO: 14605 - protein, 354 aa, Streptomyces sp
MKALVLSGGAGTRLPPFSYSMPKQLIPIANKPVLEHVLENIRAVGITEVGVIVGDWADEIAQVIGDGSRLGLRITLIPQEKPLGLAHCVALARPFLGDDDFVMYLGDNMLPGGIDTIAADFTARRPDALVVVHKVRDPPAFGVAELAPDGSVLRLVEKPERPRSDLALIGVYFFTAAIHEAVAAIEPGARGELEITDAVQWLVAHGSHVAASEYDGYWKDTGRVEEVLACNRELLGDQTARVDGEVDAASRVTGRVVLEAGARLVRSTVTGPAVIGAGTVIEDSAVGPHTSIGRGCLLRDTTLTDSIVMDGASITAVTGLQGSLIGRNAVVGAGAEGDGHRLVIGDHTRIEVAA

SEQ ID NO: 14606 - DNA, 2355 bp, Bacillus cereus
  CDS (1)..(2355)
atgaagggggttattttagctggaggaaaaggaaggcgccttagaccattaacatgtaatactccaaagccgatgttaccattattagaaaaaccagttttagaatataatattgagttattacgccagcatggtattcgtgaaattgcaattactgttcaatatatgagtacgaccattaagcaatattttggtgacggtagtaaatggggagttaacttgtattattttgaagactctcctccgcttggcacagcagggagtattaaacaagcagaacaatttttagatgaaacatttgttgtgataagcggggatgcattaactgactttcaattatcagaaggaattaggtttcatgaacaaaagaaaagaatggtaacaatgtttgtgaaagaagtagaaaatccactctcatttggattggttgtaatgaataaagaccaggaggttacacgatatatagaaaagccgggctggaatgaggtagtatctaatgttgtgaatacaggcatatatattatggagccagaaatcttttcttacataccgcctaggcaattttttgatttcagtcatgatgtgtttccgttattggcaaacaaaaatgtgttattcgcatatttgtcagaaggttattggttagatatcggcacatttaatcaatatcgacaagcacaatttgatttgttaacgaaaaagttacaagtacctattccttatacagaagtattaccgatggtatggatgggagaaggggtgacgattggtaaagggacgaaaattcatggcccctcttttattggagaaggagcaaagattggtacaggagctgtaattgagccatattctattattgggaaaaatagtatcgtttcaaattattctcatcttcaaaaaagtattgtttttgcaaatacccacattgggaagtattgtgaactattagaaacgacaataggagagcgtacaatagttgaagatgatgttacactgtttcaaaaaagtgttgtagcggatcactgtcacatcggaagaagtacggtaattaagcaaaaaggaaaactatggccttataaggcgattgatagtcattcgatagtaggagcggctggtattcaagagagtgaaatgagtgcagggtggttacaaaaaagccgcattgtaggaagagggaatgttgaaattactccccagtttatcgtgaagattgcgatggcgtatggttctctttttaaaaaaggagaaagtatattaattggaagtcaagaaaatatagaaacaacctcttataaaaatttatttttacatgctattcatggtatagggattcatacgatggaatgtaaagaaatgaacgagtcactttttcaatatagtgttcatcatttgcaatgtgcaggtggggttttcattcaagtggagaatgagaatgagattgttataaagttgtatggtcaagctggcatgccgttaacgtataagcagcaaaaagagatagaacaagtatatatgtccgaattgttttattacgtgcatgagaaagagatggggcgaaataagctcgttcatgtttctatgaatgagtatatagaagttatattggagcatattgatatcgagaaaatacagatgcagaagtttcatcttcttattaataagagaaatgatacgttgcaacatttactcatgctctttctgcaaagacttggttgtacagttacatggatttatgcaagcgaacaaaaagatcatgtgaaagctttgatgaaatcaagtaaagcgaatatggctcttatgttttctgagcaaggaaatcatttcgagttatacgataaacatagtaatatttaccaaggtacagatttggaagaggtagatattccagatttcttactcgaatcgacaggaaatatttacccaatgtctttgaagttaggagaatgttatcttctattttatacgcaggatgaaagaaagtcgtttcaagtaaggtggaagcgagatattttatatcggattggaaaattattcgagctaatagcattgcaaggaaaaacgtttctcagcatagtagagcaatcacctccgctctatttactttatgatgaagtggtatgttcatggaatgaaaaaggggaaattatgaggaaattattggatgatatagaaaggaagggagaaggtatatttgaaggagtacagttcaaatatactgaaaaagagtggtcttatatcgtttctgacacaaaacaaccaaaatttttggtgtattcacatgctagaaacccagtaatagcaagggaaaatatgaaaaatcttatagaaaaaattagacaatatcaaaaggtgtag

SEQ ID NO: 14607 - protein, 784 aa, Bacillus cereus
MKGVILAGGKGRRLRPLTCNTPKPMLPLLEKPVLEYNIELLRQHGIREIAITVQYMSTTIKQYFGDGSKWGVNLYYFEDSPPLGTAGSIKQAEQFLDETFVVISGDALTDFQLSEGIRFHEQKKRMVTMFVKEVENPLSFGLVVMNKDQEVTRYIEKPGWNEVVSNVVNTGIYIMEPEIFSYIPPRQFFDFSHDVFPLLANKNVLFAYLSEGYWLDIGTFNQYRQAQFDLLTKKLQVPIPYTEVLPMVWMGEGVTIGKGTKIHGPSFIGEGAKIGTGAVIEPYSIIGKNSIVSNYSHLQKSIVFANTHIGKYCELLETTIGERTIVEDDVTLFQKSVVADHCHIGRSTVIKQKGKLWPYKAIDSHSIVGAAGIQESEMSAGWLQKSRIVGRGNVEITPQFIVKIAMAYGSLFKKGESILIGSQENIETTSYKNLFLHAIHGIGIHTMECKEMNESLFQYSVHHLQCAGGVFIQVENENEIVIKLYGQAGMPLTYKQQKEIEQVYMSELFYYVHEKEMGRNKLVHVSMNEYIEVILEHIDIEKIQMQKFHLLINKRNDTLQHLLMLFLQRLGCTVTWIYASEQKDHVKALMKSSKANMALMFSEQGNHFELYDKHSNIYQGTDLEEVDIPDFLLESTGNIYPMSLKLGECYLLFYTQDERKSFQVRWKRDILYRIGKLFELIALQGKTFLSIVEQSPPLYLLYDEVVCSWNEKGEIMRKLLDDIERKGEGIFEGVQFKYTEKEWSYIVSDTKQPKFLVYSHARNPVIARENMKNLIEKIRQYQKV

SEQ ID NO: 14608 - DNA, 1329 bp, Chlamydophila caviae GPIC
  CDS (1)..(1329)
atgatagaaaatgattttcagggctactccccaagttatcaggcttctcatttttatagagataaggttggcgttattgttttatgtggcggtgaagggaaaagattgtcccctttaacctactggcgctgtaaaccaaccgtatcatttggaggaagatataagctcattgatgtacccatttcccatgcaatagcttcaggattttctaagattttcgtaataggtcaataccttacctacacactacaacagcatcttgtgaagacgtatttttatcatggagtacttcaagatcggatacatctccttgctcctgaggggagggagggaagtcaggtatggtatcaaggaaccgccgatgctattcggcagaacctcttgtatttagaagatacagagatagagtattttctagttttatctggcgatcagttatacaacatggattttcgtaaggttgtagactacgctatagctatgcaatctgatatggtaatagtcgcacagcccattcaggaaaaagatgcttcaagaatgggagtgttgcaaatagataaagatgcaaatcttgtagacttttacgaaaaacctcaggaagaagagattttaaatcgttttcggctatcttctgaggattgtcgtaaacataagctggatcctcaatatggaaatttcttagggaatatggggatttatctctttcgaagggaaagcctatttcaactgctactagaagaacaaggggatgattttggaaagcatcttatccaagcccaaaagcaacgcgggtcgataaagactttcctttacgatggctactggacagatatcggaacaatcgaatcttattatgaagcgaatattgctttaacacaaaggcctaaacctcaggttcgtggattgaattgctacgatgatgcaggaatgatctatagtaagaatcatcatcttcctgggactatagttacagattctatgatctccagctctttgctttgtgaaggtgctgttattgattctagtaatgtatcccacagcgttgtggggatccgtggtgtgatagggaaaaattctataatagatcactctattgttatgggaaatgaccgttatggcaatccccaacaaaacgctttagggatcggggataattgtgaaatttataaaacaattatcgatgagaactgtagaatcggtaacggggtaaaactcacgaatatccaagggcataaggattataattctcctgatgggaagcttgtcgttagggatgggattattatcattcctcgaggaactagaattcctgataattataccttctaa

SEQ ID NO: 14609 - protein, 442 aa, Chlamydophila caviae GPIC
MIENDFQGYSPSYQASHFYRDKVGVIVLCGGEGKRLSPLTYWRCKPTVSFGGRYKLIDVPISHAIASGFSKIFVIGQYLTYTLQQHLVKTYFYHGVLQDRIHLLAPEGREGSQVWYQGTADAIRQNLLYLEDTEIEYFLVLSGDQLYNMDFRKVVDYAIAMQSDMVIVAQPIQEKDASRMGVLQIDKDANLVDFYEKPQEEEILNRFRLSSEDCRKHKLDPQYGNFLGNMGIYLFRRESLFQLLLEEQGDDFGKHLIQAQKQRGSIKTFLYDGYWTDIGTIESYYEANIALTQRPKPQVRGLNCYDDAGMIYSKNHHLPGTIVTDSMISSSLLCEGAVIDSSNVSHSVVGIRGVIGKNSIIDHSIVMGNDRYGNPQQNALGIGDNCEIYKTIIDENCRIGNGVKLTNIQGHKDYNSPDGKLVVRDGIIIIPRGTRIPDNYTF

SEQ ID NO: 14610 - DNA, 1221 bp, Streptomyces avermitilis
  CDS (1)..(1221)
atgcggcgcggaggaccttcggtgctgggaatcgtactcgcgggcggcgagggcaaacggctgatgccgctcaccgcggaccgggcgaaaccagccgtgaccttcggcggaacgtatcgcctggtggacttcgtcctgtccaatctcgtgaacgcggacatcctgcggatctgtgtgctgacgcagtacaagtcgcactcgctggaccggcacatcaccacgacctggcggatgtcgagtctgctcggcaactacatcaccccggtgccggcgcagcagcggctgggcccccgctggtacctgggcagcgcggacgcgatcttgcagtcgctgaacctcgtgtacgacgaacggccggagtacatcgcggtgttcggcgccgaccacgtctaccgcatggacccgcggcagatgctcggcgagcacatcgagagcggtgcgggggtgacggtggcggggatacgggtcccgcgcgccgagtcgtcgtcgttcggtgtgatcgcccccggctcggacgggcagaccgtggagaacttcctggagaagccggccgatccaccgggtctgccgggcgaccccgagtgcgtgttcgcctcgatgggcaactacgtcttcaccaccaaggtcctgatcgaggcgctccaacgggacgcggaggacggggactccgtgcacgacatgggcggttcgatcctgcccgcgctcaccgaccggggcgaggcacggttgtacgacttcagcgccaaccacgtccccggcgagaccacccgggaccagggctactggcgggacgtggggacgctggacgcgtactacgacgcccacatggacctgatcgccgagcggcccgcgttcaacctcttcaaccgcagctggccgatctacacccactccggacagctgtcgccggcgcggttcaacgccgggggcatcgccagcgagtcgatcatcagcgcgggctgcctgatccggggccaggtcacccggtcggtgctgtcaccgggggtcgtcgtcgacccgggggccgtcgtccagggctccgtgctgcacgacaacgtgcacgtcgggcggggcgcggtggtccgcggagccgtcctggacaagaacgtcgaggtgccgccgggcgcgacgatcggcgtcaacccggggcgggacgccgacctgtacacggtgtccaagggcggcgtgatcgggctgggcaagggacagcgggtgtcgtag

SEQ ID NO: 14611 - protein, 406 aa, Streptomyces avermitilis
MRRGGPSVLGIVLAGGEGKRLMPLTADRAKPAVTFGGTYRLVDFVLSNLVNADILRICVLTQYKSHSLDRHITTTWRMSSLLGNYITPVPAQQRLGPRWYLGSADAILQSLNLVYDERPEYIAVFGADHVYRMDPRQMLGEHIESGAGVTVAGIRVPRAESSSFGVIAPGSDGQTVENFLEKPADPPGLPGDPECVFASMGNYVFTTKVLIEALQRDAEDGDSVHDMGGSILPALTDRGEARLYDFSANHVPGETTRDQGYWRDVGTLDAYYDAHMDLIAERPAFNLFNRSWPIYTHSGQLSPARFNAGGIASESIISAGCLIRGQVTRSVLSPGVVVDPGAVVQGSVLHDNVHVGRGAVVRGAVLDKNVEVPPGATIGVNPGRDADLYTVSKGGVIGLGKGQRVS

SEQ ID NO: 14612 - DNA, 2496 bp, Streptomyces avermitilis
  CDS (1)..(2496)
atgaaggccgtcgtgatggccggaggcgaaggcacacgccttcgcccgatgacctcgagtatgcccaagccgctcctgccggtggtaaaccggccgatcatggagcatgtcctgcggctactcaaaaggcatgggctcaacgagaccgtcgtaactgtgcagttcttggcgtctctcgtcaagaactacttcggtgacggcgaagagctcggcatggagctcacttatgccaatgaggagaagccactcggtaccgccgggagcgtcaagaacgccgaggaagcgctgaaggacgacactttcctcgtcatctccggtgatgccctgaccgacttcgatctcaccgagctgatcaatttccacaaggaaaagggtgcgctggtcaccgtctgtctgacgcgcgtgcccaatcctctggaattcggcatcaccatcgtcgacgaagaaggcaaggtcgagcgcttcctcgagaagcccacctggggacaggtcttctcggacaccgtgaacacgggcatctatgtcatggagcccgaagtcttcaactacgtcgaggccgacgtctccgtcgactggtccggcgatgtcttcccgcagctgatgaaggacggcaagccggtctacggctatgtcgccgagggctactgggaggacgtgggcacccacgagagctatgtgaaggcccaagccgacgtcctggagggcaaggtcgacgtcgagatcgacggcttcgagatctccccgggcgtatgggtcgcggagggtgccgaagtgcaccccgacgccgtgctgcgcgggccgctctacatcggtgactacgccaaggtcgaggctgacgtcgaaatccgcgagcacaccgtcgtcgggtcgaatgtcgtcgtgaagagcggggcctttctgcacagggccgtggtccacgacaacgtgtacatcgggcagcacagcaatctgcgtggttgcgtcatcggcaagaacaccgacatcatgcgggccgcccggatcgaggacggcgccgtcatcggcgacgagtgtctcgtcggtgaagaatcgatcatccaggggaatgtgcgggtctacccgttcaagaccatcgaggccggcgcgttcgtcaacacctcggtgatctgggagtcgcgggggcaggcgcatctgttcggcgcccgtggcgtgaccgggatcctgaacgtggagatcacgccggaactcgtcgtgcggctcgcgggagcgtatgcgaccacgctcaagaagggctcgaccgtcaccacggcccgtgaccactcccgaggcgcgcgtgcgctgaagcgggcggtcatctcggcgctgcagaccagcgccatcgacgtacgcgacctggagaacgtaccgctgcccgtcgcgcgacagcagaccgcgagaggcagcgccggcgggatcatgatccgtacgacgcccggggtgccggactccgtggacatcatgttcttcgacgggcagggtgccgacctctcgcagggcagtcagcggaagctggaccgagtgttcgcgcggcaggagtaccggcgagccttcccgggagagatcggggacctgcacttcccggcgagcgtcttcgactcgtacaccgggtcgctgctgcggaacgtcgacacgaccggtatctccgagtcggggctcaaggtcgtcgtggacgcgtcgaacggcagtgcggggcttgtgctgcccagtctgctcggcaagctgggtgtcgacgcgctcaccatcaaccccggcctcgacgagtcccggcccacggagacggccgatgcgcggcgctccgggctggtgcggctcggtgagatcgtcgcatccgcgagggccgcgttcggcgtgcgcttcgaccccgtcggtgagcgactgtcgctcgtcgacgagaaggggcggatcgtcgaggacgaccgggcactgctcgtcatgctcgacctggtggccgcggagcgacgcagcggccgcgtggcgctgccggtgacgacgaccaggatcgctgagcaggtggcggcttatcacgggacgcaggtcgagtggacgaccacgtcgcccgatgatctgacgcgggtgggaggcgacgaatcgaccatcttcggtggtgacgggcgcggcgggttcatcatccccgagttcagcagtgtcttcgacggtacggcggccttcgtgcggctgatcggtctggtggcgcggacacagctcacgctcagccagatcgatgcgcggatcccgcgggcccacgtgctgaagcgtgacctggcgactccttgggccgtcaaggggctggtgatgcggcgggtcgtcgaggcggccggcgatcgctttgtcgacacgacggacggcgtgcgggtcgtcgagtccgacgggcgttgggtgatggtgctgcccgatcccgccgaggcggtcacacatctgtgggccgaggggcccgacgacgcctccgcggaggccctgctcgacgaatgggcggcggtcgtggacagcgccggccgctga

SEQ ID NO: 14613 - protein, 831 aa, Streptomyces avermitilis
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDTFLVISGDALTDFDLTELINFHKEKGALVTVCLTRVPNPLEFGITIVDEEGKVERFLEKPTWGQVFSDTVNTGIYVMEPEVFNYVEADVSVDWSGDVFPQLMKDGKPVYGYVAEGYWEDVGTHESYVKAQADVLEGKVDVEIDGFEISPGVWVAEGAEVHPDAVLRGPLYIGDYAKVEADVEIREHTVVGSNVVVKSGAFLHRAVVHDNVYIGQHSNLRGCVIGKNTDIMRAARIEDGAVIGDECLVGEESIIQGNVRVYPFKTIEAGAFVNTSVIWESRGQAHLFGARGVTGILNVEITPELVVRLAGAYATTLKKGSTVTTARDHSRGARALKRAVISALQTSAIDVRDLENVPLPVARQQTARGSAGGIMIRTTPGVPDSVDIMFFDGQGADLSQGSQRKLDRVFARQEYRRAFPGEIGDLHFPASVFDSYTGSLLRNVDTTGISESGLKVVVDASNGSAGLVLPSLLGKLGVDALTINPGLDESRPTETADARRSGLVRLGEIVASARAAFGVRFDPVGERLSLVDEKGRIVEDDRALLVMLDLVAAERRSGRVALPVTTTRIAEQVAAYHGTQVEWTTTSPDDLTRVGGDESTIFGGDGRGGFIIPEFSSVFDGTAAFVRLIGLVARTQLTLSQIDARIPRAHVLKRDLATPWAVKGLVMRRVVEAAGDRFVDTTDGVRVVESDGRWVMVLPDPAEAVTHLWAEGPDDASAEALLDEWAAVVDSAGR

SEQ ID NO: 14614 - DNA, 1083 bp, Streptomyces avermitilis
  CDS (1)..(1083)
atgacagaagcgatcctcctggtcggcggcagaggcacccggcttcgtccgctcacggtgcacacccccaagcccatggtcccggcggccggggtcccgttcctcacgcatcagctggcgcgggcgagggcggcgggcgtggaccacatcgtcctggcgacctcctatctcgccgaagtcttcgagccgtacttcggcgacggctcggctctcggtctgcacctggagtacgtcacggaggaggagcccctcgggacgggcggcgcgatccgcaacgtggcgtcgcgcctccactccggccccgacgagccggtgctgatcttcaacggcgacatcctgacgggcctggacatccgtgccctggtccacacgcacgagacgacggccgcggatgtctccctgcacctcaccaaggtgacggacccgagggcgtacggcctcgtccccacggacgagacgggccgggtcactgccttcctggagaagccgcagacccccgaggagatcgtcaccgaccagatcaacgcgggggcgtacgtcttccggcgctcggtcatcgacacgatcccggcgggccgcccggtctcggtggagcgcgagacgttccccggcctgctgtccgccggagcacacctccagggcatggtggactcgacgtactggctggacctgggcacccccgcggccttcgtacgcggttcggcggacctggttctgggccgtgccccgtcccccgcggtcccgggccgctgcggcgaccgcctggtgctgccgacggcttcggtcgcctccgacgccaagctgacgggcggcacggtggtcggcgagggcgcgttcgtcggcgagggtgcccgcatcttcggcagcacgctcctgtccggcgcggtcgtcgaaccgggcgcggtcatcacggactccctgctcggcgcccgctcccgggtgggcgagcgctcgatcctgacgggagcggtcatcggcgacggcgcggtgatcggcgcggacaacgaactccgcgacggtgtacgggtgtggtgcgacgcgaggattccggcgggggcggtgcggttctcctcggaccagtag

SEQ ID NO: 14615 - protein, 360 aa, Streptomyces avermitilis
MTEAILLVGGRGTRLRPLTVHTPKPMVPAAGVPFLTHQLARARAAGVDHIVLATSYLAEVFEPYFGDGSALGLHLEYVTEEEPLGTGGAIRNVASRLHSGPDEPVLIFNGDILTGLDIRALVHTHETTAADVSLHLTKVTDPRAYGLVPTDETGRVTAFLEKPQTPEEIVTDQINAGAYVFRRSVIDTIPAGRPVSVERETFPGLLSAGAHLQGMVDSTYWLDLGTPAAFVRGSADLVLGRAPSPAVPGRCGDRLVLPTASVASDAKLTGGTVVGEGAFVGEGARIFGSTLLSGAVVEPGAVITDSLLGARSRVGERSILTGAVIGDGAVIGADNELRDGVRVWCDARIPAGAVRFSSDQ

SEQ ID NO: 14616 - DNA, 1302 bp, Nitrosomonas europaea ATCC 19718
  CDS (1)..(1302)
atgaaagttcaaccagctgtccagacgaatgataatccgcgtttcgtcagtacacttacccgcaatacacttgcactgattctggcaggcggtcgcggaacacgtctgaaaaacctgacggactggcgtgcaaaaccggccgttccgttcggcggtaaattccgcatcatcgatttcacgctgtccaattgcgtcaactcgggagtccggcgcattggtgtggtcactcaatacaaggcacagagcctgatacgtcatatccagcgcggctggagttttctcgatggccggttccaggaattcatcgagctgttacctgcacagcagcgtacagaagaaggaacctggtaccagggcacggctgatgcggtcttccagaatctcgacattctccgcacgcataatcccggttatgtgctgatcctcggcggtgatcacatctataaaatggattacggtcggatactggccgaacacgtcgagagacaggcagatctgacgattgcctgcctggaagttccggtggaagatgccagcgcattcggtgtcatggcagtagatgacagctggcgtaccaccagcttcgccgagaaacctgaacatccggctccgattcccggaaagcctggtcatgctctgatcagtatgggcatttatgtcttcaatgcaaaatttctgtacgagcaactgatccaggatcacgatatggatcagtcctcacacgatttcggcaaagatgtgataccccgtctggtggcaagtaatgcccgggtatacgcacaccgcttccagaacagttgtgtcaatatggcttcaggtgtgccttactggcgtgatgtgggaacagtggatgcttactggaaagccaatatcgatctcacgactatcacgccggatctgaatctgtacgatgaagactggccgatctggactcatcaggagcaactgccacccgccaaatttgtgttcgacgatgatgatcgtcgtggtcaggcgctggattcaatggtatccggcgggtgcatcatcagtggtgcaacagtacgccgctccctgctgttttccaatgttcagatacgtggctacagcactatcgaagattcggtcatcctccccaatgtcagcatcgaccgacacgcctacctcaaacgggtagtggtggagaaggaatgccagataccagaaggccttaaagtcggtttcaatcctgatgaagacaggaaacatttttatgtcacggatgacgggattacgctgattacgccggaaatgctgggacagggcatccactacatccgctga

SEQ ID NO: 14617 - protein, 433 aa, Nitrosomonas europaea ATCC 19718
MKVQPAVQTNDNPRFVSTLTRNTLALILAGGRGTRLKNLTDWRAKPAVPFGGKFRIIDFTLSNCVNSGVRRIGVVTQYKAQSLIRHIQRGWSFLDGRFQEFIELLPAQQRTEEGTWYQGTADAVFQNLDILRTHNPGYVLILGGDHIYKMDYGRILAEHVERQADLTIACLEVPVEDASAFGVMAVDDSWRTTSFAEKPEHPAPIPGKPGHALISMGIYVFNAKFLYEQLIQDHDMDQSSHDFGKDVIPRLVASNARVYAHRFQNSCVNMASGVPYWRDVGTVDAYWKANIDLTTITPDLNLYDEDWPIWTHQEQLPPAKFVFDDDDRRGQALDSMVSGGCIISGATVRRSLLFSNVQIRGYSTIEDSVILPNVSIDRHAYLKRVVVEKECQIPEGLKVGFNPDEDRKHFYVTDDGITLITPEMLGQGIHYIR

SEQ ID NO: 14618 - DNA, 1425 bp, Zea mays
  CDS (1)..(1425)
atggacatggctttggcgtctaaagcctcccctccgccatggaatgccaccgccgccgagcagccaattccaaagcgtgacaaagccgctgcaaatgattcaacatacctcaatcctcaagctcatgatagtgttcttggaatcattctgggaggtggtgctgggactagattgtaccccttgacaaagaagcgtgccaagcctgcagtgccattgggtgccaactatagactgattgatattcctgtcagcaattgtctcaacagcaacatatccaagatctatgtgctaacgcaatttaactctgcttccctcaaccgtcacctctcaagagcctacgggagcaacattggagggtacaagaatgaagggtttgttgaagtcttagctgcacagcagagcccagataatccaaactggtttcagggtactgcagatgctgtaaggcagtacttgtggttgtttgaggagcataatgtgatggaatttctaattcttgctggcgatcacctgtaccggatggactatgaaaagttcattcaggcacacagagaaacaaatgctgatattaccgttgctgccctaccgatggatgagaaacgtgcaactgcatttggcctcatgaaaattgatgaagaagggaggatcattgagtttgctgagaaaccgaaaggagagcagttgaaagcaatgatggttgacaccaccatacttggccttgatgacgtgagggcaaaggaaatgccttatattgctagcatgggtatctatgttttcagcaaagatgtaatgcttcagctcctccgtgaacaatttcctgaagccaatgactttggaagtgaggttattccaggtgcaaccagcattggaaagagggttcaggcttatctgtatgatggttactgggaagatatcggtaccattgcggcattttataatgcaaacttgggaataaccaagaagccaataccagatttcagcttctatgaccgttttgctccaatttatacacaacctcgacacctgccaccttcaaaggttcttgatgctgatgtgacagacagtgttattggtgaaggatgtgttattaaaaactgcaagataaaccattctgtagttggactccgatcttgcatatctgaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattggagacaatgttaaggtattccaaactgatgttccaacggtcaagaatattaatttagatttttccttaggatattacataatacttgatatgccattttgtcctcttatttttaacatttatttttga

SEQ ID NO: 14619 - protein, 474 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKVFQTDVPTVKNINLDFSLGYYIILDMPFCPLIFNIYF

SEQ ID NO: 14620 - DNA, 1476 bp, Oryza sativa
  CDS (189)..(1274)
tggacgcggccgacgctgtcttcttcctcgtcatcaatcatcttcccccctctctctctctctctctctttctctgacttcttctttctcaattcccgccaccccggcacgcccgctctcctctgctcggcgcaagttcttcggctgcctcaagggtgaggaggagctgagttagcagggctgcgaccatgaaggcgctcattctcgtgggaggcttcggcactcgcctgcggccgctgactctcagcgtgccaaagccgctcgtcgatttcgggaacaagcccatgatcctgcatcagatcgaagctctgaaagaagttggagttacagaagttgttctggccatcaattaccagcccgaggtcatgcttaactttctcaaggacttcgagagcaagcttggtatcaagatcacctgctcgcaggagacagagccactcggaaccgccgggccgctggccctggcacgcgacaagctcgctgacggctccggcgaccctttcttcgtcctcaacagcgacgtgatcagcgagtacccattcgccgagctcatccagttccacaagtcccatggcggcgaggccacgatcatggtcaccaaggttgacgagccttccaagtacggcgtggtggtcatggaggatgagaccgacaaggtggagcgcttcgtggagaagcccaaggtgttcgtcggcaacaagatcaacgccggcatctacctgctcaacccgtcggtgctggaccgcatcgagctgaagcccacgtccatcgagaaggaggtgttcccgcgcatcgccgcggacaatggcctgttcgccatggtcctgcctgggttctggatggacatcgggcagccgagggactacatcaccgggctgaggctgtacctcgactcgcttaggaagaaggcgcccgccaagctcgcgtcgggcgcgcacgtcctgggcaacgtgctcgtccacgagaccgccgtcatcggcgagggttgcctgatcgggccggacgtcgccgttggccccgggtgcgtggtggaggccggggtgaggctgtcccggtgcacggtgatgcgcggcgcccgcgtcaagaagcacgcgtgcatctccagcagcatcatcgggtggcactccaccgtcggcatgtgggcgcgcgtcgagaacatgaccatcctcggcgaggacgtgcacgtctgcgacgaggtctacagcaacggcggcgtggtgctcccgcacaaggagatcaagtccagcatcctcaagcccgagattgtcatgtgacaaggcgaggcgaggcgaaggattaatctgcgcgtctttcgtttacatggtggtgacgatgctaagtgcgtcggaagaagggggccattatgtgcttgatatgtttgttgtttgatttgttcctgaactgtctctgaaactggaagtgtaacatgttgtcccaagtagtatgtgtcatcaggctatatggttgaatgagtcc

SEQ ID NO: 14621 - protein, 361 aa, Oryza sativa
MKALILVGGFGTRLRPLTLSVPKPLVDFGNKPMILHQIEALKEVGVTEVVLAINYQPEVMLNFLKDFESKLGIKITCSQETEPLGTAGPLALARDKLADGSGDPFFVLNSDVISEYPFAELIQFHKSHGGEATIMVTKVDEPSKYGVVVMEDETDKVERFVEKPKVFVGNKINAGIYLLNPSVLDRIELKPTSIEKEVFPRIAADNGLFAMVLPGFWMDIGQPRDYITGLRLYLDSLRKKAPAKLASGAHVLGNVLVHETAVIGEGCLIGPDVAVGPGCVVEAGVRLSRCTVMRGARVKKHACISSSIIGWHSTVGMWARVENMTILGEDVHVCDEVYSNGGVVLPHKEIKSSILKPEIVM

SEQ ID NO: 14622 - DNA, 1749 bp, Oryza sativa
  CDS (112)..(1551)
gtgtgtgcatttctacaatcttttgttgcccattcatctgggttttcttctgcttctttttttttcctagagagtacggttttctttgtaattctttaatttgttgcaaccatgaatgtattggcatctaagatcttcccttcccgctccaatgttgccagcgagcaacaacaatcgaagcgcgagaaagcaactattgatgacgctaagaactcgtccaagaacaaaaatcttgaccgcagtgtcgatgagagtgtgcttggaatcattcttggaggtggtgcagggactagattgtatcccctcaccaagaagcgtgccaagcctgccgtgcctctgggtgccaactacaggcttattgatatccctgtcagcaactgtttgaacagcaacatatccaagatctatgtgctgacacaattcaactctgcctctctgaaccgtcacctgtcaagagcctatgggaacaacattggcgggtacaagaatgaagggttcgttgaagtcctcgctgcacagcagagcccagataatcctaactggtttcagggtactgcagatgctgtaagacagtacttatggctatttgaggagcataatgttatggagtttctaattctggctggagatcacctttaccgcatggactatgaaaagttcattcaggcacacagagaaacagattctgatattactgttgctgccctgccaatggatgagaaacgtgcaactgcattcggcctcatgaaaattgacgaggaagggagaatagttgaatttgcagagaaaccaaaaggagaacaattgaaagcaatgatggttgacactaccatacttggccttgacgacgtgagggcaaaagaaatgccttatattgctagcatgggtatctatgtgattagtaaaaatgtaatgcttcagctcctccgtgaacaatttcctggagctaatgactttggaagtgaagtcattccaggtgcaacaaacatcggaatgagggtacaagcttacttgtatgatggttactgggaagacattggtaccattgaggcattctataatgcaaatctgggaataacgaaaaagcctgtaccagatttcagtttctatgaccggtctgctccaatttatacacaacctcgacacttgcctccttcgaaggttcttgatgctgatgtgacagacagtgtcattggtgaaggttgtgttattaaaaactgtaagatacaccattcagtagttggactccggtcctgcatttctgaaggcgcaataatagaggactcattactcatgggagctgactactacgagactgaagcagacaagaaactccttggtgaaaaaggtggcattcccattggtattgggaagaattgccacattagaagggcaatcatcgacaagaatgctcgtattggagataatgtgaagataatcaatgttgacaatgtccaagaagctgcaagagagactgatggatactttatcaaaagtggcattgttaccgtgatcaaggatgctttgctccctagcggaacagttatatgaagtagctgcgtaatatgtgatggggcatcggcgacgagcaccaggcgggcattataagaagaataaaagcagttcaaggcactttattccctttttttttcttctgttcttcctctattgtgttaggataaatgtaatggtagaagcaactgtttttcagatgttttgggagtgaatgataccgtgcttgaattttcc

SEQ ID NO: 14623 - protein, 479 aa, Oryza sativa
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 14624 - DNA, 1885 bp, Phaseolus vulgaris
  CDS (31)..(1578)
catttgcttcacacactcacaaagagagtgatggcttccatggcttctatagggtctctcaatgtgccatgctcttcttcttcttcttcctccaatgggggtaggaaaatactcccacgcgccctctctttctctgcatcacagctatatggggataagatttccacagattcagtttcagttgcacccaagagagttcgtaatccagttgttgtttctcccaaggcagtttctgattcccaaaactcccagacttgtcttgatcccgatgccagcaaaagtgtgcttggcattatacttggaggtggtgctgggactcgtctttatccactgaccaagaagagggcgaagcctgctgttcctcttggagcaaactataggctgattgatatccctgttagcaactgcttgaatagcaatgtatcgaaaatctatgttctcactcagttcaattctgcgtcgttgaatcggcacctttctcgtgcttatgcaagcaacatggggggctacaaaaatgagggttttgttgaggttcttgctgctcagcagagtcctgagaatcctaattggttccagggcaccgcagatgctgtgaggcagtatttatggctttttgaagagcacaatgttttggagtatttggttctggctggtgatcatttgtatcgaatggattatgagaaatttatccaagtgcatagggagagtgatgctgatatcactgttgctgccttgccgatggatgaaaatcgtgccactgcatttggtctgatgaagatcgatgaagaggggcgtataattgaattcgccgaaaagcccaaaggagaacagttgaaagctatgaaggttgatactactatttttggtcttgatgacgagagagcaaaggaaatgccttacattgctagcatgggtatatatgttgttagcaaaaatgtgatgttaaacctgctacgtgagaagtttcctgctgcaaatgactttgggagtgaagtgattcctggtgcaacttccattggattgagagtgcaagcttacttgtatgatggctactgggaagacattggtacaattgaggctttctataatgcaaatctgggaatcaccaaaaagcctgtgcctgacttcagcttctatggtcgttcgtctccaatctacacccaaccacgatatttgcctccatctaagatgcttgatgctgatgtcactgatagtgttattggtgaaggatgtgtgattaagaactgcaaaattcaccattctgttgttgggttgcgatcttgcatatcagaaggtgcaattattgaagacacgctattgatgggggcagactattatgagactgatgctgataagaggtttctggctgctaaaggcagtgttccaattggtattggccggaactctcatgtcaaaagggcaattatcgacaagaatgctcgaattggagaaaatgtgaagattctaaacagtgacaatgtccaagaagctgcaagggaaacagatggatatttcataaaaagtgggattgtgacagtgatcaaggatgctttaattcctagtggaactgtaatctaaatccacccaaaatcagatactgttctgttccaaatgcaaaatggtgtctgaggagctcattatcaccgctggagagttgatcaagctctgctttttccacgcctagtgaaggctttcttaatgtttcatcatatatatctttaggcagtagcttgtaaataatagcggaagataatgacccttttgagcaatcattctgtaaagttcatttagtgaattcaataaatgtttttgtatttcggactaaaaaaaaaaaaaaaaaaaaaaaaaaaaaaaaaaaaaaagaaaaaaaaaaaaaaaaaaaaaa

SEQ ID NO: 14625 - protein, 515 aa, Phaseolus vulgaris
MASMASIGSLNVPCSSSSSSSNGGRKILPRALSFSASQLYGDKISTDSVSVAPKRVRNPVVVSPKAVSDSQNSQTCLDPDASKSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEYLVLAGDHLYRMDYEKFIQVHRESDADITVAALPMDENRATAFGLMKIDEEGRIIEFAEKPKGEQLKAMKVDTTIFGLDDERAKEMPYIASMGIYVVSKNVMLNLLREKFPAANDFGSEVIPGATSIGLRVQAYLYDGYWEDIGTIEAFYNANLGITKKPVPDFSFYGRSSPIYTQPRYLPPSKMLDADVTDSVIGEGCVIKNCKIHHSVVGLRSCISEGAIIEDTLLMGADYYETDADKRFLAAKGSVPIGIGRNSHVKRAIIDKNARIGENVKILNSDNVQEAARETDGYFIKSGIVTVIKDALIPSGTVI

SEQ ID NO: 14626 - DNA, 2025 bp, Phaseolus vulgaris
  CDS (152)..(1729)
ctaatgattgattttcaataatctcaaaaatcaagatcactcactgttattgcttctgcagatttccactttattgcatacttacaaattctttaatttaatcctcttcagcttcaccttccttagtgtcaagtgagttgagatcactgcaatggcttcttcttctgtaaccttgaaagccaatgctcacttggcaaactcagagaaaggtcacctttttcgtcaagaaagtagctttcttggggaaagagtaaaagttggccccaacaacagtgcctttgtgacgaatcagttggccagatgttcaagaagccagaagagggtgaatcatggtgttgcatctgctattctcacttcaaacgatgccaaagaatcactgtccttgcaagtgccttcgttcatgagacgaagggtcgatcctaaaaatgttgtttccatcatattgggtggaggacctgggaagcaactctttcccctcacccaacgtgctgccacacctgcggtgcctgtgggtggatgctacaggcttatagacatccctatgagcaactgcatcaacagtggcatcaacaaaatatttgtgctgacccagttcaactctgcatctctcaaccgtcacatcgcccgcacctattttggaaatggcatcaactttggggatggaaccgtggaggttctggcggctactcaaacaccgggagaggctggaaagaagtggttccaaggaactgcagatgctgtgaggcaattcacttgggtatttgaggatgccaagaatacacacgttgagaatgtattgatcttggctggagatcatctatatcgaatggattacatggacctaatacagagtcacgttgatagaaatgctgatatcacagtttcatgtgctgctgtgggtaacagccgtgcatcagattatggattggttaaagtagatgatagaggccgcatcattcaattttcagaaaaaccaaagggtgatgatatgacagcaatgcaagcggacacctctcttcttgggttgtcgcccccagatgcattaaagtcaccatatattgcgtctatgggggtttatgtattcaagacagatgttttactcaatcttctgaaatgtaggcatcctacctccaatgacttcggatctgaaatcatccctgcagctgtgagggaccacaatgtccaatcgtattttttcagagattattgggaagacattggaacaataaaatccttttatgatgctaacttggctcttactgaagagagtcatgagttcgaattttatgaccccaagactcccatttacacatctcctggatttctaccaccaactaagattgacaaatcccggattgtggatgccattatctcccatggatgtttcctgcgagaatgcactgtccaacactccattgtgggtgaacgttcacgtttggattatggagtcgaaattcaggacactgtaatgatgggagcggactattaccaaactgaatctgaaattgcttctctcctggcagaggggaaggtcccaattgggatcggaaggaataccaaaattaggaactgtatcattgacaaaaatgcaaaaattgggaaagatgtcatcatcaagaacaaagatgatgttcaagaagcagatagaccggaagatgggttttacattcgatcaggaatcaccatcatagcggagaaggcaacaatagaagatggcactgtcatataaaaggatagcgcttatgtcttgggcgggttgcccaaaggcgctcggtgaaagaagcattgtgaggaacacactcaaacgtcttttcgggcagaatgcaatgctgtgttaggtgacaaaggagaaatcagagcacccgattttctatttgtaaaatagaatttcccccaccatcactacatgtagaaatagaatgaataaaacatgaaaatcaacttgcatgaaagcaaataaattgaaggaccaaaaaaaaaaaaaaaaaaaaaaaaaaaaaaaaaaaaaaaaaaaaaaaaaaaaaa

SEQ ID NO: 14627 - protein, 525 aa, Phaseolus vulgaris
MASSSVTLKANAHLANSEKGHLFRQESSFLGERVKVGPNNSAFVTNQLARCSRSQKRVNHGVASAILTSNDAKESLSLQVPSFMRRRVDPKNVVSIILGGGPGKQLFPLTQRAATPAVPVGGCYRLIDIPMSNCINSGINKIFVLTQFNSASLNRHIARTYFGNGINFGDGTVEVLAATQTPGEAGKKWFQGTADAVRQFTWVFEDAKNTHVENVLILAGDHLYRMDYMDLIQSHVDRNADITVSCAAVGNSRASDYGLVKVDDRGRIIQFSEKPKGDDMTAMQADTSLLGLSPPDALKSPYIASMGVYVFKTDVLLNLLKCRHPTSNDFGSEIIPAAVRDHNVQSYFFRDYWEDIGTIKSFYDANLALTEESHEFEFYDPKTPIYTSPGFLPPTKIDKSRIVDAIISHGCFLRECTVQHSIVGERSRLDYGVEIQDTVMMGADYYQTESEIASLLAEGKVPIGIGRNTKIRNCIIDKNAKIGKDVIIKNKDDVQEADRPEDGFYIRSGITIIAEKATIEDGTVI

SEQ ID NO: 14628 - DNA, 1845 bp, Solanum tuberosum
  CDS (64)..(1629)
gcaatcacactctaccacacactctctagtagagagatcagttgataacaagctttgttaacaatggcggcttccattggagccttaaaatcttcaccttcttctaacaattgcatcaatgagagaagaaatgattctacacgtgcagtatccagcagaaatctctcattttcgtcttctcatctcaccggagacaagttgatgcctatatcgtccttacgttcccaaggagtccgattcaatgtgagaagaagttcactgattgtgtcgcctaaggctgtttctgattcgcagaattcacagacatgtctagacccagatgctagccggagtgttttgggaattattcttggaggtggagctgggacccgactttatcctctaactaaaaaaagagcaaagccagctgttccacttggagcaaattatcgtctgattgacattcctgtaagcaactgcttgaacagtaacatatccaagatctatgttctcacacaattcaactctgcctctctgaatcgccacctttcacgagcatatgctagcaacatgggaggatacaaaaacgagggcttggtggaagttcttgctgctcaacaaagtccagagaaccccgattggttccagggcacggctgatgctgtcagacaatatctgtggttgtttgaggagcatactgttcttgaataccttatacttgctggagatcatctgtatcgaatggattatgaaaagtttattcaagcccacagagaaacagatgctgatattaccgttgccgcactgccaatggacgagaagcgtgccactgcattcggtctcatgaagattgacgaagaaggacgcattattgaatttgcagagaaaccgcaaggagagcaattgcaagcaatgaaagtggatactaccattttaggtcttgatgacaagagagctaaagaaatgcctctcgttgccagtatgggtatatatgtcattagcaaagacgtgatgttaaacctacttcgtgacaagttccctggggccaatgattttggtagtgaagttattcctggtgcaacttcacttgggatgagagtgcaagcttatttatatgatgggtactgggaagatattggtaccattgaagctttctacaatgccaatttgggcattacaaaaaagccggtgccagattttagcttttacgaccgatcagccccaatctacacccaacctcgatatctaccaccatcaaaaatgcttgatgctgatgtcacagatagtgtcattggtgaaggttgtgtgatcaagaactgtaagattcaccattccgtggttgggctcagatcatgcatatcagagggagcaattatagaagattcacttttgatgggggcagattactatgagactgatgctgacaggaagttgctggctgcaaagggcagtgtcccaattggcatcggcaagaattgtcacattaaaagagccattatcgacaagaatgcccgtataggggacaatgtggagatcattaacaaagacaacgttcaagaagcggctagggaaacagatggatacttcatcaagagtgggattgtcaccgtcatcaaggatgctttgattccaagtggaatcatcatctgaaggaatgcgttttaacttggttgtcctccaagattttggctaaacagccatgaggtagaaacgtgctgaacttttattttcctgagctgtagaaatctagtgtacatctttctgttatgatacttctcattacccccacaaaagaagactggatgctgtaaaaattattcgtctagaataaaaaataaattactcaaaaaaaaaaaaaaaaaaaaa

SEQ ID NO: 14629 - protein, 521 aa, Solanum tuberosum
MAASIGALKSSPSSNNCINERRNDSTRAVSSRNLSFSSSHLTGDKLMPISSLRSQGVRFNVRRSSLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGLVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPLVASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVEIINKDNVQEAARETDGYFIKSGIVTVIKDALIPSGIII

SEQ ID NO: 14630 - DNA, 1173 bp, Lactobacillus plantarum WCFS1
  CDS (1)..(1173)
atgagacgtgaacaagtgagtgccattattaatttactggaaccaagtgacgcgttacaaccattgactgcagttcggccagttggaatgttaccctttggtggtcgttatcggttggttgattttcaattatcgagtgtcatcaatgcggggattcaaaatgtgatggtgacggtcccgcggtcagggcgttccgtggctgaccatttgcgtagcgggcgtgactggagcctgaacacaattcgcggcggcctattcttgtccccatacaatgacttgaaattagtggcgccagaaaagaaggccgcattactgcaccattactatgataattcgattcagtttctgaaatgcagccagagtgagtactcggtagtgatgagtactcgcaatgttggtaatattgatttaaaggcgctactacggtatcacgaggaacgtaacagtcccgtgacggcggtttataagcgcgttgatccagctagtttgattcccgaaaatacaatcttacaattgactgctaagggagaagcaacggcggtcgttccgatgagcaaggccaagattagcccgaagacgaaacaagttgccaagagcatggctatttacttgatgagtacggtcgatttaatcgaattattgcagtcggccaatcaacggggtgacatgatcagcctagaggaattgatgcggcaagcagtcatccaacataacgctaatgcttttgaatatacgggctttcaggcgaatattcatgatatcaacagctactttgcggccaatatggccgttttggatgaagctaatttccgagcgttattctacagttcgcgccgtatttacaccaaggtcaaaaatgaaattccgacgttctttgcgactggttcacagtgtcgtgatagtttatgtggtactgggggctatattgaagggcaacttgaccactccgtcatctttcgggatgtactgattaatcgtgatagccaagttaaaaatgccatcattatgcagggggcccggatcggtgccggttgtaagttagaaaacgtcattatcgataaagacgccgtaatcgggcccaacctagtgcttaaaggaacttcaacgacaccgttagtcatcagcaaagggcagcacgtctttcaacaagcggaggtggctgtgcatgactag

SEQ ID NO: 14631 - protein, 390 aa, Lactobacillus plantarum WCFS1
MRREQVSAIINLLEPSDALQPLTAVRPVGMLPFGGRYRLVDFQLSSVINAGIQNVMVTVPRSGRSVADHLRSGRDWSLNTIRGGLFLSPYNDLKLVAPEKKAALLHHYYDNSIQFLKCSQSEYSVVMSTRNVGNIDLKALLRYHEERNSPVTAVYKRVDPASLIPENTILQLTAKGEATAVVPMSKAKISPKTKQVAKSMAIYLMSTVDLIELLQSANQRGDMISLEELMRQAVIQHNANAFEYTGFQANIHDINSYFAANMAVLDEANFRALFYSSRRIYTKVKNEIPTFFATGSQCRDSLCGTGGYIEGQLDHSVIFRDVLINRDSQVKNAIIMQGARIGAGCKLENVIIDKDAVIGPNLVLKGTSTTPLVISKGQHVFQQAEVAVHD

SEQ ID NO: 14632 - DNA, 1263 bp, Bradyrhizobium japonicum USDA 110
  CDS (1)..(1263)
atgagtgccgtcggaaatgagccgctcgcccgtcaggcgctggcgttcgtcctggctggcggacgcggtagccggcttctggagctgaccgaccggcgcgccaagccggcggtctatttcggcggcaagtcccgcatcatcgatttcgcgctgtcgaacgcggtgaactccggcatccgccgcatcgcggtcgccacccagtacaaggcgcacagcctgatccggcatcttcagatgggctggaacttcttccgcccggagcgcaacgagagctttgacatcctgcccgcgagccagcgtgtctccgagaacatgtggtatgtcggcacggcggacgcgatctaccagaacatcgacatcatcgagtcgcacaacgcccgcttcattgtcgtgctcgccggcgaccatatctacaagatggattacgaggtgatgctgcgccagcacgtcgatagcggcgccgacgtcacggtcggctgcctcgaaatgccgcgcgcggaatcctccggcttcggcatcatgcatatcgacgagaacggctggatccaggagttcctggaaaagccggccgatccgccgccgatgccgggcaagccggacgtctcgctcgccagcatgggcatctacgtgttcgatgcgaaattcctgttcgaccagctcaagcgcgacgccgaggacccgagctcgaaccacgatttcggcaaggacatcattccctacatcgtcaagaacggccgcgcgatcgcgcaccagttctcgacctcctgcgtccgctccggcgacgatccccgcgcctattggcgcgacgtcggcacggtcgacgcctattgggcggctaacatcgacctcaccgacgtggtgccggagctcgacctgttcgaccgcgcatggccgatctggtcctactcggagatcacgccgcccgccaagttcgtccatgacgaggagagccggcgcggccaggcggtgagctcgctggtctcgggcggctgcatcatctccggcgcctcgctgcgccgttcgctgctgttcaccggcgtgcgcatcaactcctatgccaatgtcgagaacgccgtgatcatgccctatgtgaatgtcgggcgcggggcgcggctgaagaacgtcgtgatcgaccgcggcgtcgagattcccgaggggctcgtcatcggcgaggatcccgagctcgatgcaaaacgcttccgcaccaccgagcagggcatctccctcatcacccaaccgatgatcgacaggctgaatacatga

SEQ ID NO: 14633 - protein, 420 aa, Bradyrhizobium japonicum USDA 110
MSAVGNEPLARQALAFVLAGGRGSRLLELTDRRAKPAVYFGGKSRIIDFALSNAVNSGIRRIAVATQYKAHSLIRHLQMGWNFFRPERNESFDILPASQRVSENMWYVGTADAIYQNIDIIESHNARFIVVLAGDHIYKMDYEVMLRQHVDSGADVTVGCLEMPRAESSGFGIMHIDENGWIQEFLEKPADPPPMPGKPDVSLASMGIYVFDAKFLFDQLKRDAEDPSSNHDFGKDIIPYIVKNGRAIAHQFSTSCVRSGDDPRAYWRDVGTVDAYWAANIDLTDVVPELDLFDRAWPIWSYSEITPPAKFVHDEESRRGQAVSSLVSGGCIISGASLRRSLLFTGVRINSYANVENAVIMPYVNVGRGARLKNVVIDRGVEIPEGLVIGEDPELDAKRFRTTEQGISLITQPMIDRLNT

SEQ ID NO: 14634 - DNA, 1314 bp, Thermosynechococcus elongatus BP
  CDS (1)..(1314)
atggccgttcagatggagttttcaatgaaacgagtcctggcgattatccttgggggcggtgccggaacacgtctgtatcccttgaccaagcgtcgcgctaagcctgcggttccccttgctggaaaatatcgcctcattgatattccggtgagcaattgcatcaactccgaaatccataacatttacgtccttacccaattcaactcggcctccctcaatcgtcacattgcccgtacctacacctttcccggcctgacgggcggctttgtcgaagttttggccgcccaacaaacccccgaaaatcccaactggtttcagggcacggctgatgcggtacgtcaatacctgtggctgttggcggactgggatgtggatgaatacctgattctttcaggagatcacctctaccgcatggactatcgcctgtttgtccaacgccaccgcgacaccggcgccgatgttaccctttccgttctgccggtggaggaaaaggccgcctctggttttggcctccttaaggtggatggtacggggcgagtaactgactttcgcgagaagcccaccggggatgccctccgggatatgcgagtggacacaacccgctatggcctaaccatcgaggaagcccatcgcaaaccctacattgcctcgatggggatttatgtcttcaagcggcaagtcctcattgaccttttgcagcagatggccgatgccacggactttggcaaagaaatcatccccgctgcagcccgttcccaccttgtccaaacctatcttttcaatggctattgggaagatattggcaccattggctccttctacgaagccaaccttgccctcacccaacagccgcagccgccctttagcttctacgatgaaaacgcccccatctatacccgtccccgctatttgccccccagtaagattctcagttccaccatcacggagtccatcattagtgagggctgtatcctcaaggaatgccaagttcaccgctcggtcttgggcgtgcgatcgcgggtggaatccggctgtgtcattgatcactccctgctgatgggggcagactactaccaagactcagctcagcgcagccagctacggctgcaacataaaatccccatcggcattggggccaacagtgtcattcgccgggcaattgtggataaaaatgcctgcattggccgcgatgtcaaaatcatcaacaaagataacgttgaagaatccaatcgagaggatcagggattctatattcgcagcggtgtggttgtcatcatcaaaaatgccgtgattcccgacggcaccattatctaa

SEQ ID NO: 14635 - protein, 437 aa, Thermosynechococcus elongatus BP
MAVQMEFSMKRVLAIILGGGAGTRLYPLTKRRAKPAVPLAGKYRLIDIPVSNCINSEIHNIYVLTQFNSASLNRHIARTYTFPGLTGGFVEVLAAQQTPENPNWFQGTADAVRQYLWLLADWDVDEYLILSGDHLYRMDYRLFVQRHRDTGADVTLSVLPVEEKAASGFGLLKVDGTGRVTDFREKPTGDALRDMRVDTTRYGLTIEEAHRKPYIASMGIYVFKRQVLIDLLQQMADATDFGKEIIPAAARSHLVQTYLFNGYWEDIGTIGSFYEANLALTQQPQPPFSFYDENAPIYTRPRYLPPSKILSSTITESIISEGCILKECQVHRSVLGVRSRVESGCVIDHSLLMGADYYQDSAQRSQLRLQHKIPIGIGANSVIRRAIVDKNACIGRDVKIINKDNVEESNREDQGFYIRSGVVVIIKNAVIPDGTII

SEQ ID NO: 14636 - DNA, 1146 bp, Thermosynechococcus elongatus BP
  CDS (1)..(1146)
atgaaagcaatgatcttggcggctggaaagggcacgcgggtacgcccgattacatacaccattccgaagccaatgatcccaattctgcaaaagcccgtgatggaatttctagtggaactcctgcgtcagcatgggtttaaccagattatggtaaatgtgagccacctcgcccatgaaattgaaagctactttcaggatgggcagcggtttggggtggagattgcttattcctttgagggctatatcaaggatggtgaactcgttggtaaagccctagggtctgcgggcgggatcaagcggattcaggattttaaccccttttttgatgacacctttgtggtgctgtgtggtgatgccctcattgacttggatttgacagcggccgtggcttggcaccgccaaaagggggcgatcgccaccgtggttatgaaaacagtgcccagagaggatgtctcaagctatggcgttgttgttactgacaagagcgatcgcattgttgccttccaagaaaaacccagtgttgaagaagccctgagcaaccatatcaacacggggatttatatttttgagccagaagtgatcgactatatcccctccaatcaggaatacgacattggcagccagcttttccccaaactggtggaaatgggtgcccccttctatggcttggcgatggactttgaatggattgacattggtaaagtccccgactactggcaagcggtgcgcggcgttcttaatggcacgattaaaaatgtttcgattcccggccatgagcagtttcccggcatttatacggggctaaatgtggccgtcaactgggataaggtcacgatccagggaccggtctacattggcggcatgacgaagattgaagatggagcaacaattattggaccgacgatgattggccccaattgccacatttgcagcggtgcggtcgtcgataactgtgtcatttttgaatattctcgccttggttctgacgttcgtcttgtggataagttggtttttggtcgctactgtgttgataaaacaggtacaaccattgacctgaaggccgctgccctcgattggttgattaccgattcacggcaaacggatattcaactgagtcccctcgagttgaaggagatgatgtcctag

SEQ ID NO: 14637 - protein, 381 aa, Thermosynechococcus elongatus BP
MKAMILAAGKGTRVRPITYTIPKPMIPILQKPVMEFLVELLRQHGFNQIMVNVSHLAHEIESYFQDGQRFGVEIAYSFEGYIKDGELVGKALGSAGGIKRIQDFNPFFDDTFVVLCGDALIDLDLTAAVAWHRQKGAIATVVMKTVPREDVSSYGVVVTDKSDRIVAFQEKPSVEEALSNHINTGIYIFEPEVIDYIPSNQEYDIGSQLFPKLVEMGAPFYGLAMDFEWIDIGKVPDYWQAVRGVLNGTIKNVSIPGHEQFPGIYTGLNVAVNWDKVTIQGPVYIGGMTKIEDGATIIGPTMIGPNCHICSGAVVDNCVIFEYSRLGSDVRLVDKLVFGRYCVDKTGTTIDLKAAALDWLITDSRQTDIQLSPLELKEMMS

SEQ ID NO: 14638 - DNA, 2532 bp, Thermosynechococcus elongatus BP
  CDS (1)..(2532)
atgcgtgtcgttgtcatggccggtgggagtggcactcgcttacgccccctaacctgcgatctacccaaacccatggtgccggtggtcaatcgtcccattgccgagcatattctcaatctcctgcgccgccataaccttgatgatgtggtcatgacattgcattatctccccgatgtggtgcgggactattttggggatgggaatgaatttggggtgcacctgagctatgtcgttgaggaagagcagccccttggcacggcaggttcggtaaaaaacattgtcaatctgctaacggatccgtttttggtggtcagtggcgatagcattaccgatgtcgatttaaccgatgccctgcgttttcaccaacagcacggtgctcccgtaaccctgatccttgcccgtgtgccccaaccgaaggagtttggcattgtctttaccgatagcgatggccgcgtgcggcggtttctcgagaagccttcagcagcggaagtctttacggacacagtcaatacgggcatctacatcctcaaccccacggttatggattacctgaatagcggcattgagcgggatttttcgcgggatctgttcccattgctgttgcaggcggatgtgccgatgtatggctatatcaccgatgcttactggtgcgatgtcggcagtctccaaacctatcaacaggtgcaacaggatgccctctatggtcgggttcacttggaaattcaggggcacgaagttcagccgcaaatttgggtagggcacaacaccccattgccgccaacggttcagctacaggcaccgctcgtcttgggcaataactgccgcttgggtgcgggggtcacccttgggccggggacagtcttgggggataacgtgatgattggcaatggcagtcggttgcgttcagtggtggcttggaatggctgctttattggggatgacagtgaattggagcattgcatcttagctcgccatgtccatgtcgatcgccatgtgacactacaggaaggggtgattattggcagtcgctgtgtggtgagggaggaagccagcctgagtcagggagtgcgcatctggccaggaaaacgcattgaagccggtgcaattgtcaatcaaagcctgatctggggcacaacagggcagcgctatctctttgggcagcggggagtggccggtgtggccaatgtggacattacaccggagtttgctgtgcggctggcggcagcctatgcctcaattcttgagcccggaaccagtgtgcttgtgtcgcgagatcagcgaaatgtatcgcggatggtgtcccatgccctgatgtcgggtttgatgtcggtggggattcatgtcctcaatttggaggcgatcgccctgcccattgcccgctttgccgcccaaaccctttcagtcagtggggggattcatgtgcgtgcccatcccgatcgcgccgatcagcttttgattgagttttttgaccacaaaggcatcaacctcagtagagccaaagagcggcaaattgaaactgcctacttccgtgaagagattcgccgtgccctactgacggatgtcggtgtcatgacccatcccaacaactgcgtggccgcctatgcccaaggctttgaaaagtggctgaatacgcaactgttttatggtagccccgccaaaattgttattgactatgcctatgccgtttctggggtcgtcttgccccagatcctcagtaagtttggctgcgatgccgttgttctcaatgccaccctccacccaacgcctctaaatattctcgagcgacagcgactcctgcgggaactgggacaggtggtgaccgcactttctgcgagtttgggggtgcaagtctccgccaatggcgaacggttgaccttggtggacaatgccggtcaggttttcagtgatcaagaactcacggccttaatgacctacttaaccctcttgactcatccggggggcaccgtcgtggtgccggtcacaacctctagtgctgtggaggcgatcgcccgccagcagggaggacacattatccgcagtcgtaccaacccgactgatctcatggaagcctgccaacaccagagcggcgttgtcctaggggggtccgcagaaaccggtttcatcttcccgcaactgcatcctggatttgatgccatgtttacgatcgccacactgatcgaactgctggcactgattggcaagcccctcacagtgatccgccaagaactgccccgcgtccactactatcaccgcccgattcgctgtccttggctggctaaagggtcattgatgcgccacttagtggaaacccatccccgcaaccatttaagtctcattgatggcgtcaaaattggtgaacccaatactgaccattgggtactgattctgcccgatgccagtgagccactggtacacctctacgtgaatagccctgatgccctttggagtcagcagatgctgcaacgctatagccgccgcattgaagcgtttgcccgcttggaacccctctcagatgccacaataaagatgtaa

SEQ ID NO: 14639 - protein, 843 aa, Thermosynechococcus elongatus BP
MRVVVMAGGSGTRLRPLTCDLPKPMVPVVNRPIAEHILNLLRRHNLDDVVMTLHYLPDVVRDYFGDGNEFGVHLSYVVEEEQPLGTAGSVKNIVNLLTDPFLVVSGDSITDVDLTDALRFHQQHGAPVTLILARVPQPKEFGIVFTDSDGRVRRFLEKPSAAEVFTDTVNTGIYILNPTVMDYLNSGIERDFSRDLFPLLLQADVPMYGYITDAYWCDVGSLQTYQQVQQDALYGRVHLEIQGHEVQPQIWVGHNTPLPPTVQLQAPLVLGNNCRLGAGVTLGPGTVLGDNVMIGNGSRLRSVVAWNGCFIGDDSELEHCILARHVHVDRHVTLQEGVIIGSRCVVREEASLSQGVRIWPGKRIEAGAIVNQSLIWGTTGQRYLFGQRGVAGVANVDITPEFAVRLAAAYASILEPGTSVLVSRDQRNVSRMVSHALMSGLMSVGIHVLNLEAIALPIARFAAQTLSVSGGIHVRAHPDRADQLLIEFFDHKGINLSRAKERQIETAYFREEIRRALLTDVGVMTHPNNCVAAYAQGFEKWLNTQLFYGSPAKIVIDYAYAVSGVVLPQILSKFGCDAVVLNATLHPTPLNILERQRLLRELGQVVTALSASLGVQVSANGERLTLVDNAGQVFSDQELTALMTYLTLLTHPGGTVVVPVTTSSAVEAIARQQGGHIIRSRTNPTDLMEACQHQSGVVLGGSAETGFIFPQLHPGFDAMFTIATLIELLALIGKPLTVIRQELPRVHYYHRPIRCPWLAKGSLMRHLVETHPRNHLSLIDGVKIGEPNTDHWVLILPDASEPLVHLYVNSPDALWSQQMLQRYSRRIEAFARLEPLSDATIKM

SEQ ID NO: 14640 - DNA, 1146 bp, Streptococcus mutans
  CDS (1)..(1146)
atgcatatgaagaatgaaatgttagctcttattcttgctgggggacaagggacacgacttggaaaattgacgcaaagcattgcaaaacctgctgtccagtttggcgggcgttatcgtattattgattttgcactttcaaattgtgccaattcaggcatcaataatgttggtattattacacagtaccagccactggctcttaatagtcatattggaaatggctcaagctggggtttggatggtattaattctggggcaacaattcttcaaccttattctgcaacagaaggcaatcgttggttccaaggaaccagccatgcgatttaccaaaatattgattatattgatagtattaatcctgagtacgttcttattttgtcgggtgatcatatttataagatggactatgatgatatgcttcaaacccacaaagataatatggccagcttgacagttgcagttatcgatgtacctcttaaagaggctagtcgttttggtattatgaatacggattccaatgaccgtatcgttgagttcgaagagaaaccagaacagccaaaatcaaccaaagcttcaatgggaatttatattttcaattgggatcgtttacggaccatgcttgttgatgctgaaaagaacaatattgatatgtctgactttggtaaaaatgtcattcctgcttatcttgagtcaggtgagcgtgtttatacttataattttaacggctattggaaagatgttgggaccattgaatcactctgggaagctaatatggagtatattggcgaagacaatgaccttcacagccgtgatcgttcttggaagatttattcaaaaaacttaatcgcaccgccaaactttatcaccgaagaagctcatgtaaaagattctttagttgtagatggctgttttgtttctggtaaggttgaacattctattttgtcaaccaatgttcaggtcaaagaaggtgcccaaatcaaggattcctttattatgagtggtgctgttattggcgaaggtgctaaaattacacgtgccattgttggcgaaggagccaagattggtgaagacgttgagattgatggtactgaagaagtccaagttattggttataatgaagtagtgggggttccaaatgaagattga

SEQ ID NO: 14641 - protein, 381 aa, Streptococcus mutans
MHMKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 14642 - DNA, 1134 bp, Streptococcus mutans
  CDS (1)..(1134)
atgaagattgataaatattctgcaattctaggaagtgctatcggattcccagaaatggaaggattaacagatacgcgtcccttggcaaatctgccttttgatggtaaatatcgcttaattgactttcaattatcaaatttagcaaatgctggtattcgaagtgtttatggtattttccgtggacaaaatattcgttctatttttgatcatatcagaagcggtcgtgaatggggtcttaatacactcttaagtcattatttcctaggtttctataatacaccagaagatagtatttatgccgataaggattattatgatcaaatcttgacttatttaaaacgttcaggttctgatcaaaccatttacatgtcttgtgatattctgtgtaatattgacttgcagcaagtgattcatctgcataatgctaataaacgcaatataacagttgtttataaaaaattgccaatcaatgctatttctgcagctaatgacattttagaaattgatgaaacggatactgttacgggacgccgtgatagtcagtctggtaatgaaacagaaaaaatgtctgctggtatctatattgtgaatacctcttggttgattgagcagatggaaaaagaaaatcaaaaagaagaaccgattaatcttcgtttcttattgcgtgatttgacagtagctgagaaagctcttgcttttgaatacactggttatttggctaatatttcttctatccagtcttattacaatgccaatatggatatgctggaatctcaaaaattttattccttgctttattctaaccaaaaagtttatactaaggtcaaaaatgaagaagcgacctattttgcagtggattcgactgtaaaaaatgctcagtttgcttcaggaagcatcatcaaaggaactgtagatcattccattatttcgcgcaactgccatattgctaatcattctcgtgttgttaacagtgttgttttccctaaagtaagcattggtgatggtgcagtagtagagaatgctattcttgataaaaatgttaagattgctcctggagtgatcattcgcggtacgggagataaacctattgttatcgcaaaagcaagtgaagttgttgaggatattattcaatga

SEQ ID NO: 14643 - protein, 377 aa, Streptococcus mutans
MKIDKYSAILGSAIGFPEMEGLTDTRPLANLPFDGKYRLIDFQLSNLANAGIRSVYGIFRGQNIRSIFDHIRSGREWGLNTLLSHYFLGFYNTPEDSIYADKDYYDQILTYLKRSGSDQTIYMSCDILCNIDLQQVIHLHNANKRNITVVYKKLPINAISAANDILEIDETDTVTGRRDSQSGNETEKMSAGIYIVNTSWLIEQMEKENQKEEPINLRFLLRDLTVAEKALAFEYTGYLANISSIQSYYNANMDMLESQKFYSLLYSNQKVYTKVKNEEATYFAVDSTVKNAQFASGSIIKGTVDHSIISRNCHIANHSRVVNSVVFPKVSIGDGAVVENAILDKNVKIAPGVIIRGTGDKPIVIAKASEVVEDIIQ

SEQ ID NO: 14644 - DNA, 1134 bp, Streptococcus agalactiae
  CDS (1)..(1134)
atgaagattgataaatatactgcgattttaggaaatactgttagttacccagatatgcacagtttgacggataatcgtccgcttgcttctctaccttttgatggtaagtatcgtttaattgattttcaattatcctctttagctaatgcaggcgttagaagtatttatggtatttttcgtgggaataatgttcgctctgtttttgaccatattagaagtggtcgtgagtggggcttaggtacattgttgagtcactattctttaggattttatgatacagacgatgatattcgtacagtcaatggggattattacgatcaaattttaacttacttgaggcgttcgggtagcgaccagacgatatatatgagttgtgatatgctttgtaatattgacttaagtcaagtaatccacttgcataatgcaaatggtacgcaagccaccgtggtttataaaaaaatgccgagatcagctattgcagaggctaatcaagtcttgaccattgatgaatctgatcatgtagtgagtctaggtaaagctgtagataatgacgataaccaaaaaatgtctgctgagatttatgttatcaacacaccttggttaatcgaaaaaatggaagaggaagctcaaaataatgaaccacgtaaactccgcttcttacttcgtgatttaattgttgaaagtaatgctttggcttttgaatacactggttatttgtcaaacatttcttctattaaatcctattatgatgctaacatggacatgttaacaccaaataaattttattcgctcttcttttcaaaccaaaaagtttatactaaggtgaaaaatgaggaagctacttattttgataaacaatcaaatgtctctaattcgcaactagcttctggaagtattattaaaggttatttagaccattctatcgtttctagaaattgtctccttgaaaatgggactcgagtagtcaatagtattatctttccaaaagtaaaaatcggggaaggggcaaccattgaaaatactattattgacaaatgcgttaaggttgcacccggagttacattgaaaggtagtttagataaaccgttagtgattcctaaattttcagagattaatgaggatattatacaatga

SEQ ID NO: 14645 - protein, 377 aa, Streptococcus agalactiae
MKIDKYTAILGNTVSYPDMHSLTDNRPLASLPFDGKYRLIDFQLSSLANAGVRSIYGIFRGNNVRSVFDHIRSGREWGLGTLLSHYSLGFYDTDDDIRTVNGDYYDQILTYLRRSGSDQTIYMSCDMLCNIDLSQVIHLHNANGTQATVVYKKMPRSAIAEANQVLTIDESDHVVSLGKAVDNDDNQKMSAEIYVINTPWLIEKMEEEAQNNEPRKLRFLLRDLIVESNALAFEYTGYLSNISSIKSYYDANMDMLTPNKFYSLFFSNQKVYTKVKNEEATYFDKQSNVSNSQLASGSIIKGYLDHSIVSRNCLLENGTRVVNSIIFPKVKIGEGATIENTIIDKCVKVAPGVTLKGSLDKPLVIPKFSEINEDIIQ

SEQ ID NO: 14646 - DNA, 1140 bp, Streptococcus agalactiae
  CDS (1)..(1140)
atgaaaaatgaaatgttagcactcattctcgccggaggacaaggcactcgactcggaaaattgactcaaagcattgcgaaacccgctgttcaatttggaggtcgttaccgtattattgactttgcgctttcaaattgtgcgaattcaggtattaataatgttggggttattactcagtatcaaccgctggaactcaatactcatattggaaacggatctagctggggactagatggtatcgattcgggagtaactgtattacaaccatattctgcaacagaaggtaatcgttggttccaaggtaccagccacgctatctatcaaaatattgactacattgatcgtattaatccagaatatgtgctcattctctctggggaccacatctataaaatggactatgatgacatgctacagacacataaagataatttagcaagcctaacagtcgctgttttagatgttcctttaaaagaagcaagccgttttggaattatgaatactgattcaaacgaccgtattgtcgaatttgaagaaaaacctgaacatcctaagtcaacaaaagcttcaatgggaatatacatttttgactggaagagattacggacagttttaattgatggtgaaaagaacggcatagacatgtcagactttggtaaaaatgttataccagcataccttgaatcgggtgaacgtgtttatacctataattttgatgggtattggaaagatgttggtactattgaatccctttgggaagctaatatggaatatattggagaagataacaaattacatagtcgtgatcgttcatggaaaatctattctaaaaatttgattgcaccacctaatttcatgacagaagatgcaaatgttaaagattctttagttgtagatggatgctttgttgcagggaatgttgagcactccattttgtcaactaatgtccaggtaaaaccaaatgctattattaaagactcctttgttatgagtggcgcgactatcggtgaaggtgcaaagataaatcgagctattatcggtgaggatgctgttattggtgatggtgttgtgattgatggaagtaaagaagtagaagttattggttataaagaagtagtgggggttccaaatgaagattga

SEQ ID NO: 14647 - protein, 379 aa, Streptococcus agalactiae
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMDYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVVGVPNED

SEQ ID NO: 14648 - DNA, 1263 bp, Shewanella oneidensis
  CDS (1)..(1263)
atgtctaatgtacgttatatcagtaatttaactcgtgaaacctatgcattgattctggctggtggccgaggctcgcgtttacatgaactcactgattggcgtgctaaacccgcgctgtatttcgggggcaagtttaggattattgattttccgctatcaaattgcatcaactcggggatccgccgcgttggggtggtgacccaatataagtcgcactcgttaatccgccatgtgatgcgcggttggggccatttcaaaaaagagttgggcgagtcggtagagattttgcctgcctcacaacgctactctgaaaattggtatcaaggcaccgcggatgcggtgtttcaaaatatcgacatcattcgccatgaactgcccaagtatgtcatggtgctgtcgggagatcatgtgtatcgcatggattacgccggtttactcgccgcccacgccgaatctggcgccgatatgacggtctcctgccttgaagtgccagtggctgaagctgcaggggcatttggggtaatggaggtcgatgatgatatgcgtatcttaggttttgaagaaaaacctcagctaccaaaacattgccccggtaatccggaaaagtgcctcgcttcgatgggcaactatgtgtttaacactgaatttttattcgaacagttgaaaaaggacgcccaaaacgccgaatctgaccgtgattttggcaaagatattattccctcgatcatcgaaaaacataaagtgtttgcctatccctttaagagtgccttcccgaacgagcaagcctattggcgcgatgtgggcaccttggactctttttggctggccaatatggaattgttgtcgcctacgcccgcattaaacctttacgatgcgaaatggcctatttggacctatcaagagcaattaccgcccgctaagtttgtattcgacgatgatgatcggcgcggcatggcggtggattctattatttccggtggctgtattatctcgggcgcaaccgtgcgtcgcagcgtattgtttaacgaggtacgtgtctgttcttactctgtggttgaggattccgtggtactgccagatgtagtagtactgcgccactgtaagatcaaaaacgccattatcgataggggttgtattatccccgaaggtactgtgattggttataaccacgaccacgacagagcaaaaggctttagggtgtccgaaaaaggcatcaccttagttacccgcgatatgttaggactgccagtgggctacgagtaa

SEQ ID NO: 14649 - protein, 420 aa, Shewanella oneidensis
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDDMRILGFEEKPQLPKHCPGNPEKCLASMGNYVFNTEFLFEQLKKDAQNAESDRDFGKDIIPSIIEKHKVFAYPFKSAFPNEQAYWRDVGTLDSFWLANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 14650 - DNA, 1107 bp, Oceanobacillus iheyensis
  CDS (1)..(1107)
atggaacgtatgatgggccttgtgaatttagaacatgaacatcacttattaaatgaactggcatactttcgtaatccggcttccattccgttcggaggaaggtaccgcctcattgacttcacattatcaaatatggtgaattcttcgattcaagaagtcgcgatatttgttcggaataaatataggtcgttactagatcacattggtaccggtgaaaattgggagttagatcgtcgaaacggaggattatttatattgcctccggattggaatgatccaactgatcgatctagaggagatttaaagtttttccataataatcgggattatttcaatcgtagtaattctaaatatgtgttaataagtggtagtcaattcatctccaatacggattacaaagaagcgctcgagcaacatataaaagagcaggcagatgtaacactaataaccgttagagaagaagagctttcgaatgaacatgagtccaatttacgagtggaatgtgattatatacatcgagttcaagcgttaaccaatgataagaataatccggaaatttttacgggagtatatattatcaacaaagatttattaattgaactggtagataattgtatcgcgtatcataaggaccatttttttcatgcagcgattatggaaagactgggggatttacgtgtttttcgatttcggcaagaaggatatcacgcatttattaactctgtagaaagtttttataagcataatatgaagctgctacaggaggatagttaccagcagttatttttaaacaaccattttgtgcgtacaaaaatatccaataatgctccggttaagtacggtgaaaaggcagaagtagtgaatacattggttgcaaatgggtgtaaagtgaatggctgtattgaagggagtatactgtttcgaggtgtccaacttcatgaaggggcaacggtgaaaaattcgatcattatgcaacgatgtacaattggctcaggtgttcatttggaaaatgtaatattagataaagacgtcgtagtaacaacagggcagcgaattataggatcaaaggaaaaaccatacgtcgtagccaaaagacaagtaatataa

SEQ ID NO: 14651 - protein, 368 aa, Oceanobacillus iheyensis
MERMMGLVNLEHEHHLLNELAYFRNPASIPFGGRYRLIDFTLSNMVNSSIQEVAIFVRNKYRSLLDHIGTGENWELDRRNGGLFILPPDWNDPTDRSRGDLKFFHNNRDYFNRSNSKYVLISGSQFISNTDYKEALEQHIKEQADVTLITVREEELSNEHESNLRVECDYIHRVQALTNDKNNPEIFTGVYIINKDLLIELVDNCIAYHKDHFFHAAIMERLGDLRVFRFRQEGYHAFINSVESFYKHNMKLLQEDSYQQLFLNNHFVRTKISNNAPVKYGEKAEVVNTLVANGCKVNGCIEGSILFRGVQLHEGATVKNSIIMQRCTIGSGVHLENVILDKDVVVTTGQRIIGSKEKPYVVAKRQVI

SEQ ID NO: 14652 - DNA, 1158 bp, Oceanobacillus iheyensis
  CDS (1)..(1158)
atgagtgaatgcatcggaatgttattagcgggaggagaaggaaagcgactgggcatgttaacgaaacaaggagcaaagcccgctgttccgtttggaggtaagtatcgtattattgattttactttaagtaattgtactaactcagggatacaaacagtaggtatactaacgcagtatgctcctttggaattgaataaacatatcggtaatggaaagccgtgggatatgaaccatcaacatggtggagtttcgatattacccccctacacaggaacaaaaggcggggattggtattcaggtacggcggatgccatctatcaaaatatgaactttatccatcaatatgaacctgagtacgttcttatcatatcaggcgatcatatttatcaaatggattatcaacaaatgttagagcagcataaacgaacgaatgcggatgtaacaatctctgttattgaagttccgtgggcagaggcaggacgctttgggatattgcatgcgaatgacgaacaaataatttatgaattcgaagaaaaaccaaaaaacccatccagtaatttagcctcgatgggaatttatatttttaactggaaaacgctaaaaaagtatttaatcgaggacgcaaataaaccgaattcgagccgtgattttggtaaagatattattccgtccatgttaaataatcagcaccgcctatatgcattcaaatttaacggttactggaaggatgttgggacgattcaaagttattgggaagccaatatggatgtgctgaaagataataatggatatttttcgttacatgatcgaaattggcgtatctatacacatgactcgaatttaccaccacattttattggaaccaatggtaaagcagtaaacagctatattaattctggttccattatttatggtcatattaaaaactcaattgtgtttcgtaatgtcagtgttcaacagggaagttatataaaccaatcgatcattcacccaaatgtaaagataggaaaagattgtgtacttgatcgtgtgattgtgatggagaatacgacgattccagaagggactatctttcgttcggataaagagatagaaccattcattattaataatgagatattaaattcaatgcttgcaccagcaggaggagacgtataa

SEQ ID NO: 14653 - protein, 385 aa, Oceanobacillus iheyensis
MSECIGMLLAGGEGKRLGMLTKQGAKPAVPFGGKYRIIDFTLSNCTNSGIQTVGILTQYAPLELNKHIGNGKPWDMNHQHGGVSILPPYTGTKGGDWYSGTADAIYQNMNFIHQYEPEYVLIISGDHIYQMDYQQMLEQHKRTNADVTISVIEVPWAEAGRFGILHANDEQIIYEFEEKPKNPSSNLASMGIYIFNWKTLKKYLIEDANKPNSSRDFGKDIIPSMLNNQHRLYAFKFNGYWKDVGTIQSYWEANMDVLKDNNGYFSLHDRNWRIYTHDSNLPPHFIGTNGKAVNSYINSGSIIYGHIKNSIVFRNVSVQQGSYINQSIIHPNVKIGKDCVLDRVIVMENTTIPEGTIFRSDKEIEPFIINNEILNSMLAPAGGDV

SEQ ID NO: 14654 - DNA, 1467 bp, Corynebacterium efficiens YS
  CDS (1)..(1467)
atgaccatacgtgcagcggtttcccatcccgtcggaccctccgggcgcaacccgggtacaggacagatgcgggatgccatgcagtgtgggcacggagcggggtgtgggtcgcgacctcccaggtgcccccgtcggcccagcatccggggggcggtcacccaccctcgactgaccccgtggccaccccaaaagaaatacttattcactggtttcaagcgggaacaggtttttcgttttatggttgagtgtgtgaagggtagaccaaatgtattagcaatcgttctcgctggtggcgagggtaagcgtctgtttccgctgacggaggaccgtgccaaaccggccgttcccttcggcggaacctatcggcttattgactttgtactttcaaacctggtcaatgccgggtacctgaagatcgctgtgctcacgcagtacaagtcgcattccctcgaccggcatatctccgtttcctggaatgtttctggcccgaccggccagtacatcgcctcggtcccggcgcagcagcgcctgggcaagcggtggttcacaggctccgcagatgccatcctccagtcactcaacctgatctccgatgagaagccggactatgtcatcgtcttcggcgcggaccatgtgtaccgcatggatccgagccagatggtcgatgagcatattaaatccggcaagtcggtgtctgtggcaggtatccgtgtgccacgccacgaggccaccgcattcggctgcatccagtccgatgatgagggcaacatcaccgaattcctggagaagccggcggatccgcccggtaccccggatgatccggatgtcaccttcgcctccatgggcaactacgtgttcaccaccgaggctctggtgcgtgcgctcaaggatgattcggagaacgaggactccgagcacgacatgggcggtgacatcatcccgtacttcgtagaccgcggtgatgcccatgtgtatgacttctcccgaaacatcgtgcccggtgccaccgagcgcgacaagggatactggcgtgatgtcggtaccatcgacgccttctacgagtgccacatggatctgatttccgtgcacccgatcttcaacctctacaacaaggaatggccgatccacaccaccgtggagggtaacctgccgccggcgaagttcgtgcagggcggtatcgcacagtcctcgatggtcgccccgggatccatcatctcggcgggtactgtgcgtaactccgtgctgtccaccgatgtcatcgtcgaggagggggccaccgtggagggcgcggtcctcatgccgggcgtacgcatcggtaagggagcggtggttcgccacgccatcctggataagaacgtcgtggtgcgcgacggtgagctcatcggagtcgatcacgaccgtgattcccagcgcttcaaggtcagtgccggcggtgtggtcaccgtgggtaagaaccaggtggtctga

SEQ ID NO: 14655 - protein, 488 aa, Corynebacterium efficiens YS
MTIRAAVSHPVGPSGRNPGTGQMRDAMQCGHGAGCGSRPPRCPRRPSIRGAVTHPRLTPWPPQKKYLFTGFKREQVFRFMVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 14656 - DNA, 1119 bp, Corynebacterium efficiens YS
  CDS (1)..(1119)
atgtctagttctgagaaaaacggctccctggatgcatccgcaggtgcgtctgttgatgtggatgccgtcatcctcgtcggtggtaagggaacccgactccgccccctgacgaacaacaccccgaagccgatgctccccacggccgggcacccgttcctcaagcatctgctggcgaggatcaaagccgccggtatcacccacgtggtgctgggaacatccttcaaggcggaggtgttcgaggattacttcggggacggctcggatctgggacttgagatcgagtacgtcgtggaggatcagcccctggggaccggtggcggtatccgcaatgtctatgacaagctccgtcatgacaccgccgtggtattcaacggcgatgtgctctccggtgcggacctcggtgacattctggccacccaccgcgagaaggaggccgacctgacgatgcacctggtgcgcgttgccaacccccgtgccttcgggtgtgtccccaccgatgccgatggccgggtcctggaattcctggagaagaccgaggacccgccgaccgatcagatcaacgcgggttgttatgtcttccagcgggagctcatcgcctccatcccggccgaccgtgtggtgtcggtggaacgggagacgttcccccagctcctgcaggagggcaggcgtgtctacgggcacgtggacacctcctactggcgtgacatgggcaccccgcaggatttcgtccgtggatccagtgacctggtccggggtatcgcattctcccccctcctggaggggcagacgggggaggagttggttgatccttccgccggtgtgcgtgacggggtgatcctcctgggtggcacggtcgtggggcggggcacggagatcggtgcgggctgccgcctggacggcacggttgtcttcgacggtgtcaccatcgagccgggggccttcatcgagaattccatcatctcctccggtgtccgcatcggtgccaacgcccatatctcggggtgtgtgatcggtgagggggcgcagatcggtgcccggtgtgagctcagttcgggcatgcgtgtgttcccgggtgtcgtcattcccgatggtggtatccgattctcctcggatcagtag

SEQ ID NO: 14657 - protein, 372 aa, Corynebacterium efficiens YS
MSSSEKNGSLDASAGASVDVDAVILVGGKGTRLRPLTNNTPKPMLPTAGHPFLKHLLARIKAAGITHVVLGTSFKAEVFEDYFGDGSDLGLEIEYVVEDQPLGTGGGIRNVYDKLRHDTAVVFNGDVLSGADLGDILATHREKEADLTMHLVRVANPRAFGCVPTDADGRVLEFLEKTEDPPTDQINAGCYVFQRELIASIPADRVVSVERETFPQLLQEGRRVYGHVDTSYWRDMGTPQDFVRGSSDLVRGIAFSPLLEGQTGEELVDPSAGVRDGVILLGGTVVGRGTEIGAGCRLDGTVVFDGVTIEPGAFIENSIISSGVRIGANAHISGCVIGEGAQIGARCELSSGMRVFPGVVIPDGGIRFSSDQ

SEQ ID NO: 14658 - DNA, 1245 bp, Bifidobacterium longum
  CDS (1)..(1245)
atgaccaagaatcccaagattctgtcgattgtgcttgcaggtggtgaggggacccgcctgatgccgttaacccgtgatcgcgcgaagcccgccgttcccttcggtggtgtgtatcgtctgatcgatttcccgttgagcaacctggtgaactccgggtaccgtcaggtcgtggtgctcacccagtacaagtctcactcgcttgaccgccacatctcccaggtctggcgtttctccccgctgcttggctcgtacgtctcccctgtgcccgcgcagcagcgtctcggcaagcactggtatctcggctccgccgacgccatctaccagaccatcaacatcatcgaggatgtccagccggacatcgtggtgatcgtgggtgccgatcacgtctaccgcatggacttcgaacagatggtacagcagcacatcgagtccggcgccgagttcaccgtggccggtatccgccagcccatcgaggaatcgaaccagttcggtgtgattgaggtcgatcccgatcacccgaacatgatcaagaacttccaggagaagccgcccaccaccaccggtctgccggacaatccgaaccagattctggcctccatgggtaactacgtcgccaacaccaaggccctgttcgaggctctggctctcgatgagaaggctgccgacaccaagcacgacatgggcggcgacatcgccccgtacttcgcttcccgcaacgaagccggcgtctacgacttcaactcgaacgagattccgggctccacggccactgatcacgcttactggcgcgacgtcggtacgattaagcagttctacgatgcgcacatggatctgatcgcctatgtgcccgagttcaacctgtacaaccaggattggccgatttacacgatgtccggcaacctgccgccggccaagttcgtgcacgccggccgcgaccgtctgggccacgccaccgattcgatcgtctcccccggtgtgatcgtctccggcggtgaagtgcaccactccgtgctctcccccaatgtgcgtatccactcgtgggcacagattgtcgattccgtgctgttcgacggtgtagtcatcaaccgccgcgcccgcgtgtacaaggcgattcttgacaagaacgtggtgctcaccgagaactccactgtcggcatcgataccgagcacgatctggcccgtggcttcaccgtcacgccggatggcatcacggttgtcccgaagaacaccatcgtcgatgactga

SEQ ID NO: 14659 - protein, 414 aa, Bifidobacterium longum
MTKNPKILSIVLAGGEGTRLMPLTRDRAKPAVPFGGVYRLIDFPLSNLVNSGYRQVVVLTQYKSHSLDRHISQVWRFSPLLGSYVSPVPAQQRLGKHWYLGSADAIYQTINIIEDVQPDIVVIVGADHVYRMDFEQMVQQHIESGAEFTVAGIRQPIEESNQFGVIEVDPDHPNMIKNFQEKPPTTTGLPDNPNQILASMGNYVANTKALFEALALDEKAADTKHDMGGDIAPYFASRNEAGVYDFNSNEIPGSTATDHAYWRDVGTIKQFYDAHMDLIAYVPEFNLYNQDWPIYTMSGNLPPAKFVHAGRDRLGHATDSIVSPGVIVSGGEVHHSVLSPNVRIHSWAQIVDSVLFDGVVINRRARVYKAILDKNVVLTENSTVGIDTEHDLARGFTVTPDGITVVPKNTIVDD

SEQ ID NO: 14660 - DNA, 1575 bp, Oryza sativa
  CDS (1)..(1575)
atggcgacctgctcgtgggccgccaccacggcggcggcggcgcccccccgcccgcccgccaggtgccgctcgcgcgtcgccgcgctccgccgcacggccgccgcctccgccgccgccgccagctgcgtcctcgccgaagcgcccaaggggctcaaggtggagcaggcggatgcggtcgagccagcggcggcggcggcggcgcggagggacgtggggccggacacggtggcgtccatcatcctcggcggcggcgccggcacgcgcctcttccctctcacgcggaccagggccaagcccgcggtgcctgttgggggatgttacaggctgatcgatatcccgatgagcaactgcataaacagcaagatcaacaagatctacgttctcacccagttcaactcccagtctctcaaccgtcacatcgcgcgcacttataacattggcgagggggttggatttggtgatggctttgtggaggtgctggcagctacccagacaacaggggaatcaggaaagcgatggttccagggaacagccgatgctgtcaggcagttcctgtggctatttgaggatgcaaggctcaaacgcatagagaacatactaattctatctggtgatcatctgtataggatggattatatggactttgtccagaagcatgttgacaaaggtgctgatatttcagtcgcttgtgttcctgtggatgagagtcgagcttctgattttggattgatgaagactgacaagaatggacgcattactgattttctcgaaaagcccaaggatgaaagcttgaaatcaatgcaactagatatgggaacttttggtttgcgcccagaagttgcagatacatgcaaatacatggcttcaatgggaatatatgtattcaggactgatatcttgttaagacttctaagtttgaggtatgctgatactctttctctttgttctgtatcttttagaggacattatcctacagcgaatgattttgggtcagaagttatcccaatggctgcaaaagactacaatgtgcaggcctatctatttgatggttactgggaagatattgggacaataaagtcattctttgaggcaaatcttgctctcacagatcagtcgccaaacttctatttttatgatcctgtgaagcccatattcacatctcctagatttttacctccaacgaaagtagaaaactgcaaggttctgaactctatagtttcccatgggtgctttctaacagaatgtagtgttgatcgctctgttattggtgtccgttcaagattagaaccgggggtgcagctgaaggacaccatgatgatgggggcagattactatcagactgaagctgagagattttctgaattgtctgatggaaaagtaccagttggcgttggagaaaacaccataataaggaactgtatcatcgacaagaatgctcgaattggaaagaatgtaatgattatgaactcacagaatgtgcaagaagcagagagaccattagagggtttctacattcgttctgggataacggtagtgcttaaaaatgcggtgattccagatggtacagttatctag

SEQ ID NO: 14661 - protein, 524 aa, Oryza sativa
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLSLRYADTLSLCSVSFRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 14662 - DNA, 1800 bp, Hordeum vulgare var
  CDS (66)..(1571)
ccctcactttctctcggccgtcgctgccaccgccccaacccgtcactctcttgcccccgacggcgatgatggcgatggcgacggcgatggccgccacgtacggggcaccgatcccggcgccggcaccctccgcatcctctcctcgccgcgctgcccccgatggcgggcggcggctgcgggcggtggcggggaggccgcgtcccctgttctcgccccgggccgtgtccgactcgcgcaactcccagacgtgcctcgatccggacgccagcacgagtgttcttgggatcatcctgggtggtggcgccgggacaaggctgtacccgctgaccaagaagagggccaagcctgcggtgccgctgggtgccaactacaggctcatagatatcccggtcagcaactgcctcaacagcaatgtgtccaagatctatgtgctgacgcagttcaactccgcgtcgctcaaccgccacctctcgagggcctatgggaacaacattggcgggtacaagaatgacggttttgttgaagttctcgccgcgcagcagagcccggagaatcctaactggtttcagggtaccgcagatgccgtgcggcagtacttatggctgtttgaggaacacaatgttatggagttccttattctggctggagatcacctataccgtatggactaccaaaaattcattcaagcacacagagaaacagatgctgatattactgtggctgccctgccaatggatgaggagcgcgcaactgcatttggcctgatgaaaattgacgatgaagggagaattgttgagttctcagaaaaaccaaaaggagagaagttgaaggcaatgatggttgtcaccaccatactgggccttgattctgagagggccaaggaattgccttatattgctagcatgggaatctatgtttttagcaaagatgcgatgcttcggcttcttcgtgacaattttccttcagcaaatgactttggaagtgaggttattcctggtgcaacagaaattggaatgagggtgcaagcttacctatatgatggttactgggaagatattgggactattgaagcattttacaatgcaaacttgggaataaccaagaagccagtaccagattttagcttctatgaccgttctgccccaatttatacacaatctcgatacttgcctccttcaagggtccttgacgctgatgtgactgacagtgttatcggtgaaggttgcgttatcaatcattgtaaaatcaaccattctgttgttggactacgctcgtgcatatcggaaggcgcagtaatagaggactccctgttaatgggtgcagactattatgagacagaaaatgacaagaaagtcctttctgaaactggcggcattcccatcggtattggaaaaaatacacacatcaaaaaagcaataattgacaaaaatgctcgaatcggagaaaatgtgaagataatcaatgttgatgatatccaagaagcttcaagggagagtgatggatacttcatcaaaagtggcattgtcaccgtgattaaggacgccttaattcctagcgggacagtcatatagatgcagccgtcatcgccatgtatataagtgaggttggcttgcagaattaccgtgacctccaatgcatccatgactggtttcccatgcagcaagttcaccaatctctgcatggaagtgtcgtcggcgggaagaacaaaacagtggccaccactcaaggccataataaaactgagaattgcactgttaactagtatatgagcaaatgttttgaagttgaagtaaaaaaaaa

SEQ ID NO: 14663 - protein, 501 aa, Hordeum vulgare var
MMAMATAMAATYGAPIPAPAPSASSPRRAAPDGGRRLRAVAGRPRPLFSPRAVSDSRNSQTCLDPDASTSVLGIILGGGAGTRLYPLTKKRAKPAVPLGANYRLIDIPVSNCLNSNVSKIYVLTQFNSASLNRHLSRAYGNNIGGYKNDGFVEVLAAQQSPENPNWFQGTADAVRQYLWLFEEHNVMEFLILAGDHLYRMDYQKFIQAHRETDADITVAALPMDEERATAFGLMKIDDEGRIVEFSEKPKGEKLKAMMVVTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSRVLDADVTDSVIGEGCVINHCKINHSVVGLRSCISEGAVIEDSLLMGADYYETENDKKVLSETGGIPIGIGKNTHIKKAIIDKNARIGENVKIINVDDIQEASRESDGYFIKSGIVTVIKDALIPSGTVI

SEQ ID NO: 14664 - DNA, 1754 bp, Oncidium cv
  CDS (23)..(1576)
gaaaacaccttgtaagccattcatggagctgtgcatgaagagccaaatcgccctctcggccgcggtgcttcagccgcacgccggctcagggaggttttccgatggagagacaatgggacagcggcttgatttctcgagctttcgccgtgcgaatgagcagatttgccgccggcggagggcatcgttgttgcggatgtctttcgccactactgaacttgtagctgagggaaagttgcgggatttggagttggagggaagagatcctcggacagttgtggcagtcattttaggaggtggagcgggaacccgcctctttcctctcacaaggcaaagggccaaacctgcggtgcccatagggggggcatatagattgatcgatgttccaatgagcaactgtattaatagtggaatcaataaggtgtatattctcacccagttcaactctgcatcactcaacagacatcttttgagggcgtacaatttcagcaatggcataggcttcggggatggttttgtcgaggtattggcggccactcaaactccaggtgaggcaggaaagaaatggtttcaaggcacggccgatgccgttcgtcaattccattggctatttgaggatgccaaaggcaaggaaattgaggatgtactcatcctctctggagatcatctttaccgtatggactacatggactttgttcagagccatagacaaagtggtgcagacatcacaatctcctgtgtgcctatggatgtcagccgcgcatcagattttggtctaatgaagatagacaacaatggaagggttctttcattcagtgaaaaacctaaaggtcaagaattaaaggcgatggaagtggatacttctgtccttggtttgtcgcgagaacaggcaaagaagactccattcattgcttcaatgggggtttatgttttcaagaaggagatactattaaatcttctaagatggcgttttcccactgcgaatgactttggctctgaaataattcctgcgtcagctaaagaactatttgtcaaggcatacctttttaatgattattgggaagatattgggacaataaaatccttttgtgaggcaaatctttctctcacccgacatccacccaatttcagcttttacgacgcaacaaaaccaatatatacatcacgaagaaatttacctccaacggcgatcaacaatagcaagattgttgattctattatatcccatggaagtctcttgagtaactgcttgatagaacacagtgtcgtcggcattcgatccagaataaacgataacgtccacttgaaggatactgtgatgctcggtgccgacctctacgaaactgatgcagaaatagcagcattgcttgctgaaggaagagttcctgttggaataggagagaacacaaagatcaaggattgtatcattgataagaatgcgagaatcggaaagaatgcaacaatctcaaacgttgacggtgtgcaagaagcagaccggagtgctgaagggttctacactcgttcagggattacagttatactaaagaattcaacaatacctgatggatttgccatatgaagcttagtctttatagcctagggttagttattatagcaagtgatattcaatgttttagccacagctacatcatgaataaaattataatgttctgctgctgttaaagtctatttttcgcttccttgtacaataatgattttattaatatttttctcatcaaaaaaaaaaaaaaaaaaaa

SEQ ID NO: 14665 - protein, 517 aa, Oncidium cv
MELCMKSQIALSAAVLQPHAGSGRFSDGETMGQRLDFSSFRRANEQICRRRRASLLRMSFATTELVAEGKLRDLELEGRDPRTVVAVILGGGAGTRLFPLTRQRAKPAVPIGGAYRLIDVPMSNCINSGINKVYILTQFNSASLNRHLLRAYNFSNGIGFGDGFVEVLAATQTPGEAGKKWFQGTADAVRQFHWLFEDAKGKEIEDVLILSGDHLYRMDYMDFVQSHRQSGADITISCVPMDVSRASDFGLMKIDNNGRVLSFSEKPKGQELKAMEVDTSVLGLSREQAKKTPFIASMGVYVFKKEILLNLLRWRFPTANDFGSEIIPASAKELFVKAYLFNDYWEDIGTIKSFCEANLSLTRHPPNFSFYDATKPIYTSRRNLPPTAINNSKIVDSIISHGSLLSNCLIEHSVVGIRSRINDNVHLKDTVMLGADLYETDAEIAALLAEGRVPVGIGENTKIKDCIIDKNARIGKNATISNVDGVQEADRSAEGFYTRSGITVILKNSTIPDGFAI

SEQ ID NO: 14666 - DNA, 1821 bp, Metroxylon sagu
  CDS (22)..(1611)
tggccgggggctcgcatggcgatggctgctaccgggatctcgcgaattccgctcttgaaaaccctaatcccttcgacctctccctctccgtcttccgatcggggctccaatgatctgccgctttgcctcaaaccttctttgaactggcgcctctcctcctcttttcacttctccggcgaggcactcttctccaaagccgtccttgggagcgggaaaacggccgcgggcgggaggactccggttctggtttcccccaaggccgtctcggactcgaagagctcgcagacgtgtctcgatcctgacgccagtcgcagtgttttgggaattatacttggtggtggagctggaacccgcttgtaccctttaacgaagaagagagccaaaccagcagttcctttaggagcgaactacaggttgatagacatacctgtcagcaactgcttgaacagtaatatttcaaagatctatgttttgacacaattcaattctgcttcactcaaccgccacctttcacgagcttatggaagtaacatgggtggatacaagaatgaagggttcgtggaagttcttgctgctcagcagagtccagagaacccaaactggttccagggtactgctgatgctgttaggcaatatctgtggctttttgaggagcacaatgtaatggaatttcttgtccttgctggagatcatttgtaccgtatggactatgagaggttcatccaggcacacagagaaacagatgcggatatcaccgtggctgcacttccagtggatgaaaggcgtgcaactgcttttggcctgatgaagattgatgaagaaggacgcataattgaattctcagagaagccaaaaggggagcaactaaaggctatgaaggttgataccaccattttaggccttgatgaagaaagagcaaaagagatgccatatattgctagcatgggcatctatgtgatcagcaaagacataatgttgcagctacttcgggataaatttcctggggccaatgacttcggaagcgaagtaattcctggtgctaccaatattggaatgagggtacaagcatacttgtatgatggctactgggaggacattgggaccattgaggcattctataatgcgaatctgggaataactaagaagccagtgccagatttcagcttttatgatcgttcatctccaatttacacacaacctcgatatttaccaccttccaaaatgcttgatgctgatgttacagatagtgttattggtgagggatgtgttatcaaaaactgcaagattcaccactctgtggttgggctccgttcttgtatttctgaaggtgcaatcatagaagactcattactgatgggagcggattattatgagacggatcaagagaagaggttcctagctgcgaaaggcagcattccaattggcatcggaaagaattctcatatcaaaagagccatcatagacaagaatgctcgcattggagaaaatgtccagatcgtcaacaatgataatgtgcaagaagcagcaagggagactgatggatacttcatcaagagcggtatcgtcactgtaattaaagatgctttgatccctagtggaaccctcatatagagccttcaggcatattctgtcgcgaatatggaataactcttgctttgttcatcctcacgggatgcgcagtatcatgcgattactttatttgcaggtgccttggtgaaaggaggaccttagttaaggacatttcctgtataaaagctaaataagtttccctcgcgagaagatcatcataaaaaaaaaaaaaaaaaaaaaaaaaaaaaaaaa

SEQ ID NO: 14667 - protein, 529 aa, Metroxylon sagu
MAATGISRIPLLKTLIPSTSPSPSSDRGSNDLPLCLKPSLNWRLSSSFHFSGEALFSKAVLGSGKTAAGGRTPVLVSPKAVSDSKSSQTCLDPDASRSVLGIILGGGAGTRLYPLTKKRAKPAVPLGANYRLIDIPVSNCLNSNISKIYVLTQFNSASLNRHLSRAYGSNMGGYKNEGFVEVLAAQQSPENPNWFQGTADAVRQYLWLFEEHNVMEFLVLAGDHLYRMDYERFIQAHRETDADITVAALPVDERRATAFGLMKIDEEGRIIEFSEKPKGEQLKAMKVDTTILGLDEERAKEMPYIASMGIYVISKDIMLQLLRDKFPGANDFGSEVIPGATNIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDSLLMGADYYETDQEKRFLAAKGSIPIGIGKNSHIKRAIIDKNARIGENVQIVNNDNVQEAARETDGYFIKSGIVTVIKDALIPSGTLI

SEQ ID NO: 14668 - DNA, 1047 bp, Corynebacterium glutamicum ATCC 13032
  CDS (1)..(1047)
atggtcggtggcaaaggtacccgactgcgccccctgaccgtcaatactccaaagccaatgctgccaactgctggccacccattcttgacccaccttttggcccgcatcaaggccgcaggcatcacacacgtcgtgctgggaacgtcattcaaagctgaagtcttcgaggaatacttcggagatggctccgaaatgggcttggaaattgaatatgtcgtcgaggatcagcctttgggcactggtggtggcatccgaaacgtctacgacaagctgcgtcacgatactgcgattgtgttcaacggcgatgtgctctccggtgcggatctcaacagcattctggacacccaccgcgaaaaggacgcagatctgaccatgcatctcgtgcgcgtagctaaccctcgtgcgtttggttgcgtccccaccgatgaggatggtcgcgtcagcgaattccttgaaaagaccgaagatccaccaaccgatcagatcaacgccggctgctacgtgttcaagaaggaactcatcgagcagatcccggcaggccgagcagtttccgtcgagcgcgaaaccttccctcagctgttggaagaaggcaagcgagtcttcggccacgtcgacgcttcctactggcgcgacatgggcaccccaagcgacttcgtccgcggctcggctgacctggtccgcggcattgcgtactccccattgctcgaaggcaaaacaggagagtcgcttgtcgacgcctccgccggcgttcgcgacggcgtcctgctgctcggcggaaccgtagtcggccgcggcactgagatcggtgccggctgccgcgttgacaacactgttattttcgacggcgtcaccattgaaccaggtgcggtcattgaaaattccatcatttcctcgggagcacgcatcggtgctaatgcgcacatctccggttgcatcattggcgagggcgcacaggttggtgctcggtgtgaactcaacgcagggatgcgcgtcttcccaggcgttgtgatcccagacagcggaattcgtttttcgtctgatcagtag

SEQ ID NO: 14669 - protein, 348 aa, Corynebacterium glutamicum ATCC 13032
MVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 14670 - DNA, 1179 bp, Methanosarcina mazei
  CDS (1)..(1179)
atgaaagcatgtatcatgtgcggaggtgcagggacaaggctcagaccgctgaccttcaaacaccctaaacccagcataccgattctcaataaaccgtcagtaaggcacctgatagagcacctttcaagagaagggttcaatgaaatagttatgaccctgggatatatgggggagcgcatagaagaacagctcggggacgggcacatattcggggtacatattgagtatgtgtatgaaaaggagaagatgggcactgcaggcggggttaaaaacgcagaggagtatctgaaaaatgagccttttatcgtgcttgggggagaccacgtacttaaccttgacctgagggagatgtaccgttttcacgagaccaatgacgcaatagtgaccatagggctactttcaattgatgacccgagagaattcgggattgcggatatggatataaataacaggatccaccgcttcctcgaaaaacccaagtccgggcaaatttttagcaaccttgcaagtacaggcatttacatctgtgaccccgaaatcttcgactggatacccgagaataaaaagtatgattttgcaaaagaccttttcccttccctgcttgcagcagatgaaaaaattaacggcatgcttgtccgggggaaatggactgatgtagggagttcggcagcttacaggcaggcccagcgctggatgcttgacgctcttcccgggaccactatagaaggaaactttacgacaagaaacgcaagaatacgcgggcctttatccataggaaacaacgtttgcataggttcgaattcttcccttgtaggaccgattgttataggggaaaacactgtaataggtgacaacgtccttgtggggccttacagcgtaataggcgcgaactgcactattgacgacaatgcaaaaattctttcatcctatctttttgattatgtctctataggaaaaggctccaatatctcagggtcagtggttgccgatgaaacagctgtaggggaaaaatgcagccttgaaaacgggacagtgatcgggcacagagtgaccataggagataactccaccatacattcgggagttaaaatatggcctgaagtgataattgataatgattccagtatagaggaaacaattgttaacctcaattatgatacctcacaggaagggtcgtga

SEQ ID NO: 14671 - protein, 392 aa, Methanosarcina mazei
MKACIMCGGAGTRLRPLTFKHPKPSIPILNKPSVRHLIEHLSREGFNEIVMTLGYMGERIEEQLGDGHIFGVHIEYVYEKEKMGTAGGVKNAEEYLKNEPFIVLGGDHVLNLDLREMYRFHETNDAIVTIGLLSIDDPREFGIADMDINNRIHRFLEKPKSGQIFSNLASTGIYICDPEIFDWIPENKKYDFAKDLFPSLLAADEKINGMLVRGKWTDVGSSAAYRQAQRWMLDALPGTTIEGNFTTRNARIRGPLSIGNNVCIGSNSSLVGPIVIGENTVIGDNVLVGPYSVIGANCTIDDNAKILSSYLFDYVSIGKGSNISGSVVADETAVGEKCSLENGTVIGHRVTIGDNSTIHSGVKIWPEVIIDNDSSIEETIVNLNYDTSQEGS

SEQ ID NO: 14672 - DNA, 1194 bp, Methanosarcina mazei
  CDS (1)..(1194)
atgaaagctgttgtccttgtggcaggaaaaggcacaaggatggaacctcttacttccgactgcccgaaggtgatgcttcaggtagcaaacaaacccgtactcgaacatatccttgattcggctgttgaagcaggcattgaaggttttgtcttcattacaggatacctggaagatcagataaaaactcacttcggggacggaagcagatggggagtgagcattgagtacgtgcagcagaaagagcagctagggactgcaaatgccataggctatgccagagggcacgttgaaggagcattccttgtgcttaacggagacatgctcatagaaaaatctgatttacaatccctgcttgaaagaaaagaggaagctgttatctgcgtaaaagaggtagaaaatccctcggatttcggagtgcttgaaactgaaggagagagagtaatcaggataattgaaaagccaaaaaaccccccaacaaagcttgcaaacgccggaatttatctcttccgggagtcaatttttggctttattgacaggacagagctttctgtaagaaaagaacttgaaataacagactccatccagatgctgatcgacagtggagcgcctgcaggttacagccttctcggagacagctggattgacataggttacccctgggacctcctgaaagcaaacgagcacctcttaaaaaccctgaaaggatactgccggggtaatgttgaaccaaacgttactttaagaggggaggtcgctataggaaaaggctcacttatccggagcggggcttatatcgaaggacctgtggtaataggagattactgcgatatagggcctaactgctttatccgcccatcaacagcaataggcaacaaagtaaggatagggaatgccgttgaggtaaaaaatacaattgttatggaaggcactcatattggtcacctgagttatgtgggtgatagtgttatagggcgccgctgtaattttggagccggcacgaaagttgcaaacctccgccacgacggaaagaacataaaagtaatgctgaaaggaaggattatagattcgggcaggcgaaaactcggtgtgataatgggggatgatgtgcatacaggcatcaatacaagcataaatattggggtcgtaatgggaaaagggagagccacagttcccggagaagtggtcaagcactga

SEQ ID NO: 14673 - protein, 397 aa, Methanosarcina mazei
MKAVVLVAGKGTRMEPLTSDCPKVMLQVANKPVLEHILDSAVEAGIEGFVFITGYLEDQIKTHFGDGSRWGVSIEYVQQKEQLGTANAIGYARGHVEGAFLVLNGDMLIEKSDLQSLLERKEEAVICVKEVENPSDFGVLETEGERVIRIIEKPKNPPTKLANAGIYLFRESIFGFIDRTELSVRKELEITDSIQMLIDSGAPAGYSLLGDSWIDIGYPWDLLKANEHLLKTLKGYCRGNVEPNVTLRGEVAIGKGSLIRSGAYIEGPVVIGDYCDIGPNCFIRPSTAIGNKVRIGNAVEVKNTIVMEGTHIGHLSYVGDSVIGRRCNFGAGTKVANLRHDGKNIKVMLKGRIIDSGRRKLGVIMGDDVHTGINTSINIGVVMGKGRATVPGEVVKH

SEQ ID NO: 14674 - DNA, 2337 bp, Thermoanaerobacter tengcongensis
  CDS (1)..(2337)
atgaaagggataataatggcaggtggagagggaagcagattaaggcctttaacttttgatattccaaagcctttggtgcctgtggcaaataaacctgcgataaagcatattgtagagcatttgcacaagtacggagtgggggaattagcagtcactcttttttatttacctcacaagataaaagattacttgcttgaagagtatggaaatgaaataaagttttacacagaagaaaagcctctggggactgcaggaagtgtgaaaaacgcgaaagatttcctgaaggaaacttttattgtcatgagcggagatgtaattacagatgtaaacataaaggaagtatatgactttcacaggaaaaagggttcgaaagtgactttagttttaaaaaaagtagaaattcctttagagtatggagttgtaatagtcgatgaaacagggaaaatagtaaagtttttagagaaaccgtcgtggggagaggtttttagcgatactgtcaacacagggatttacataattgaaccggaaatacttgaatttatacctgaagatagaccttttgattttagtaaagacttgtttccgcttcttttgaaggaaaacattcctatgtatgggtacattacagaaggctactggtgtgacataggaaatacagcgcagtacctttcaagccattttgatgtgttggaaggtaagctggatttgggttacagaaaaatcctccttgaagaaggaaaagttattggcaagaaggttttaatgtcttcgggagcaaagttgattcttcctttgattataggaaatgaggtggttattgaggaaaatgctgtagtagggcctaatgtggtcataggaagaggtacgattataaagaaaggaagtcatgtaaaaaattctgtactgtgggaagatgtatatgtaggggaaaacagcgaattgaatggagcagtggtgtgcaataaggtcagaatagattctaacgcaaggatattggaaaatgctgtaataggagaaggggttagaataaaggcttttgcagagataagaccggatgtaaaagtttggccttttaaggttatagaggaagaggcagtagtctcaaaggatgtagtttggggaaatggcaggaaaaacctatcttttggttacagagggataaggggcatttttaatgaagagataggtccttatcaggctgtagaaattggggaggcctttggggatttaatgaaagggaaagtcattgtgggaagtgatgaggaactagcttcctctctcattgccgatttgattgcttacgggcttgctttttccgggtgtgaagtgttaaaaagcaatagctttctgctgccggctttaagagtgggaatcaggttaagaagtgcaaaaggaggggtgtatgtagaaaggataggggaggaaattagaattttatttttggatggagagggaatggatatagatagaaatttggagaagaagatagagaataaattaaaaattcacgacatatcaagaagaaaaatagaagacataaagccaataaaagaggtggatgtagagggagattataaggattatcttgtcaaaaatagagcagattctttcaagataaaggttaagcctcatgatgaatggactaaaaaagtgcttctgcagataaaaggagagcaaattttagatgaccaaaactatcacttgaaagtgaaattgaaaaagaatggggaagagatagaactttatgacgaaaaagataggaaatttgatgaagatgaagtgaattatctaaagatgttgattgccagggaaaaaggtctaaagaaagttgtactgccttttaacagttccaagtatttggcagagtttgcagaagaacttgcagtagagacagttgtaggaaagatttcaccaagggaccttatgaggtcgatgactaatttagaagagggaaggcaggtgtattttgacctttcttttgacgggataaactttttgttagaagtgattgaatacgtaaggttaaagaataaaaggctttcggagataaaagatagttttcctcttaggtataaaacagtcaagagaataagatgtgattggaaggataaggggagaataataagagaactgtttgaaacccgtaaaaataatgttacatttttggatgggctaaggtttgaagaggatgaaggatgggttctagtggttcccgatagcgaacttcctttttgcaatgtgtatgtggaggcattgacaccggagaaagctgaaaggctttttacaatttatgaaaaaaagatacaggatattttattgaaaaatgatggaaagtga

SEQ ID NO: 14675 - protein, 778 aa, Thermoanaerobacter tengcongensis
MKGIIMAGGEGSRLRPLTFDIPKPLVPVANKPAIKHIVEHLHKYGVGELAVTLFYLPHKIKDYLLEEYGNEIKFYTEEKPLGTAGSVKNAKDFLKETFIVMSGDVITDVNIKEVYDFHRKKGSKVTLVLKKVEIPLEYGVVIVDETGKIVKFLEKPSWGEVFSDTVNTGIYIIEPEILEFIPEDRPFDFSKDLFPLLLKENIPMYGYITEGYWCDIGNTAQYLSSHFDVLEGKLDLGYRKILLEEGKVIGKKVLMSSGAKLILPLIIGNEVVIEENAVVGPNVVIGRGTIIKKGSHVKNSVLWEDVYVGENSELNGAVVCNKVRIDSNARILENAVIGEGVRIKAFAEIRPDVKVWPFKVIEEEAVVSKDVVWGNGRKNLSFGYRGIRGIFNEEIGPYQAVEIGEAFGDLMKGKVIVGSDEELASSLIADLIAYGLAFSGCEVLKSNSFLLPALRVGIRLRSAKGGVYVERIGEEIRILFLDGEGMDIDRNLEKKIENKLKIHDISRRKIEDIKPIKEVDVEGDYKDYLVKNRADSFKIKVKPHDEWTKKVLLQIKGEQILDDQNYHLKVKLKKNGEEIELYDEKDRKFDEDEVNYLKMLIAREKGLKKVVLPFNSSKYLAEFAEELAVETVVGKISPRDLMRSMTNLEEGRQVYFDLSFDGINFLLEVIEYVRLKNKRLSEIKDSFPLRYKTVKRIRCDWKDKGRIIRELFETRKNNVTFLDGLRFEEDEGWVLVVPDSELPFCNVYVEALTPEKAERLFTIYEKKIQDILLKNDGK

SEQ ID NO: 14676 - DNA, 1050 bp, Thermoanaerobacter tengcongensis
  CDS (1)..(1050)
atgaaggcgcttcttctagcggggggactgggaaccaggttaaggccccttactgacgatttgccaaagcctatggttcctataatgggaaagccgcttttggagcgcattattttaaatcttaaaaaaagtggagtagacgaagtggtcataagcactcattataaatccgactacattgaaaactacttcaaaggcaagagcaaagaactaggggtaaagattcattatgtcacagaagagactcctttaggcacgggaggagctataaaaaatgctgaaaagttttttgacgacactttcttaattctcaactccgatatagtgagcgatatagactatgcagacttggtgaaatatcacaagagaaggagagcacaggttactattgcttccatagaagtgagagatacttcccagtacggggtcatagagtttgacagcaagggttttatcactgcttttaaagagaagccaaagcctggggagtcaaattctaagtatataaatgcaggagtttatgtgtttgagccggaggtcttaaaggaaattccagctaacactcaggtatctgtagaaagggaaacatatcctttgcttctttcaaaaggctataaaatggctatatataagtttactggctattggatggacatagggactgtggacaaatataaaaaggtacatgaagacatcctcaaaggcaaatctagatttgtagcaggattgtccacgagagggataatcctcggagagaatgtgaaaatccaccctacagccagtgtaattgggccagcctatattggggataatacagaagttgatgcttatgctactgtagggccttacactgtgataggcagtaactgcaggataggacaggagagcaaggtttccaatagcgtgctgtgggacaacataaaggtgagaagatttgcaagattggaaaatagcgtggttacctcggaatgcgtagtggaagtgaatatggagattaaaaacacggtttttactgctaataagttagctgatattacgctcacaccttga

SEQ ID NO: 14677 - protein, 349 aa, Thermoanaerobacter tengcongensis
MKALLLAGGLGTRLRPLTDDLPKPMVPIMGKPLLERIILNLKKSGVDEVVISTHYKSDYIENYFKGKSKELGVKIHYVTEETPLGTGGAIKNAEKFFDDTFLILNSDIVSDIDYADLVKYHKRRRAQVTIASIEVRDTSQYGVIEFDSKGFITAFKEKPKPGESNSKYINAGVYVFEPEVLKEIPANTQVSVERETYPLLLSKGYKMAIYKFTGYWMDIGTVDKYKKVHEDILKGKSRFVAGLSTRGIILGENVKIHPTASVIGPAYIGDNTEVDAYATVGPYTVIGSNCRIGQESKVSNSVLWDNIKVRRFARLENSVVTSECVVEVNMEIKNTVFTANKLADITLTP

SEQ ID NO: 14678 - DNA, 1164 bp, Fusobacterium nucleatum
  CDS (1)..(1164)
atgataagaagttatatggcaattatttatttaggtgatagtaaaaaaaatataagtcctttaactaaggttagagctttagcgtctattcctgttggaggttcatatagaattatagacttttctttatctaatgttgttaatgctggaataagaaatgttggtttattttgtggaaatgaagagttaaactctttaactgaccatattggtatgggagcagaatgggatttagcaagaaaaaaagatggaatatttatctttaaaagaatgttagatgataacttttctttaaatcaagcaagaatcagtaaaaatatggaatatttttttagaagtactcaacaaaatattgtagttttaaatgcacatatggtttataatctagatgtaagtgatttaattgaaaaacatgaagcctctggaaaagaaataacaatggtttataaaaaagttaagaaagctaatgaacattttaaccattgttcttcagtaaaaattgatgaaaataatcgtgttattggaataggtcaaaatttattttttaaagaagaagaaaatatttctttagatgcttttgttttaagtaaagagcttatgttaaagttactagttgatagcatacaagaaggaaaatacaatgtactttctgaattaattgcaagaaatttaccttctttaaatataaatgcttatgaatttaaaggatatttacaatgtataaattctacaagagaatattttaactttaatatgaatttattaaatcaaaaaataagagatgatgtctttggaataaaatcaggcagaaaaatatttacaaaagtcaaagatactcctcctactctttttaaagaaacagctgatgtagaaaattcattagtttctaatggttgtatcattgaaggtacagttaaaaatagtatactttcaagaggagctattatagaaaaagatgtagttttagaagaatgtgtaattttacaagattgccatattaaaaaaggtgctcatttaaaaaatgttattgtagataaaaataatattattcatgaaaatgaaaaattatctgcttcaaaagaatatccattagttatagaaaagagtatgaaatgggatacaaaacaatatcaagatttaatggattatattagaaataaataa

SEQ ID NO: 14679 - protein, 387 aa, Fusobacterium nucleatum
MIRSYMAIIYLGDSKKNISPLTKVRALASIPVGGSYRIIDFSLSNVVNAGIRNVGLFCGNEELNSLTDHIGMGAEWDLARKKDGIFIFKRMLDDNFSLNQARISKNMEYFFRSTQQNIVVLNAHMVYNLDVSDLIEKHEASGKEITMVYKKVKKANEHFNHCSSVKIDENNRVIGIGQNLFFKEEENISLDAFVLSKELMLKLLVDSIQEGKYNVLSELIARNLPSLNINAYEFKGYLQCINSTREYFNFNMNLLNQKIRDDVFGIKSGRKIFTKVKDTPPTLFKETADVENSLVSNGCIIEGTVKNSILSRGAIIEKDVVLEECVILQDCHIKKGAHLKNVIVDKNNIIHENEKLSASKEYPLVIEKSMKWDTKQYQDLMDYIRNK

SEQ ID NO: 14680 - DNA, 1179 bp, Methanosarcina acetivorans
  CDS (1)..(1179)
atgaaagcatgtatcatgtgcggaggcgcagggacaaggctcaggccgctgaccttcaagcacccgaaaccgagcataccgattctcaataaaccatcagtccggcacctgatagagcacctttcaagggaagggttcaatgagatagtcatgaccctcggatatatgggagaacgcatagaagaacagcttggagacgggcatatgtttggggtacacatcgattacgtgtatgagaaagaaaagctggggacagccggcggggtaaaaaatgctgaaaagtatttgaagaacgagcctttcattgtgcttgggggagaccacgtccttaacctcgacctgagggagatgtaccgcttccacgaagcaaacgacgccctgataactataggcctcctttccattgacgacccgagggaattcgggattgccgatatggatataaataaccgaatccaccgttttctggagaaacccaaatcaggccagattttcagtaatcttgcaagcacaggcatttatatctgtgaccccgaaatcttcaactggatccctgaaaataaaaagtatgattttgcaaaagacctattccctgccctgcttgcagcagataagaaaattaacggcatgcttgtccggggaaaatggactgatgtagggagttcggcggcttacaggcaggcccagcgctggatgcttgatgctcttcccggaaccacaatcgaaggaaacttcacaacaagaaacgcaagaatacgaggccccctctccataggaaacaacgtatcaataggttcgaattcttcactcgtcgggcccattgtcataggggaaaacaccgtaatcggcgatagcgtccttatcgggccttacagtgtgataggggcaaactgcactatcgaaaataatgcaaagattctttcttcttacctttttgatggggtatccataggtaaaaactccaacatctccggagctgtagttgcagatgaaacagctgtaggagaagagtgcaaccttgagaatgggacagtaatcgggcataaagtcgtgataggggacaattcgaccatacattcggggataaagatctggcccgaagttgtgatcgaaaagaattccagcataaaggaaactgtcgtcaacccagcttatgatactacgtatgaaggctcctga

SEQ ID NO: 14681 - protein, 392 aa, Methanosarcina acetivorans
MKACIMCGGAGTRLRPLTFKHPKPSIPILNKPSVRHLIEHLSREGFNEIVMTLGYMGERIEEQLGDGHMFGVHIDYVYEKEKLGTAGGVKNAEKYLKNEPFIVLGGDHVLNLDLREMYRFHEANDALITIGLLSIDDPREFGIADMDINNRIHRFLEKPKSGQIFSNLASTGIYICDPEIFNWIPENKKYDFAKDLFPALLAADKKINGMLVRGKWTDVGSSAAYRQAQRWMLDALPGTTIEGNFTTRNARIRGPLSIGNNVSIGSNSSLVGPIVIGENTVIGDSVLIGPYSVIGANCTIENNAKILSSYLFDGVSIGKNSNISGAVVADETAVGEECNLENGTVIGHKVVIGDNSTIHSGIKIWPEVVIEKNSSIKETVVNPAYDTTYEGS

SEQ ID NO: 14682 - DNA, 1194 bp, Methanosarcina acetivorans
  CDS (1)..(1194)
atgaaagcagttgtcctcgtagcaggcaaaggcacaaggatggaacctcttacctccgactgcccgaaagtgatgcttaaggttgcaaacaaaccgatacttgaacatatcctgaactcagccatagaagccggtatcgagggttttatcttcattacgggataccttgaagaacaaataaaagcccacttcggggacggaagcaaatgggaagtgagcattgagtacgtacagcaaaaagagcagcttgggactgcaaatgcgataggctatgcgaggggacatgttgaaggagctttccttgtacttaacggggacatgctaatagaacaggaggacttaaaggctctggtttcaagggaagaagaggctgttatctgcgtaaaagaggtagaaaacccctctgatttcggggtgcttgagaccgagaatgataaagtggtcaggataattgaaaagccgaaaaaccctccgaccaaccttgcaaatgccggcatttaccttttcagggaatccatttttgacttcattgacaaaacccaaccctccgtgagaagggaacttgagataacagattccatccagatgcttatcaacagcggggcacctgtgggctacagctccctcgaaggtaggtggattgacataggatatccgtgggaccttcttaaagcaaacgaacaccttttaaaagacctcaaaggcagctgcgaaggtaccgttgaaccatatgcaatcataaaaggagaagtttcaatcggaaaaggctctctcatccgaagcgggtcctatatcgaggggcctgtggtgataggtgagaactgtgacatagggcctaactgctttatccgcccttcaactgcaatagacaaccatataaggataggaaatgctgtggaagtgaaaaacacaattattttggaagacactcacgtagggcacttgagttacgtgggagacagcgtaataggccaccattgcaattttggggccgggacgaaggttgcaaacctccgccatgacggaaagaacataaaggtaatgttgagaggcaggatcctggactccggtagaagaaaactcggcgtgatcatgggagatgatgtgcacacaggcatcaataccagcataaatattggcgtggtaatgcacaaaggaagagccacacttcccggagaagtggtcaagcactga

SEQ ID NO: 14683 - protein, 397 aa, Methanosarcina acetivorans
MKAVVLVAGKGTRMEPLTSDCPKVMLKVANKPILEHILNSAIEAGIEGFIFITGYLEEQIKAHFGDGSKWEVSIEYVQQKEQLGTANAIGYARGHVEGAFLVLNGDMLIEQEDLKALVSREEEAVICVKEVENPSDFGVLETENDKVVRIIEKPKNPPTNLANAGIYLFRESIFDFIDKTQPSVRRELEITDSIQMLINSGAPVGYSSLEGRWIDIGYPWDLLKANEHLLKDLKGSCEGTVEPYAIIKGEVSIGKGSLIRSGSYIEGPVVIGENCDIGPNCFIRPSTAIDNHIRIGNAVEVKNTIILEDTHVGHLSYVGDSVIGHHCNFGAGTKVANLRHDGKNIKVMLRGRILDSGRRKLGVIMGDDVHTGINTSINIGVVMHKGRATLPGEVVKH

SEQ ID NO: 14684 - DNA, 1218 bp, Methanosarcina acetivorans
  CDS (1)..(1218)
atgaaagctattatcctcgcagcaggggaaggactgcgctgcaggcctcttacgcttactcgttccaaagtaatgcttcctgtggccaacagacccattctggaacacgtcatatcttcgcttgagaaaaacggaataaaagagatcatccttatagttggatatgaaaaagaacgcataatgaactatttcgaagacgggctgaatttcggagtcaatataacatatgtagagcaaaaagcccagcttgggacagcacacgcaattgaacaggcaaaaaaactgataagtcccgaagattccgaattcctcgtccttaacggagacaacctggtagaatcaaaaaccattgcggatcttcttaacaactataagggagatgcaagccttttaaccgtgagaatggaggacacggcggggtatggagtggtattgaaagaaaataagagagttaccaggattctggaaaaaagacctggagacctgagccatatcgtaaacacgggaatttatatttttacgccgcaggtttttgaaacaattgaaaaaactccgatatccgaaaacggagaatacgcaataaccgatactctccagcttatgattgacgaaggaaaaatcgtcacttcaatcccaaccgaatccaaatggctggatgcagttcatgcctgggacctcctgaaagcaaactcaactgtattaaactcttccagaaacctcaaacaagaaggagaacttgaagaaggggtaataattcgcgggaaggttgcaatcggcaaaaactcgagaatccgtgccggaacctacatcgtaggcccggtggtaatcggcgaaaactgtgatataggacctaatgtagtaattctgccctctactacaataggagacaatgtatccataaggtcctttaccgaaatccagaacagcatcataatgaatgactgcaggatttcttcccacggacagatttctaattgcataatcgggagcaacaatacccttggtccgggctttactgcagaggaaaaagaaaaccttgagataaacataaactgcaagattcacagtgctccgaagctcggtaccatatttggagacgataaccggataggaggcagggtgcttgtgaaagccggagtaatgattgctgttaactgccaggtagagtccggaaacaccatttacagagacctcccccgtgattcggtggtcctctga

SEQ ID NO: 14685 - protein, 405 aa, Methanosarcina acetivorans
MKAIILAAGEGLRCRPLTLTRSKVMLPVANRPILEHVISSLEKNGIKEIILIVGYEKERIMNYFEDGLNFGVNITYVEQKAQLGTAHAIEQAKKLISPEDSEFLVLNGDNLVESKTIADLLNNYKGDASLLTVRMEDTAGYGVVLKENKRVTRILEKRPGDLSHIVNTGIYIFTPQVFETIEKTPISENGEYAITDTLQLMIDEGKIVTSIPTESKWLDAVHAWDLLKANSTVLNSSRNLKQEGELEEGVIIRGKVAIGKNSRIRAGTYIVGPVVIGENCDIGPNVVILPSTTIGDNVSIRSFTEIQNSIIMNDCRISSHGQISNCIIGSNNTLGPGFTAEEKENLEININCKIHSAPKLGTIFGDDNRIGGRVLVKAGVMIAVNCQVESGNTIYRDLPRDSVVL

SEQ ID NO: 14686 - DNA, 1071 bp, Methanopyrus kandleri
  CDS (1)..(1071)
atgaacgtggacgcggtggtgctcgcgggcgggttcggcacaagactgcgccccctgacctgggatacgcctaaacccctggttcccatcctgggtaagccgctcatcgagtgggtgatccgctccctaccccgtgacgtcgttcacgttcacatcgccgccggtttcagctccgagaagctcgagcggtacgtcgagtccgatcccctccccaggaagcttcacctgaaggtagaacccaagccactcgacaccgccggtgcgatcaagttcgcgtgccgagactccacggccgacgccttcgtagcgttcaacggggacatagtctcctcgctcgacgtacgccagatgttgaagttccaccgtgagcacgacgggatcgccacgatagccctgtatccagtacccgaagacgaagtctcacgcttcggtgtagtggacctggacgatgacgaccgcatcctcgacttcgtcgagaagcccgagccggaggaggctccctcgaacctcatcaatgccggcgcgtacgtgctggaccgggaggtgctggactacatacccgaagggcgccccgtatcgatcgagcgcgagatcttcccgaaactcgccgaggaaggcctgctatacgggttcaagttcgaaggatactgggtggacgtgggcctccccgaaacttacctcgaagcacatcgcgttctgatggagcatgaatgttctgggaagtccgtggtaggagcacggatcaccgataccgacttgaagccaccggtagtagccgcaccgatgaccgagctccgatcctcagagatcggaccgtacgtgtacgtgggtgagaggacagaaattaacggatcagtaatcgagaactccgtcatcctagacgatgtagagatcatcgactctgaggtccgcaacaccatcgtagccgaagggtgtaagatcgagaacgcacggctcgacgggtgtgtgctgggtcatgatgccgaggtgtgtggttgcaacctcaagggtgttcgggtggctcccggtaaggaagccgagcgggacctcgaggatgagtgggtgatctga

SEQ ID NO: 14687 - protein, 356 aa, Methanopyrus kandleri
MNVDAVVLAGGFGTRLRPLTWDTPKPLVPILGKPLIEWVIRSLPRDVVHVHIAAGFSSEKLERYVESDPLPRKLHLKVEPKPLDTAGAIKFACRDSTADAFVAFNGDIVSSLDVRQMLKFHREHDGIATIALYPVPEDEVSRFGVVDLDDDDRILDFVEKPEPEEAPSNLINAGAYVLDREVLDYIPEGRPVSIEREIFPKLAEEGLLYGFKFEGYWVDVGLPETYLEAHRVLMEHECSGKSVVGARITDTDLKPPVVAAPMTELRSSEIGPYVYVGERTEINGSVIENSVILDDVEIIDSEVRNTIVAEGCKIENARLDGCVLGHDAEVCGCNLKGVRVAPGKEAERDLEDEWVI

SEQ ID NO: 14688 - DNA, 1278 bp, Methanopyrus kandleri
  CDS (1)..(1278)
atgatcggtatcgtgctcgcggcgggcgaaggtacccggatgcgaccgctgacgaagacacggccgaaggtcctcctgccggtggccgatcgccgtcttatcgacttctccatcgaggccatgaagcgcatcggagtggaacacctcgtggtggtcgtggaatacctggccgagaaggtggaacggtacgtcaaggatcgctggggcgattccttcgagctggagttcgtccgtcagggtaagcccctgggaacagcccacgctgtgtacgtcgcgtggcgggagatcgaacccgacgagaccgtggtcatcacaaacggggacttggtgttcgattcggagttgctcgagcgcgcggtacgtgagcacgaaggcgtcgcctcaatggtgctagtggaggtcgaggatccgtcggaattcggggtcgcgagactacaagacgggtacgtggtggagctcgtggagaaacccaagcccgaggaggctccctccaacctggcgaacgcgggagtgtacgtggcggaaccggagttcgagaggtttttggaacgagtcaaaccctctccgcggggcgagttcgagatcaccgatgcgctgctcgacgccgccatcgatgaaggtgttctagggatttcgtacgacgggttctggtccgacgtaggtcgcccgtgggacctactcgacgccaacgcttgggcacttcggaacgcgatgtcgcgtcccgaggttgaaggagtcatcgaggagaacgtggagctgagaggaccggtgtgggtagccgaggatgcgatcctcaggtcgggagccgtagtcgaagggcccgcctatataggcccggggtgcgaaatcggacccaactgctacatccgaccggcgacgacgctggtccgggacgtccgcatcggccaagccgtcgaaatcaagaactcaataatcatggaggggacgaacgtcagccacctctcctacgtgggagacagcgttatcggggccaagtgcaacctgggagccggtaccatcatcgccaacctcagacacgatgaacgcaacgtgaaagtagtagtcaagggcgagctcgaggataccggtaggaggaagttcggagccgtactgggtgatggggttaaaacagggatcaacacctctatactgccgggacggaaactgggcccgtactcggccaccgcaccttccaccgtcgtccgtaagaacgtcccggagggcaagatgctagttcaaggtgaccagatcctagtcgattgggagggacgcggatga

SEQ ID NO: 14689 - protein, 425 aa, Methanopyrus kandleri
MIGIVLAAGEGTRMRPLTKTRPKVLLPVADRRLIDFSIEAMKRIGVEHLVVVVEYLAEKVERYVKDRWGDSFELEFVRQGKPLGTAHAVYVAWREIEPDETVVITNGDLVFDSELLERAVREHEGVASMVLVEVEDPSEFGVARLQDGYVVELVEKPKPEEAPSNLANAGVYVAEPEFERFLERVKPSPRGEFEITDALLDAAIDEGVLGISYDGFWSDVGRPWDLLDANAWALRNAMSRPEVEGVIEENVELRGPVWVAEDAILRSGAVVEGPAYIGPGCEIGPNCYIRPATTLVRDVRIGQAVEIKNSIIMEGTNVSHLSYVGDSVIGAKCNLGAGTIIANLRHDERNVKVVVKGELEDTGRRKFGAVLGDGVKTGINTSILPGRKLGPYSATAPSTVVRKNVPEGKMLVQGDQILVDWEGRG

SEQ ID NO: 14690 - DNA, 1086 bp, Pyrococcus furiosus
  CDS (1)..(1086)
atgcaggcagtagttctagcaggaggtaaaggaacccgcctattgccactgacagtatatcgaccaaaaccaatgataccatttttcaacaggccaataatggaatacattgtagaaagcttggttaaatttggagtagatgaaatcattgtcctagtagggtatctgaaagagagaatttttgaatactttggaaatggagaagaatttggagtagaaataaagtactcaaatggggaaaatctaaaacttggaactgcgggagctctaaaaaaagctgaaaaacttatccaagacaccttcttagtagtttcgggagatattctaacaaatttggactttaggagtttagttgaataccacaaaaagaagggaggccccgcgacaatagccctaacaaaagtggaagatcccagtgcgtatggagtagcggtattagataaggaagggagaatatcatacttcaaagagaaaccaaaaagggaagaggctccaagcaatttggtaaatgcaggaatatatgtatttgaaccagaaatttttgatttaatcccgaagggtaaaaacttcgatttttccttggatctctttccaaaaatgctaaatgaaaacattcctatctacggatatccttttgatgagtactggaatgatataggaagaccctccacatatctccaagctactgaagatgtatttttgggtaaactaaggctacctcaaataaatgttggatcactaaaaggaaacattgaaaaagggggaagtctattcacgggaagtaggtgcatactaagaagaccaagaatcatcggctttgcagtcttggggaacaatgttgaaatcagcaaagatgtaacaatagaaaggtcagttatattctccaacgttaccatagaagaaggagcagaaattagagaggcaataattggagaaaacgtctacataggtaagggagttgttattgagccaggaagtgttattggagataactcaataattgaagactttagtaaagttggtgcaaatgttaagatttgggcagattcgagaattggtaaagaaagtataatactacccgactga

SEQ ID NO: 14691 - protein, 361 aa, Pyrococcus furiosus
MQAVVLAGGKGTRLLPLTVYRPKPMIPFFNRPIMEYIVESLVKFGVDEIIVLVGYLKERIFEYFGNGEEFGVEIKYSNGENLKLGTAGALKKAEKLIQDTFLVVSGDILTNLDFRSLVEYHKKKGGPATIALTKVEDPSAYGVAVLDKEGRISYFKEKPKREEAPSNLVNAGIYVFEPEIFDLIPKGKNFDFSLDLFPKMLNENIPIYGYPFDEYWNDIGRPSTYLQATEDVFLGKLRLPQINVGSLKGNIEKGGSLFTGSRCILRRPRIIGFAVLGNNVEISKDVTIERSVIFSNVTIEEGAEIREAIIGENVYIGKGVVIEPGSVIGDNSIIEDFSKVGANVKIWADSRIGKESIILPD

SEQ ID NO: 14692 - DNA, 1242 bp, Pyrococcus furiosus
  CDS (1)..(1242)
atgaaagctgttattcttgctggaggttttggaactagattaaggcctatttcatcaacaaggccaaaacctatggttcctgtactcgggaagccaaatcttcagtacattcttgaagccctagaaaaagtcagcgagatagatgagataatactctccgttcactatatgagaggagaaataagagagttcattcaagagaggatggttgattatcctaaggacattagattcgtaaatgacccaatgcctttggaaactggtggagcattaaagaacgttgaggattacgtgagcgacgacttcctagtaatatatggcgatgtgtttacgaactttgattattcagaactgattaaggctcacaaagagaacgacggtctcataacagtcgccctaacgaaggtttatgacccagagaggtttggtgtggtcatcgtagatgaagaaggaaagattattgacttcgaggagaagccaaggaaacccaagaccaacttggttgatgctggaatatacatggttaacaaggaagtcctcaaggagattcccaaaaacaaggaggtttactttgagagggagatccttccaaagttcgtcagccaaggactagtctacggatacaggatgccaaaggaatactactggattgatcttggaacgcctgaagacctattctatgcccaccaaattgctctcgatcagctttcaagggaaaatggctacatgatcttgggagaaaatgttgaaattccagaggatgtcgaagtccagggcccagtttacattgataacaatgcaaagattggccacggagttaagattaaggcctacacttacattgggccaaacaccatcattgaagataaggcttatataaagaggtctatcctcctgggaagcgacataataaaggagagagcagagctcaaggatacaatcctgggagagggagttgttgttgggaagaatgtaatcataaaggagaatgcagtggttggggattatgcaaggattaacgacaatcttgtaatctatggagcaaagatcttaccatggaagaaagttgaggagtatgaagcttacataagaataaagctagatccgacaaaagtcaggccagaactaacccctgagaggtgtccacttggcctcccagagtgtatatacaagaagttcaaggcaattgctggtgaaaagccaccttgtgacgaatgtatagagaaccaatggctcttctga

SEQ ID NO: 14693 - protein, 413 aa, Pyrococcus furiosus
MKAVILAGGFGTRLRPISSTRPKPMVPVLGKPNLQYILEALEKVSEIDEIILSVHYMRGEIREFIQERMVDYPKDIRFVNDPMPLETGGALKNVEDYVSDDFLVIYGDVFTNFDYSELIKAHKENDGLITVALTKVYDPERFGVVIVDEEGKIIDFEEKPRKPKTNLVDAGIYMVNKEVLKEIPKNKEVYFEREILPKFVSQGLVYGYRMPKEYYWIDLGTPEDLFYAHQIALDQLSRENGYMILGENVEIPEDVEVQGPVYIDNNAKIGHGVKIKAYTYIGPNTIIEDKAYIKRSILLGSDIIKERAELKDTILGEGVVVGKNVIIKENAVVGDYARINDNLVIYGAKILPWKKVEEYEAYIRIKLDPTKVRPELTPERCPLGLPECIYKKFKAIAGEKPPCDECIENQWLF

SEQ ID NO: 14694 - DNA, 1263 bp, Pyrococcus furiosus DSM 3638
  CDS (1)..(1263)
atgaaagctataatacttgccgctggaaaaggtgaaaggcttaggccactcactgatgataggccaaaggttgttctaaagatcgccaacaaaccaataattagctatgttcttgaaaaccttgacccatttgtagatgaatttatcatagttgttaagtacatgaaggagaaagttattgatttactcggtgatgaatttcgcggaaagccaataacttatgtggagcagggagaagaagagggaacagctgcagcagtgtattccgtaaaagagtttatagagtctaatgaagagtttttcgttgtcaatggcgatttatattttgaacccgatgcagtaaagggccttcttcatgttttcaaaaaagagaaaggagatgcaggcatcgttgtgaaagaatttgagaacctcagccaatatggaatggtagaggtagagaacggtaaggtgaaagggataatagaaaagccaggcaatgtcaaaggatatgcaaacctaggaatatacattttcaagtcagatgtctttgattacatagagaacaccgaaataagtgagaggggagaatatgagattacagacacgataaacctcatgataaaagatggcaaaagtgtggtttactacaactatgaaggattctggagcgatattggaaggccatgggacttacttgaagtgaatgaatacattctaaaaactaagctaaaacacgagataagaggagttgtcgaagagggagcaacaataatcccacctgtggaaattggagagggaacaatagtaagggcaggaagctacataatcgggcccgttaagatcggaaaaaactgtagaatcgggccgaactgctacataagaccatatacaagcataggagacaactgccacataggaaatgccgttgaagttaaaaattccataataatggataattcaaatgcccctcacttaaactatgttggggattcaataatcggggaaaacacaaatcttggggctggaacaataacagctaacttgagacacgacaagggaactatcaaggttgaagttaaaggaaagttagaggattcagggaggagaaagctcggtgcaataattgggcacaacgtaaaagtagggataaacgtcacaatttatccaggaagaaaaattggtagtaactctttcataggcccaggagttatagttgataagaacatcccacaaaacgttcttgttacagttaagcaggagaaaaaggtgattgagaaatga

SEQ ID NO: 14695 - protein, 420 aa, Pyrococcus furiosus DSM 3638
MKAIILAAGKGERLRPLTDDRPKVVLKIANKPIISYVLENLDPFVDEFIIVVKYMKEKVIDLLGDEFRGKPITYVEQGEEEGTAAAVYSVKEFIESNEEFFVVNGDLYFEPDAVKGLLHVFKKEKGDAGIVVKEFENLSQYGMVEVENGKVKGIIEKPGNVKGYANLGIYIFKSDVFDYIENTEISERGEYEITDTINLMIKDGKSVVYYNYEGFWSDIGRPWDLLEVNEYILKTKLKHEIRGVVEEGATIIPPVEIGEGTIVRAGSYIIGPVKIGKNCRIGPNCYIRPYTSIGDNCHIGNAVEVKNSIIMDNSNAPHLNYVGDSIIGENTNLGAGTITANLRHDKGTIKVEVKGKLEDSGRRKLGAIIGHNVKVGINVTIYPGRKIGSNSFIGPGVIVDKNIPQNVLVTVKQEKKVIEK

SEQ ID NO: 14696 - DNA, 1107 bp, Clostridium perfringens str
  CDS (1)..(1107)
atgaataattgcataggtataataaatttagatgagaatgaaagcaaaattggagaattagcaaaaaataggcctttagcagcagtacctatagcaggaagatatagaataattgattttatactttctaatatgaccaatgcaggaatagaatctttaggcattttaagcaaaaataaatcgcgttcattagtagatcatttaactaatggtagaccatgggatttacacagaaaaagagatgggttaagagtatttaattttggagaaagagatccatattatgatgatataactaatctttatgaaaatttagagtttttaactaaaagtagaagagaatacgttattatgtcaccttcatatatgatttgtaatatagatttaaaagaagctttagaatatcataagaaaaatgataatgatattacagtaatatataaaaaagttaaagatgcagattctaattttattgattgtgatgttttaaattttgatgaatgtggatttataaaaagtataggaaaaaatttgggtagagaagaagaaagtaacataagtttagaaatgtatatattaagaacagatcttctaatagaaataatatatgaatgtataagaagaggttctcatagaaaatttaaaagttatttaaaggaattcttagatgaaattaaggttggtggatttgaatttaaaggttatttaagttgtgttaattcactaaaatcttattacaaggctaatatggatttattagaagagaaggtttataaggaattatttatagataataatcctatatatactaaatctagagatgaaggaccgacacattatactaaaaatagtgaagtaactaattcgataatagcaaatggttcttatattgaagggaaagttgaaaacagtataattggaagaagagtttatgtaggaccagaggcggttattaaaaattgtattataatgcaagaaactgttataggtgaaaatgcccatttagataaaataataacagataaggcagcggtaataagagatgatgagaaaatagtaggtcttgaatactgtcctatggttttaagcaaacctaatataatataa

SEQ ID NO: 14697 - protein, 368 aa, Clostridium perfringens str
MNNCIGIINLDENESKIGELAKNRPLAAVPIAGRYRIIDFILSNMTNAGIESLGILSKNKSRSLVDHLTNGRPWDLHRKRDGLRVFNFGERDPYYDDITNLYENLEFLTKSRREYVIMSPSYMICNIDLKEALEYHKKNDNDITVIYKKVKDADSNFIDCDVLNFDECGFIKSIGKNLGREEESNISLEMYILRTDLLIEIIYECIRRGSHRKFKSYLKEFLDEIKVGGFEFKGYLSCVNSLKSYYKANMDLLEEKVYKELFIDNNPIYTKSRDEGPTHYTKNSEVTNSIIANGSYIEGKVENSIIGRRVYVGPEAVIKNCIIMQETVIGENAHLDKIITDKAAVIRDDEKIVGLEYCPMVLSKPNII

SEQ ID NO: 14698 - DNA, 1224 bp, Pyrobaculum aerophilum
  CDS (1)..(1224)
atggtaagaattgctgtcattcccgtgggaggcgaggctgtgagacttaggccgctcacagtggaaacctccaaggcaatgatacgttttctcaacaggcccctagtggagctatctattctccatctggcacggcagggaatagaggagttttacttcggcgtgaggggatatcacaactaccgcgatatttacgactacttccgcgaggggtcttggtttgcggtcaaatacggcgtgaacattaaaataagatatatgcctagagtagagacccgcggcaacgcagaggcggtgttggcaacgctggaatattacgacattaacgagccagttttagtaatccagggcgataacatctttaacttagatgtgaaagagatgtattcatttcacagctctaaaaaggcctttatcacaatagctcttaaagaggagacaggcgacttaagcgaattcggcgttgctgcagtagatgataacatgcgtatattaaaattcgtagagaagcccaagaggagagaggaggcgcccagtaatttagtcaacacaggcctatatttactctctgaggactttaagtcgtttttcaagggagagctagggggtaagctatactccgagggaaggctggactttgggggcgacgtcatccccgccgtaatagaggcaggccttccggtatatggctatcacacaaaggggtattggtttgacgtgggaactcccgagcgctacctaaaggctgttcagtatttattaagacatctaactgcgtatgagcttgaggcagaggagatagcgccctcagtctttgcacagggtaaaagcgagcagtcaaaagccctaaaggagaagatcgccgaggcaattaaaaacggccaaataaaggctgaagggcgcctactattaggcaggcacgtacaaataggggataactcctacttgagagacactgtgattgacaactacgtcattataggggacaacagcgtaatcgaggactccgttgtaatggacagatcttatataggacgtggcgttgtgataaggcgctcaataataggccgccatgtacaaataggcgacggcgcagtgattgaagacgctgtagttgccgacaatgtgatagtaggagacggagcccacctgagaagggtcaaggtctggccgcataaaacagtagagagaggggtgaggctagagggcttctcgcttatatga

SEQ ID NO: 14699 - protein, 407 aa, Pyrobaculum aerophilum
MVRIAVIPVGGEAVRLRPLTVETSKAMIRFLNRPLVELSILHLARQGIEEFYFGVRGYHNYRDIYDYFREGSWFAVKYGVNIKIRYMPRVETRGNAEAVLATLEYYDINEPVLVIQGDNIFNLDVKEMYSFHSSKKAFITIALKEETGDLSEFGVAAVDDNMRILKFVEKPKRREEAPSNLVNTGLYLLSEDFKSFFKGELGGKLYSEGRLDFGGDVIPAVIEAGLPVYGYHTKGYWFDVGTPERYLKAVQYLLRHLTAYELEAEEIAPSVFAQGKSEQSKALKEKIAEAIKNGQIKAEGRLLLGRHVQIGDNSYLRDTVIDNYVIIGDNSVIEDSVVMDRSYIGRGVVIRRSIIGRHVQIGDGAVIEDAVVADNVIVGDGAHLRRVKVWPHKTVERGVRLEGFSLI

SEQ ID NO: 14700 - DNA, 1927 bp, Zea mays
  CDS (141)..(1673)
aagcaaaacgccaaacaggctcctctgaaactcccagagccggtagaggcacgccactccgcagtgtcagtcactgcccccccatcacgccgcccgccctttctcggccgttgccgcgagctcgcttcgacccaccgccgatggcgacggcgatgggcgcgatggccgccacctgcatggcctcgatcccggccgccgctacgttccccggtgatctcggcgtcggacgacgccgagcggttgtaccagggtggcgcgccggtgggagacggctgcgtgcgacgccgcctgcccggaggccgttcctgttctcgccgaagggcgtttcggactcgcggagctcgcaaacgtgccttgatccggacgccagcacgagtgttcttgggatcatccttggagggggtgctgggacaaggctgtatccactgacgaagaagagggcgaaaccagcagtgccgttgggcgccaactacaggctcatagatatccctgtcagcaactgtctcaacagtaacgtctccaagatatatgtgctaacacagttcaactctgcttcgctcaaccgccacctctcgagggcctatggaaacaacattgccgggtacaagaatgagggattcgttgaggtccttgcagcacaacagagtccagagaatcccaactggtttcagggtactgcagatgccgtgcgtcaatatatgtggctatttgaggagcataatatcatggagttccttattctggctggagatcatctgtaccgtatggattaccaaaagttcattcaagctcatagagaaacagatgctgatataacagttgcagccctgccaatggatgaacaacgtgcaactgcatttggtcttatgaaaattgatgatgaagggaggatagttgagtttgcagaaaaaccaaaaggagagaagctgagatcaatgatggtagacaccactatattgggccttgatcctgaaagggccaaagaactgccttatattgccagtatgggaatctatgtttttagcaaagatgtgatgcttcgtcttctcagagaaaattttcctgcagcaaatgactttggaagtgaggttattcctggcgcaacagaaattggattaagggtgcaagcttacttatatgatggttactgggaagatattggtactattgaagcattttataatgcaaacttgggaataaccaagaagcctgtaccggattttagcttctatgatcgttctgctccaatttatacgcaacctagatatttgcctccttcgaaggttcttgatgctgatgtgacagacagtgttattggagaagggtgtgttattaaacattgcacaatcaatcattccgtagttggactccgttcctgcatttctgaaggtgcagttatagaggactctttgctaatgggtgcagactattacgagactgagaatgataagaatgtcctttctgagactggtggcattcccattggtattgggaaaaattcacatatcagaaaagcaataattgacaaaaatgctcgcattggagaaaatgtgaagataatcaattttgataatgtccaagaagcagtaagggagacagaaggatattttatcaaaagtggaattgtcacggtgattaaagatgctttaattcctagtggaacaatcatataaagtcagccaacaccatgtatataaggttgggttgcatcatatggtgatcgccaatgcgcatcaagttctctcatcccttgcgagaccatgcttatttccattgcaaaatcatcaagctctgcatcaacttgttgtggataataatgaaataataaatggtgccattccatggcaacatttttctgtcactagtatgaggcactgttctaaatgtactgttgagtggaatttgaatatgtatgcttttgcaatcg

SEQ ID NO: 14701 - protein, 510 aa, Zea mays
MATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 14702 - DNA, 1754 bp, Zea mays
  CDS (6)..(1433)
aaaccatggacatggctttggcgtctaaagcctcccctccgccatggaatgccaccgccgccgagcagccaattccaaagcgtgacaaagccgctgcaaatgattcaacatacctcaatcctcaagctcatgatagtgttcttggaatcattctgggaggtggtgctgggactagattgtaccccttgacaaagaagcgtgccaagcctgcagtgccattgggtgccaactatagactgattgatattcctgtcagcaattgtctcaacagcaacatatccaagatctatgtgctaacgcaatttaactctgcttccctcaaccgtcacctctcaagagcctacgggagcaacattggagggtacaagaatgaagggtttgttgaagtcttagctgcacagcagagcccagataatccaaactggtttcagggtactgcagatgctgtaaggcagtacttgtggttgtttgaggagcataatgtgatggaatttctaattcttgctggcgatcacctgtaccggatggactatgaaaagttcattcaggcacacagagaaacaaatgctgatattaccgttgctgccctaccgatggatgagaaacgtgcaactgcatttggcctcatgaaaattgatgaagaagggaggatcattgagtttgctgagaaaccgaaaggagagcagttgaaagcaatgatggttgacaccaccatacttggccttgatgacgtgagggcaaaggaaatgccttatattgctagcatgggtatctatgttttcagcaaagatgtaatgcttcagctcctccgtgaacaatttcctgaagccaatgactttggaagtgaggttattccaggtgcaaccagcattggaaagagggttcaggcttatctgtatgatggttactgggaagatatcggtaccattgcggcattttataatgcaaacttgggaataaccaagaagccaataccagatttcagcttctatgaccgttttgctccaatttatacacaacctcgacacctgccaccttcaaaggttcttgatgctgatgtgacagacagtgttattggtgaaggatgtgttattaaaaactgcaagataaaccattctgtagttggactccgatcttgcatatctgaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattggagacaatgttaagatactcaatgctgacaatgttcaagaagctgcaatggagacagacgggtacttcatcaaaggtggaattgtcacagtgatcaaggatgctttactccctagtggaacagttatatgaagtgaacgtgcgacatgcagctgtgtgtctcgacattcgacaatgatcagcacctggttacatgcgtgatctgcagatcagtctgttggagatcatcggagcaataaaagtgtcatccaaggcattttttctttctttttgctcttttgtgtccttcaatgttgtagggtagaatgttgtagcagcaaatgttagttacatgttgaatcgacattgggggcctggatttggggatacatcatgctgtaaattgatcagtttaattaccatactgtgctgctttgagcgaagccatggagaccatgctccacttttgtgccc

SEQ ID NO: 14703 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 14704 - DNA, 1471 bp, Nicotiana tabacum
  CDS (220)..(1305)
ggaaatccagtgctaatctggagctttgtgcttgagctctatgacaagttgctcaatgttcagaaggaagtggaaaggctacgagctgagagaaatgtagttgctaacgttgttatttggttcaggaaaattctctgactccgtcgttgctttagtccatccgttttctgcacctcagtctttggattttctagatctaaggagctttgatatatcagaatgaaggcgcttattcttgttggagggttcggtactcggttgaggccattgacgctcagtgtcccaaagccattagttgaatttgccaacaaacccatgattttgcatcagattgaggctctcaaggcagtcggagtaactgaagttgtactggctattaattaccaacctgaggagatgctgaacttcttgaaagaatttgaggcaaaccttggaatcaagatcacctgttctcaagaaactgaaccacttggcactgcaggtccccttgctttggctagagataagctgattgatgactccggtgaacctttttttgttcttaatagtgatgttatcagtgaatatcctttcaaggagatgattgctttccacaaatcccatggaggtgaggcttccttgatggtcaccaaggtggatgagccttctaaatatggtgttgtcgtcatggaagaatcgacagggcaagtagagagatttgtagagaagccaaagttatttgttggcaacaagatcaatgctggattttacctgctgaatccttctgtcctagatagaattcaattacggccaacatcaatcgagaaagaggttttcccaaaaattgcagcagaggaaaaactatatgctatggtcttaccaggattttggatggacattggtcagccaagagattacattcctggcctcagactctacctggattctttaaagaagaattcttcacctaaattggcttcaggatctcacattgttggaaatgtcatagtggatgagtctgccaagattggagagggttgtttgataggaccagatgttgcaatcggttctggttgtgttattgagtctggagttagactctcccgctgcaccgtgatgcgaggagtccgcatcaagaaacatgcctgcatctcaagtagcatcattggctggcattctacggttggacaatgggctcgtgtagagaacatgaccattcttggagaagatgtccatgtctgtgatgaaatttacagcaacggaggtgtagttttgccccacaaggagatcaaatctagcatattgaaacctgaaatagttatgtgaggatatgattgttagcactagtgagatattatgtatttgttgaatttgacaagattaatgttaaccagtgtaaacatttgaagcctccttttaggaagaaattggcagatgcatttttcatgcatttacattgcatgatcacacttaatatgatatcatgcatgac

SEQ ID NO: 14705 - protein, 361 aa, Nicotiana tabacum
MKALILVGGFGTRLRPLTLSVPKPLVEFANKPMILHQIEALKAVGVTEVVLAINYQPEEMLNFLKEFEANLGIKITCSQETEPLGTAGPLALARDKLIDDSGEPFFVLNSDVISEYPFKEMIAFHKSHGGEASLMVTKVDEPSKYGVVVMEESTGQVERFVEKPKLFVGNKINAGFYLLNPSVLDRIQLRPTSIEKEVFPKIAAEEKLYAMVLPGFWMDIGQPRDYIPGLRLYLDSLKKNSSPKLASGSHIVGNVIVDESAKIGEGCLIGPDVAIGSGCVIESGVRLSRCTVMRGVRIKKHACISSSIIGWHSTVGQWARVENMTILGEDVHVCDEIYSNGGVVLPHKEIKSSILKPEIVM

SEQ ID NO: 14706 - DNA, 1074 bp, Sulfolobus tokodaii
  CDS (1)..(1074)
atggtctcagctatagtattagctggaggatatgcaactagattaagaccgttaagtctcacaaaacctaaagctcttttacccattttggataagcctcttttggattatattttagattcattagaaatagctggaataaatgaggtatatttatcccttcgtgttatggcagacaaaattttgtctcatattgaaggtgaaaatagaaaagtaattccagtaatagagaaagagagactaggagatgcaggaccattgaaattgatctcacaaagatataatctatctgatgatgttcttgtaatatacggagatatttataatgaattggatataaaatcattacttaaatttcatgaaaaagaaggttgtgatgcaacgatagtaggaaaacctgtagaagatcctagaagatatggtgttttaataacggagggagaacgcttagtacaaataatagaaaaaccaaagaatccggtatctaaccttataaatgcgggtatatatgtatttaagaaaaaattattagaaaaaatagatgggcaaagcatagctaagaattttctaccaaaacttctatctgataatacttgtatagctgtttataaatatgatggattatggatggatattggagtaccatcagattacataagaataaatttacaacttctatctttaaaatatcctaagggatatattaatgaagaagcaaaagtgagtgaaaaagttaacctaattccaccttattatataagtagtggcgtaaatataagtgaggactcattcatatttaatagtattattggtaagaatacgtcaattggtaatggtgtttatatagaccaaagtatattaatggaagatgttaaagtcgatagttttagttatattagagatagtatcttaggtgataaagataatttaggaaaatgggttagattagattcagttattttgggtgatgaggtagtaatatatgatggtgtatttgtaaatagagatacaataattttaccctataaagaagttaatgagtccgtatacgataagggaaaaataatattgtga

SEQ ID NO: 14707 - protein, 357 aa, Sulfolobus tokodaii
MVSAIVLAGGYATRLRPLSLTKPKALLPILDKPLLDYILDSLEIAGINEVYLSLRVMADKILSHIEGENRKVIPVIEKERLGDAGPLKLISQRYNLSDDVLVIYGDIYNELDIKSLLKFHEKEGCDATIVGKPVEDPRRYGVLITEGERLVQIIEKPKNPVSNLINAGIYVFKKKLLEKIDGQSIAKNFLPKLLSDNTCIAVYKYDGLWMDIGVPSDYIRINLQLLSLKYPKGYINEEAKVSEKVNLIPPYYISSGVNISEDSFIFNSIIGKNTSIGNGVYIDQSILMEDVKVDSFSYIRDSILGDKDNLGKWVRLDSVILGDEVVIYDGVFVNRDTIILPYKEVNESVYDKGKIIL

SEQ ID NO: 14708 - DNA, 1260 bp, Sulfolobus tokodaii
  CDS (1)..(1260)
atggcatggaaactagaagatataaaagttataatccctataggcggtgaagcaacaagattaagaccattaaccgtggaaacatcaaaagctgcagtaaggttactaaatagaccgttaatagaatacacgattttagaattagcgagacaaggtataaaggagtttatttttggagtaaaaggatatgttaattataggtctttatttgatctatataaagaaggtataggattttcagcaaggtatcatataaagccaagagttcacttcaaatatattccaagagctgagactgttggaaatgcacatgctgtcaaaattgctgtagaatattatgatgtaaaggaaccgtttcttgtagttcaaggggataatctctttaaacttgatgttaagaaagttcttgagtatcatgaggaaaagaaggcttttatgactatagttttaaagaaagttgagagtgttgaagagtttggtgtggcagagttagataacgatatgaaaataaagaggtttgttgagaagccaaaaagaagagaagaagcaccttcagatttggcaaatactggaatttacgtaattagcccagagatacgtgatgtatttaagagcgaagaagtagaggaaatgttaaaattaggtaaaatggatttcggtaaggatataataccctaccttattaagaagggttatccggtttatggatatgtcacagaaaatctatggtttgatgttggtacaccagatagatatttggaagcaatgctaacattactaaagactctctctgatgaagatatgcaaggtctgaggattgatgctaacagaaggattttcgttcaaggaactagtccggactccagaaagagaagggtaatcataaagagaatgtacaaaaaaggggatttaaaactagaaggcgatatacttattggaaggcattgtcaaattggcagtgggacttacattgaggaatctgccatagataactttacaataataggaaaaagtgttaaaattgtgagaagttctataatggatagagtatacataggagataatgctgtaattgaaaattctataattggtagacatgttgagataagatccacttcttcaaaacctactaaaataattaatagtgtcattgctgatgatgctgtaataggagagggtagtgaaattactaattcaaaaatctatcctcataaacttataaattctgagagtaagatatacgatacgatattaacatga

SEQ ID NO: 14709 - protein, 419 aa, Sulfolobus tokodaii
MAWKLEDIKVIIPIGGEATRLRPLTVETSKAAVRLLNRPLIEYTILELARQGIKEFIFGVKGYVNYRSLFDLYKEGIGFSARYHIKPRVHFKYIPRAETVGNAHAVKIAVEYYDVKEPFLVVQGDNLFKLDVKKVLEYHEEKKAFMTIVLKKVESVEEFGVAELDNDMKIKRFVEKPKRREEAPSDLANTGIYVISPEIRDVFKSEEVEEMLKLGKMDFGKDIIPYLIKKGYPVYGYVTENLWFDVGTPDRYLEAMLTLLKTLSDEDMQGLRIDANRRIFVQGTSPDSRKRRVIIKRMYKKGDLKLEGDILIGRHCQIGSGTYIEESAIDNFTIIGKSVKIVRSSIMDRVYIGDNAVIENSIIGRHVEIRSTSSKPTKIINSVIADDAVIGEGSEITNSKIYPHKLINSESKIYDTILT

SEQ ID NO: 14710 - DNA, 1080 bp, Thermoplasma volcanium
  CDS (1)..(1080)
atgaccgtcaagggagttctgatggcaggtggcaagggcacaaggcttaggcccattacatattcgataccaaaacctctcgttccggtggcaggaaaaccggtgatatcctacatattagattcattctataacgcaggtgtcaaggacataataataacaactggatataagttcgaagcgcttataaagggcgtactagaaaacaaattctccgaccagaatatattgttttcagtggagaaagatcccgcaggaacagcaggtggtgttaaattggcagagaacttcatagacgacacttttgtcgttggaagcggtgacatacttatcgatttcgacgtctctaagatgatagaggagcacaagaagaggggggctaacataacaatcgcccttactagggttgatgatccgtcccagtttggcatagctgaagttgacgatgaaggctatgtcaaaaggttccttgaaaagccaaagaagtcagaaactttttcgaataccataaacgcaggtgtttatgtgatcgaaccatctgtattggaatacataccaaagggcgtacagtttgactttgccaaggatctatttccaaaggctatggcgaatggcatcaagatatatacttacgaaataaatggcgtctggttagatgcgggcaggccaggggatcttataaaagcaaaccagataatggttgataaatacggcgataggaatataaatggcagcaggatgatattaaaggcaagaataccggatggcgttaacgtaagcggcccgacttacattggagaaggggtagccataggcaagggatcgtccatagactcttcgactatatacgaaggagttcaaataggcaatgatgtggagataaagaactcggtgataatgtcatcttgcagaatactggatggatcaaaaatatccgattcggttataatgcagaacacggtcataggtgaggcctgtgagattagaaatagcgtactttcccaaaaattaaacctgcaaaaaggctccagggtatttgatgtggccctatcttccgaaataatacaggatgaaaactag

SEQ ID NO: 14711 - protein, 359 aa, Thermoplasma volcanium
MTVKGVLMAGGKGTRLRPITYSIPKPLVPVAGKPVISYILDSFYNAGVKDIIITTGYKFEALIKGVLENKFSDQNILFSVEKDPAGTAGGVKLAENFIDDTFVVGSGDILIDFDVSKMIEEHKKRGANITIALTRVDDPSQFGIAEVDDEGYVKRFLEKPKKSETFSNTINAGVYVIEPSVLEYIPKGVQFDFAKDLFPKAMANGIKIYTYEINGVWLDAGRPGDLIKANQIMVDKYGDRNINGSRMILKARIPDGVNVSGPTYIGEGVAIGKGSSIDSSTIYEGVQIGNDVEIKNSVIMSSCRILDGSKISDSVIMQNTVIGEACEIRNSVLSQKLNLQKGSRVFDVALSSEIIQDEN

SEQ ID NO: 14712 - DNA, 1758 bp, Oryza sativa
  CDS (115)..(1617)
gaaaaagaaaaaaaaagagaaaaaaagagggaacttttcacggccgctgaagcctctgacactccactgtagtgtgtcagtactccggccacctctctcggccgttgctctcccatggcgatgatggcgatgggcgcggcgtcctgggccccgatcccggcgccggcgagggcggcggccgcattctatcccggccgcgatcttgcggcggcgaggcggcggcgtggggcggcggcgaggaggccgttcgtgttcacgccgcgtgccgtgtcggactcccggagctcgcagacgtgcctcgatccggacgccagcacgagtgttcttgggatcatccttggaggtggtgctgggacaaggctgtatccgctgacaaagaagagggcgaagccggcggtgccgttgggtgctaattacaggctcatagatatcccggtcagcaactgtctgaacagcaatgtgtcgaagatctatgtcctgacacagttcaactccgcgtcgctcaatggtcacctctcgagggcctatggaaacaacattggtggttacaagaacgaggggtttgttgaagttcttgctgcgcagcagagcccagagaatcctaactggtttcagggtactgcagatgctgtgcgacaatacttatggctatttgaggaacacaatgttatggagtttctcattttggctggagatcacctgtaccgtatggactaccaaaagttcattcaggcccacagagaaacaaatgctgatataaccgttgctgcgctgcccatggatgaagaacgtgctacagcatttggccttatgaagattgatgatgaagggaggatcattgaatttgcagaaaagccaaaaggagagaagttgaaatcaatgatggttgacactaccatacttggccttgatactgagagggcaaaggaattgccttacattgctagtatgggaatctatgtttttagcaaagatgtgatgcttaagcttctccgtcaaaatttccctgctgcaaatgactttggaagcgaggttattcctggagcaacagaaattggaatgagggtgcaagcttacttatatgatggttactgggaagatattggtactatagaggcattctacaatgccaacttggggataaccaagaaacctgtgccagattttagcttctatgaccgttctgccgcaatttatacgcaacctcgatacttgcctccatcaaaagttcttgatgctgatgtgacagacagtgttattggtgaaggttgtgttattagacattgcacaatcaaccattctgtggttggactccggtcctgtatatctgaaggcgcagtgatagaggactctctgctaatgggtgcagactattatgagacggagacggacaagaaagccctttctgagactggtggcattcccattggtattggaaagaatgcacacatcagaaaagcaataattgacaagaatgctcgtattggagaaaatgttaagataatcaatgtcgacaatatccaagaagcttcaagggagactgatggatacttcatcaaaagtggcattgtcactgtgatcaaggacgccttaatccctagcggaacagtcatataaaggcaaccaatcaccactgttgggccttgcagcatatggtgatctgatctccagtgcacatcaagcaatcaacttttaacgctgtggtttattccatgctgccagttcaccaagctatgcatcaacttgcaaggatatcat

SEQ ID NO: 14713 - protein, 500 aa, Oryza sativa
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNGHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 14714 - DNA, 1620 bp, Oryza sativa
  CDS (52)..(1608)
ggcacgagcacaagaacacttgggcaggtttgtctgggactttgagtacccatggaattcatgatgccattggatacgaatgcttgtgcacaaccaatgagaagggctggtgagggtgctgggactgagaggttgatggaaagattgaatattgggggcatgactcaggagaaagcactgaggaagaggtgctttggtgatggagttactggaactgcacgatgtgtgttcacatcagatgctgatagagacactcctcatcttcggacacaatcctcccgaaagaattatgctgatgcaagccacgtttctgctgtcattttgggtggaggcactggagttcaactctttcctctgacaagcacaagggctacccccgctgttcctgttggaggatgttacaggcttattgacatccctatgagcaattgcttcaatagcggaataaataaaatatttgtgatgactcagttcaattctgcttctcttaatcgccatatccatcatacataccttggtggggggatcaactttactgatgggtctgtgcaggtattggctgctacacaaatgcctgacgaaccggctggatggttccagggtacagcagatgctatcagaaaatttatgtggatacttgaggatcattacaatcaaaacaacattgagcacgttgtaatcttgtgtggagatcagctttacaggatgaattacatggagcttgtgcagaaacatgtcgatgacaatgctgacattaccatatcatgtgctcccatcgacgggagccgagcttctgactatggactggtgaagtttgatgattcaggccgtgtgatccaatttcttgagaaaccagagggtgctgatttggaatcgatgaaagttgataccagcttcctcagctatgcaatagatgacaaacaaaagtatccctacattgcatcaatgggaatttatgtcttgaaaaaagatgttcttttagacattctgaagtcaaaatatgcacacctgcaagactttggatcagaaattctcccgagagctgttttagagcataatgtgaaggcatgtgtcttcacagaatattgggaggatattggaacaatcaaatcattttttgatgctaacttggccctcaccgagcagcctccaaagttcgaattttatgatccaaaaactcctttcttcacctcacctcgatacttacctccagcaagattggagaagtgcaagatcaaagatgcaataatctccgatggctgttcctttagtgaatgcaccattgagcattctgtcattggaatctcttcacgcgttagcatcgggtgtgaactcaaggataccatgatgatgggtgcagatcaatatgaaactgaagaagaaacttcaaagctattgtttgaaggcaaggtcccaattggtataggcgagaacacaaagataaggaactgtatcatcgacatgaatgctagaattggcaggaacgtgatcattgcaaacactcagggggtccaagagtctgatcaccctgaagagggatactacataaggtctggaattgtggtgatcctgaagaatgcaaccatcaagcacgggccgatcatataatagaagcttcag

SEQ ID NO: 14715 - protein, 518 aa, Oryza sativa
MEFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKHGPII

SEQ ID NO: 14716 - DNA, 1889 bp, Cicer arietinum
  CDS (24)..(1574)
gacaatacagagcaccaaaagccatggcatcaatggctgcgatcggtgttctcaaagtaccaccatcctcttcttcttcttcatcatcatcatcatccaaagccattattgcacgcaacctctcattcacttcatcacaggtttgtggtgataagattggcacattttcaagaaggggaagaggaagctatgtcggcaaccccatcattgtttctcccaaagctgtttctgattccaaaaacgcccaaacttgtcttgatccagatgctagccgaagtgtacttggcattatacttggaggtggtgccgggacgcgtctttatccactgaccaagaaacgggcgaaaccagctgttcctcttggagcaaactataggctgattgatattcctgtaagcaactgcctaaacagcaacgtatcaaagatatatgtcctcacacaattcaattcagcatccttgaataggcatttgtctcgtgcttatgcaagcaacatgggtggctacaaaaatgaaggtttcgtcgagggtcttgctgcacagcaaagtcctgagaatccaaattggttccaggggaccgcagatgcggtgaggcaatatttatggcttttcgaggagcacaatgttttggaatacttagttctggctggtgaccatctgtatcgaatggattacgagagatttatacaagcacacagggaaagtgatgctgatattactgttgctgcattgccaatggatgaattgcgtgccactgcattcggtctaatgaagatcgatgaagaggggcgtataatcgaatttgctgagaagccaaaaggagaacagttgaaagctatgaaagttgatactactattttgggtcttgatgaagagagagcgaaggaaatgccttacattgctagcatgggtatatatgtcgtcagcaaacatgtgatgttagatctgctccgtgagaagtttcctggtgcaaacgacttcgggagtgaagttattcctggtgcaaccaacattggaatgagagtgcaagcttatttatatgatggatactgggaagacattggtacgatagaggctttctataatgcaaatctcggaatcaccaaaaagccagtgccagattttagtttctatgatcgttcatctccaatctacactcaacctcggtatttacctccatctaagatgcttgatgctgatatcactgatagtgttatcggtgaaggatgtgtaattaagaactgcaaaatccaccattctgtggttggactgcgatcttgcatatcagaaggcgcaatcattgaggacactttgttgatgggagcagattattatgagacggatgctgataggaggtttttggctgctaaaggcagtgttccaattggtattggcaagaattctcatatcagaagggcaatcattgacaagaatgctagaattggagacaacgtgaagatcattaacagtgacaatgtgcaagaagctgcaagggaaactgaaggttatttcataaaaagtgggattgtcacagtaatcaaagatgcattgattccaagtggaactgtcatctaaagtcttctcaacggtttcctcttgctggttttgcaacaactcattttcactgctggaaggtgttgcaagagcagttctgcttccacattggttttctggtgcattttatatttggttggttagtaaatagagtagaggaaggacccttttctgtagtcacgatgtaaatttaattattcagtcaaataaatgtttctttagtatgcagtgtctgtgatgcatgttcttttgcaattcatcaaagggatggaatatgatggacgaaaaacaatggaatgaaatacaataacagccatggacattatcttctgcttt

SEQ ID NO: 14717 - protein, 516 aa, Cicer arietinum
MASMAAIGVLKVPPSSSSSSSSSSSKAIIARNLSFTSSQVCGDKIGTFSRRGRGSYVGNPIIVSPKAVSDSKNAQTCLDPDASRSVLGIILGGGAGTRLYPLTKKRAKPAVPLGANYRLIDIPVSNCLNSNVSKIYVLTQFNSASLNRHLSRAYASNMGGYKNEGFVEGLAAQQSPENPNWFQGTADAVRQYLWLFEEHNVLEYLVLAGDHLYRMDYERFIQAHRESDADITVAALPMDELRATAFGLMKIDEEGRIIEFAEKPKGEQLKAMKVDTTILGLDEERAKEMPYIASMGIYVVSKHVMLDLLREKFPGANDFGSEVIPGATNIGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGSVPIGIGKNSHIRRAIIDKNARIGDNVKIINSDNVQEAARETEGYFIKSGIVTVIKDALIPSGTVI

SEQ ID NO: 14718 - DNA, 1920 bp, Cicer arietinum
  CDS (174)..(1739)
gctcaacgtgtgtgtgtgtttgtcttaacaagcttctcgtgagtcaccagtttttgttcttcaacttcaactcatcatttttcttaactctactggagtacactttcctccattattatcacatttttctcttcaattcacttcaataaactctcctaattgaaagaaaaaaaatggatttagctataggttcaaactatgcatctcttagaagcagtgtgttcttaggtgaaactttaaagggaaatttaagcacaaaatttctcacatcacctaagttttcacaaattcacatcaataatcttagaagctttaatcccagaaatggtgcttcatattctgttcttacatcagggatcaatgattttgaagagtctatgacatttcatgagggaccctattttgatactcctaaagcagacccaaaaagtgtagcttcgatcattttgggtggtggtgctggaactcgcctttttcctctcactagcaaaagagctaaacctgcggttccaattggagggtgttacagactcatagatatccctatgagcaattgcatcaacagtggcattaggaaaatattcatcttgacacagttcaattctttctccctcaaccgccacctatcccgctcctacaattttggtaatgtctccacttttggagagggtttcgtggaggtcttggctgccactcaaacatctggagaagcagggaagaaatggttccaaggaacagctgatgctgtgaggcaatttatatgggtttttgaggatgctaagaccaagaatgttgagcatatattgatactctctggtgatcatctttatcgaatgaactatatggattttgtacagaaacatattgacacaaacgctgatatcacggtatcgtgtattcccatggatgacagtcgagcatcagattatgggctgctaaaaattgacggaaagggacggattatacagtttgcggaaaagcccaagggatcagaactgaaagcaatgcgtgtcgacaccacacttcttgggttatctccagaagaagcaaagaaacaaccttatattgcatccatgggtgtctacgtgttcagaaccgagaccctactgaaacttttaagatcaaactgttctacatgcaatgactttggatctgaaatcattccatctgctgtgaacgacgatcacaatgtccaggcatatttgttcaacgactactgggaagatattggaaccataaagtccttctttgatgcaaatctggccctaacagatcagcctccaaaatttcaattctatgatccaaatacacctttctacactttcccaagattcctaccacccactaaagtagaaaaatgcaagatcgtggacgcaattatttctcacggttgcttcttgagggagtgcagtgttcaacattctattgtcggaatacgctcacgtttagagtccggtgtggagcttcaggatactatgatgatgggtgctgattactatcaaaccgagtctgaaattgcgtctctgctggcagaagggaaggtcccagttggggttggagaaaataccaaaatcaggaattgtattatcgacaagaatgcaagaatcggaagaaatgtgataattacaaatgcagatggtgttgaagaagcagacagaactaaggaaggattttacattaggtcaggtatcacggctatactgaagaatgcaacaattaaagatggaacagttatatgaagcacttcaagttcaaattatcatttggatctctctagagttagacataaatcttgagtacaatagttaacttgcagacacttacaaagtcgaatacttgcttgtaacaagctattttccaaataaaaacatatcatcagtttctgaatataaatatcactgataactatatcttattttt

SEQ ID NO: 14719 - protein, 521 aa, Cicer arietinum
MDLAIGSNYASLRSSVFLGETLKGNLSTKFLTSPKFSQIHINNLRSFNPRNGASYSVLTSGINDFEESMTFHEGPYFDTPKADPKSVASIILGGGAGTRLFPLTSKRAKPAVPIGGCYRLIDIPMSNCINSGIRKIFILTQFNSFSLNRHLSRSYNFGNVSTFGEGFVEVLAATQTSGEAGKKWFQGTADAVRQFIWVFEDAKTKNVEHILILSGDHLYRMNYMDFVQKHIDTNADITVSCIPMDDSRASDYGLLKIDGKGRIIQFAEKPKGSELKAMRVDTTLLGLSPEEAKKQPYIASMGVYVFRTETLLKLLRSNCSTCNDFGSEIIPSAVNDDHNVQAYLFNDYWEDIGTIKSFFDANLALTDQPPKFQFYDPNTPFYTFPRFLPPTKVEKCKIVDAIISHGCFLRECSVQHSIVGIRSRLESGVELQDTMMMGADYYQTESEIASLLAEGKVPVGVGENTKIRNCIIDKNARIGRNVIITNADGVEEADRTKEGFYIRSGITAILKNATIKDGTVI

SEQ ID NO: 14720 - DNA, 1809 bp, Cicer arietinum
  CDS (83)..(1660)
gattaatttgaaacacacacaagacaaggtcttcattaacaactgaatttcccattttgtccctccctccggtgatcggaaaatggcagtctctgccaccggtcagataatgctatcatctaccgttcaattacgtgaaccaacaataatgggcagtactaggaacttgaggtttgtcaagttttgtaatggagaaattatgggaagaaagattgagcttaaagctgggggtgctattagcaattgttgcactaagaatgttattaggcagaatatatctatgtctctcactgctgacgtggctgccgaatccaagttgagaaacgtagatttggaaaaaagagacccaagtacagttgtagcaattatactaggtggaggtgctggaactcgtctcttccctctcaccaagcgacgagccaagcctgctgttccaattggaggtgcttataggctgatagatgtaccaatgagtaactgcatcaatagtgggatcaacaaagtatacattctcactcaatttaattcagcctcactcaacaggcatattgcacgtgcttataactctggtactggagtcacttttggagatggctatgttgaggttcttgcagcaactcaaactccaggggagcaaggtaaaaagtggtttcagggtactgctgatgctgtgagacagttccactggctctttgaggatgcaaggagcaaggatatcgaggatgtcttgattctttctggagatcacctctacagaatggactatatggactttgttcaaaatcaccgagagagcggtgcagatatcacgctttcttgcctgccaatggatgacagccgtgcctcagattttggtctaatgaagattgacaataaaggaagggtcctttcattcagtgaaaagcctaaaggagaagatctcaaagcaatgcaagtggatacaaccgttctaggtctttcaaaggatgaggctctcgaaaaaccatacattgcttccatgggagtgtacgtcttcaagaaggagatacttcttaatctattaagatggcgctttccgactgcaaatgactttggatcagagatcattcctgcctcagctagagaattttacatgaaggcttatctcttcaatgattactgggaggacatagggaccatcagatcattctttgaagcaaatctagctctcactgagcatccatcgaaatttagcttttatgatgcagcaaaaccaatgtacacatcaaggagaaacttaccaccttccaagattgacaatagcaagattgttgattcaattgtatcgcacggaagctttttgaataattccttcatagagcatagtgtagttggaatcagatccagaataaactcaaatgttcatttaaaggatacagtgatgcttggtgctgatttctatgaaactgaagcagaagtggcagccctgttagctgaaggaagagttccaataggaataggagaaaacacaaaaatcaaagattgtattattgacaaaaatgctagaattggaaagaatgttatcatagcaaattcagagggcatacaagaggctgatagatctgcagaagggttttacatccgttccggagtcacagttgtattgaaaaattcaacaattgaagacggactcgtcatataataaagtcacccattacttgtctgaagatgagattttttttagtttttaactttttatgaattgtaaaaaaaaaaaaggatataaatagattggcatattatccatcttatattccaattcctccaacttaacatgtcataaaaattatt

SEQ ID NO: 14721 - protein, 525 aa, Cicer arietinum
MAVSATGQIMLSSTVQLREPTIMGSTRNLRFVKFCNGEIMGRKIELKAGGAISNCCTKNVIRQNISMSLTADVAAESKLRNVDLEKRDPSTVVAIILGGGAGTRLFPLTKRRAKPAVPIGGAYRLIDVPMSNCINSGINKVYILTQFNSASLNRHIARAYNSGTGVTFGDGYVEVLAATQTPGEQGKKWFQGTADAVRQFHWLFEDARSKDIEDVLILSGDHLYRMDYMDFVQNHRESGADITLSCLPMDDSRASDFGLMKIDNKGRVLSFSEKPKGEDLKAMQVDTTVLGLSKDEALEKPYIASMGVYVFKKEILLNLLRWRFPTANDFGSEIIPASAREFYMKAYLFNDYWEDIGTIRSFFEANLALTEHPSKFSFYDAAKPMYTSRRNLPPSKIDNSKIVDSIVSHGSFLNNSFIEHSVVGIRSRINSNVHLKDTVMLGADFYETEAEVAALLAEGRVPIGIGENTKIKDCIIDKNARIGKNVIIANSEGIQEADRSAEGFYIRSGVTVVLKNSTIEDGLVI

SEQ ID NO: 14722 - DNA, 1862 bp, Brassica rapa subsp
  CDS (85)..(1797)
ttcggcacgaggcaactctcttttcttctctgttatctctccacttgtctcagaactcttcaacagccaatatttccagcaaaaatggttgcctctcctgactgcagaatctccctctctgctccgagctgcctacgcggctcctcgggctacaccaagcacattaagctaggaagcttctgcaatggggagctcatggggaagaagcttaacttggctcagcttcgatcttcttcaaccaactcctctcaaaagagaatccaaatgtctttaaacagtgtagctggagagagtaaggtacaagaaattgagtctgagaaaagagatccaaagacagtagcttccattattcttggaggtggagcaggaactcgactctttcctctcacaaagcgtcgcgctaagcctgctgtccctatcggaggagcctataggttgatagatgtaccgatgagcaactgcatcaacagtggaatcaacaaagtctacatactcacacaatacaactcagcgtcactgaacaggcatctaactcgtgcttacaactccaatggagtttttggagacggctttgttgaggctcttgcagccactcaaacgccaggagaaacaggtaaaaggtggttccaaggtacagcagatgcggttcggcagttccattggctttttgaggatgcaagaagcaaggagatagaggatgtgttgatcctctctggtgatcacctttacaggatggattacatggattttgtacaggatcagtcgacaaagcggcgagatataagcatttcctgcataccaatagatgacagggaatgcaaaagagtccaacaaatccattcaaagatcatggtttcttataagtctctgtctgtgttacatggtagacgtgcttcagattttggtctaatgaagatagatgacaaaggaagagtcatctctttcagtgaaaaacctaaaggagatgacctgaaagcaatggcagtagacacaactgttctaggactttctaaggaggaagctgaaaagaaaccatacatagcatcaatgggagtttatgttttcaagaaagaaatactgttgaatctcttgagatggcgtttcccaacagcaaacgactttggttcagagattatacccttctcagctaaagagttctatgtgaatgcttatctctttaatgactactgggaagatataggaaccataagatctttctttgatgcaaatctcgccctcactgagcatccaccagcattcagtttctacgacgcagcgaaaccaatatatacatcaaggagaaacctgccaccatcaaagatagacggctctaagctcattgattcgatcatttctcatggaagcttcttaacaaactgcttaattgagcacagcattgtgggaattagatcaagagtaggtagtaatgttcagttgaaggacactgtgatgcttggggcagacttctacgaaactgaagcagaagttgcagcactacttgctgaggaaaaagttcccattggaataggagagaacacaaagatatcaagtaagactaaacgttcactttcaaatggtttaccttcgaaacaaaaggttcttgattccttttttccttctcatttcccctacagagaatgcattatagacaagaatgctagagttggcaagaatgtagttatagcaaactcagagggagtacaagaagcagataggtcatcagatggattttacatcagatctggcattacagtaatcttgaagaactcagtaattgcagatggagttgtcatatgagacttttaagtcaaaactatattaataaaagcaatttatttgataataaaaaaaaaaaaaaaaaa

SEQ ID NO: 14723 - protein, 570 aa, Brassica rapa subsp
MVASPDCRISLSAPSCLRGSSGYTKHIKLGSFCNGELMGKKLNLAQLRSSSTNSSQKRIQMSLNSVAGESKVQEIESEKRDPKTVASIILGGGAGTRLFPLTKRRAKPAVPIGGAYRLIDVPMSNCINSGINKVYILTQYNSASLNRHLTRAYNSNGVFGDGFVEALAATQTPGETGKRWFQGTADAVRQFHWLFEDARSKEIEDVLILSGDHLYRMDYMDFVQDQSTKRRDISISCIPIDDRECKRVQQIHSKIMVSYKSLSVLHGRRASDFGLMKIDDKGRVISFSEKPKGDDLKAMAVDTTVLGLSKEEAEKKPYIASMGVYVFKKEILLNLLRWRFPTANDFGSEIIPFSAKEFYVNAYLFNDYWEDIGTIRSFFDANLALTEHPPAFSFYDAAKPIYTSRRNLPPSKIDGSKLIDSIISHGSFLTNCLIEHSIVGIRSRVGSNVQLKDTVMLGADFYETEAEVAALLAEEKVPIGIGENTKISSKTKRSLSNGLPSKQKVLDSFFPSHFPYRECIIDKNARVGKNVVIANSEGVQEADRSSDGFYIRSGITVILKNSVIADGVVI

SEQ ID NO: 14724 - DNA, 1858 bp, Brassica rapa subsp
  CDS (31)..(1590)
gaagagtgaagctcctcctctcgaacaacaatggcgacaatggctgcaatcggatccttaaaagtcccttcctcttcctcgaaccacacccgtagattatcatcttcttctcaacggaagactctctcgttctcgtcgtcttctcttaccggagagaaactcaacccgacgcaggagatcatcatctcgaatctcccacgttggcaacgagagaagaacgccatcgattctccaaaagcagtttccgattcgcaaaactcgcaaacttgccttgatcctgacgctagcagaagtgtgttggggataattctgggaggtggtgctggaacgagattgtatccgctaacgaagaagagagcgaaccgagctgttcctctcggcgccaactaccgtctcattgatatccctgtgagcaattgcttgaacagtaacatctccaagatctatgtgcttactcagttcaactccgcttctctcaaccgccatctctcccgagcttacgccagcaacatgggtggttacaagaacgaaggcttcgtcgaggttcttgctgctcaacagagtcccgagaatcccaattggtttcaggggactgctgatgcagtgaggcagtacttgtggctgtttgaagagcacaatgtgttggagtttttggttcttgcaggggatcatttgtaccgtatggactacgagaagttcattcaagcgcatcgtgagaccgacgctgatatcactgttgctgctcttcctatggatgagaaacgtagcacggcttttggacttatgaagattgatgacgaaggaaggatcattgagtttgctgagaagcctaaaggagagcagttaaaggctatgaaggttgatacaacaatcttgggacttgatgacgaaagggccaaagagataccctttattgctagtatggggatatatgttgttagcaagaatgtgatgttggacttgctccgagaccagttccctggagctaatgacttcgggagtgaagttatccctggtgctactgatcttggactcagagtgcaagcttatctgtatgatggatactgggaagatattggtaccattgaagccttttacaatgctaatcttgggatcaccaagaaaccagtaccagatttcagcttctatggccgttcagcaccaatctacacacagcctcggtacttacctccatccaagatgcttgatgccgatgttaccgatagtgtgatcggtgaaggttgtgtcatcaagaattgcaaaatccaccattccgtcattggtcttcggtcttgcatatcggagggtgcaatcatagaagacaccttgttgatgggtgctgactactacgagactgatgcggataggacactcctggctgcaaaaggcagggtcccgattggcattggcgagaactctcacattaaaagagctatcattgacaagaatgctcgtattggtgacaacgtcaagatcatcaacacggacaatgtgcaagaagctgccagagagacggatggatacttcatcaagagcggcattgttacagtgatcaaggatgctctgattcctagtggaactgttatctaagagacaccaccaccctgtttgacaatcttcttaatatctcatggttttgacctcgagttagcttccactgatgctatctctaatgttatccgaggtcagggcctatgcatcctcctgccttatccctaaataatattctctactttgtattctagatctttggcgatatatgcgtatatatacatgcattttttttttaaaaaaagcacaacattccctctatgtaacaaaactatgaaccagaaattgttaaaaaaaaaaaaaaaaa

SEQ ID NO: 14725 - protein, 519 aa, Brassica rapa subsp
MATMAAIGSLKVPSSSSNHTRRLSSSSQRKTLSFSSSSLTGEKLNPTQEIIISNLPRWQREKNAIDSPKAVSDSQNSQTCLDPDASRSVLGIILGGGAGTRLYPLTKKRANRAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRSTAFGLMKIDDEGRIIEFAEKPKGEQLKAMKVDTTILGLDDERAKEIPFIASMGIYVVSKNVMLDLLRDQFPGANDFGSEVIPGATDLGLRVQAYLYDGYWEDIGTIEAFYNANLGITKKPVPDFSFYGRSAPIYTQPRYLPPSKMLDADVTDSVIGEGCVIKNCKIHHSVIGLRSCISEGAIIEDTLLMGADYYETDADRTLLAAKGRVPIGIGENSHIKRAIIDKNARIGDNVKIINTDNVQEAARETDGYFIKSGIVTVIKDALIPSGTVI

SEQ ID NO: 14726 - DNA, 1080 bp, Thermoplasma acidophilum
  CDS (1)..(1080)
atgtccctgaaaggagttgtgatggccggaggcaagggaacgaggctgaggccaataacatattcgatcccgaaaccgctcgttccagtggctggaaagcccgtgatatcgtacatactggatgcgttttacagatcgggaataagcgatataataataacaaccggttataagttcgaatccctcataaagggtgttctggaaaataagaacagccaacagaatatacttttttctgtggaaaaggaggccgctggaacagccggaggggtaaagattgcggaaaactttcttgacgataccttcgtggtggggagtggggatatactcatagatttcgacataggagacatgataaaggagcaccagcgcaggaagaacaagataacgatcgcagtgacaaaggtggacgacccatcccagttcggaatagcggagatagatgaggaaggttacatcaagcgattcctggaaaagccaggaaagaacgagaccttctcggacaccataaatgcaggcgtttacatcatggatcgatcgcttctccggtacataccatccacggggcagttcgattttgcaaaggatctgtttccaaagctgctctcgcagggcataaagataggaacatacctcatagatggcgtgtggctggatgccggaaggccgaaggacgtcataaaggcaaaccagataatggttgagaaatatggcgaaagcttcaatggtaccggcaaggcaataataaaatcaaaggtgccgcagggctgctccataaagccgcccatatacataggcgagggtgtgcacgtaggaaacaacagcaccatatcaggatcggccgtttacgatggcgtttcgataggcgatgacgttcagatcgagaattctgtcataatggcatcgtcaaagataatgcggggaacgaaggttgtgaactcagtgataatgcagaacacaactataggcgaagactgcgagatacatgacagcgtactgtcgcagaaattaaacctacagaacggatcgaaggtattccaggttgccctgtcatctgagatagtacaggatgaaaactag

SEQ ID NO: 14727 - protein, 359 aa, Thermoplasma acidophilum
MSLKGVVMAGGKGTRLRPITYSIPKPLVPVAGKPVISYILDAFYRSGISDIIITTGYKFESLIKGVLENKNSQQNILFSVEKEAAGTAGGVKIAENFLDDTFVVGSGDILIDFDIGDMIKEHQRRKNKITIAVTKVDDPSQFGIAEIDEEGYIKRFLEKPGKNETFSDTINAGVYIMDRSLLRYIPSTGQFDFAKDLFPKLLSQGIKIGTYLIDGVWLDAGRPKDVIKANQIMVEKYGESFNGTGKAIIKSKVPQGCSIKPPIYIGEGVHVGNNSTISGSAVYDGVSIGDDVQIENSVIMASSKIMRGTKVVNSVIMQNTTIGEDCEIHDSVLSQKLNLQNGSKVFQVALSSEIVQDEN

SEQ ID NO: 14728 - DNA, 1083 bp, Streptomyces coelicolor
  CDS (1)..(1083)
atgacagaagcgatcctcctggtcggcggcaagggcacgcggctgcggccgctcacggtgaacacgcccaagcccatggtccgggccgccggagtgccgttcctcacgcaccagctggcgcgggccaaggcggccggcgtcgaacacatcgtgctcgcgacgagctacctggccgaggtgttcgagccgtacttcggcgacggctcgacactcggcctgcacctcgagtacgtcacggaggaggagccgctcggcaccggcggcgcgatccgcaacgtggcctcccggctgcactcgggccccgacgagccggtgctgatcttcaacggcgacatcctgacgggcctggacatcggcgcgctcgtccgcacccacgagacgacgggcgcggacgtctccctgcacctgacccaggtgaccgacccgagggcgtacgggctggtccccacggacgacacgggccgagtgctcgccttcctggagaagccccagacccccgaggagatcgtcaccgaccagatcaacgcgggggcgtacgtcttccgccgctccgtcatcgacacgatcccggcgggccgcccggtctcggtcgaacgcgagaccttcccggaactcctcgccaccggcgcccacctccagggcatggtcgactccacgtactggctggacctgggcaccccggcggccttcgtccgcggctcggccgacctggtcctgggccgcgccccgtccccggccgtaccgggccgctgcggcgaccgcctcgtgctgcccacggcacaggtcgcgcccgacgccaagctgaccggcggcacggtggtcggcgagggcgccttcgtggcggagggggcgcgcgtcttcggcagcacgatcctgccgggcgccgtcatcgagccgggggccgtcatcaccgactccctcatcggcacccgcgcccgcgtcggcacccgctcggtcctcgccgacacggtcatcggcgacggggcggtcatcggcgccgacaacgaactccgctccggcgcccgcatctggtgcgacgcccacatcccccctgcatccctccgcttctcaccggacacgtga

SEQ ID NO: 14729 - protein, 360 aa, Streptomyces coelicolor
MTEAILLVGGKGTRLRPLTVNTPKPMVRAAGVPFLTHQLARAKAAGVEHIVLATSYLAEVFEPYFGDGSTLGLHLEYVTEEEPLGTGGAIRNVASRLHSGPDEPVLIFNGDILTGLDIGALVRTHETTGADVSLHLTQVTDPRAYGLVPTDDTGRVLAFLEKPQTPEEIVTDQINAGAYVFRRSVIDTIPAGRPVSVERETFPELLATGAHLQGMVDSTYWLDLGTPAAFVRGSADLVLGRAPSPAVPGRCGDRLVLPTAQVAPDAKLTGGTVVGEGAFVAEGARVFGSTILPGAVIEPGAVITDSLIGTRARVGTRSVLADTVIGDGAVIGADNELRSGARIWCDAHIPPASLRFSPDT

SEQ ID NO: 14730 - DNA, 2496 bp, Streptomyces coelicolor
  CDS (1)..(2496)
atgaaggccgtcgtgatggctggaggcgaaggcacacgccttcgtcccatgacctcgagcatgcccaagccgctcctgccggtggtcaaccggccgatcatggagcatgttcttcggctgctcaaaaggcatgggctcaacgagaccgtcgtgaccgtccagttcctggcctcactggtcaagaactacttcggtgacggcgaggagctcggaatggagctcacctatgccaacgaggagaagccactcggtaccgccggaagcgtcaagaacgccgaggaggcattgaaggacgatgccttcctcgtcatttccggcgatgccctgaccgacttcgacctcaccgatctgatcaacttccacaaggaaaagggctcgctcgtcaccgtgtgtctgacgcgcgtgcccaacccgctggaattcggtatcaccatcgtcgacgaagagggcaaggtcgagcgcttcctggagaagccgacctggggccaggtcttctcggacaccgtgaacaccggcatctacgtcatggagcccgaggtcttcaactatgtcgaccccgatgtgcccgtggactggtccggtgacgtcttcccgcagttgatgaaggaaggcaagcccatctacggctatgtcgccgagggctactgggaggacgtcggtacccatgagagctatgtgaaggcccaggccgacgttctggaacgcaaggtcgacgtcgacatcgacggcttcgagatctcgcccggcgtctgggtggccgagggtgcggaggtgcatcccgacgcggtgctgcgcggacccctctacgtcggcgactacgcgaaggtcgaggccggcgcggagatccgcgaacacacggtgatcgggtccaacgtcgtcgtcaagagcggcgccttcctgcacaaggccgtggtcgccgacaacgtgtacgtcggcccgcacagcaatctgcgcggctgtgtggtcggcaagaacaccgacatcatgcgcgccgcgcggatcgaggacggcgcggtcatcggcgacgaatgcctggtcggtgaagaatcgatcatccagggcaatgtgcgggtctacccgttcaagaccatcgaggcaggcgcgttcgtcaacacctcggtgatctgggaatcccgcgggcaggcgcatctcttcggtgcgcgcggggtctccggcatcctcaacgtggagatcaccccggagctggccgtgcggctggccggtgcgtacgcgacgaccctgaagaaggggtccaccgtcaccacggcccgtgaccactcccgtggcgcccgggcgctgaagcgggcggtgatctccgcgctgcaggccagcgccatcgacgtacgcgacctggagaacgtacccctgcccgtggcgcggcagcagaccgcgcggggcagcgccggcgggatcatgatccggaccaccctcggggtgccggactccgtcgacatcatgttcttcgacggccagggcgccgacctctcgcagggcagccagcgaaagctggaccgggtcttcgcgcgccaggagtaccggcgggcgttccccggcgagatcggggacctgcacttcccgtccagcgtgttcgactcctacaccgggtccctgctgcgcaacgtcgacatcaccggcatcgcggagtccgggctcaaggtggtcgtcgacgcctccaacggcagcgcgggactggtgctgccgagcctgctcgggaagctcggcgtcgactccctgacgatcaatcccggtctcgacgaggccaggcccaccgagtcggccgacatgcggcggtccggtctggtgcgcctcggggagatcgtggcgtcctcgcgggccgcgttcggcgtgcggttcgaccccgtcggtgaacggctgtcgctcgtcgacgagaagggccgcatcatcgaggacgaccgggcgctgctggtgatgctcgacctgatcgcggccgagcggcgcagcggccgggtggcgctcccggtgaccaccaccaggatcgccgagcaggtcgccgcgtaccacggcacgcaggtcgagtggacgaccacctccccggacgatctgacgcgggtggggggcgaggaaggcgcgatcttcggcggagacggcaagggcggcttcatcgtccccgagttcagcagtgtgtacgacggcacggcggccttcgtgcggctgatcggactggtcgcgcgcacgcagctcacgctgagccagatcgacgcgcggatcccgcgggcccacgtcctcaagcgcgatctggccactccgtgggcggtcaagggcctggtgatgcggcgggtcgtcgaggcggccggagaccggttcgtggacaccacggacggggtgcgggtggtcgagaccgacgggcgctgggtgatggtcctgcccgaccccgcggaggcggtcacccatctgtgggcggagggccccgacgacgcctccgcacaggcgctgctggacgagtgggccgcggtggtggacagcgcgggccgctga

SEQ ID NO: 14731 - protein, 831 aa, Streptomyces coelicolor
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDAFLVISGDALTDFDLTDLINFHKEKGSLVTVCLTRVPNPLEFGITIVDEEGKVERFLEKPTWGQVFSDTVNTGIYVMEPEVFNYVDPDVPVDWSGDVFPQLMKEGKPIYGYVAEGYWEDVGTHESYVKAQADVLERKVDVDIDGFEISPGVWVAEGAEVHPDAVLRGPLYVGDYAKVEAGAEIREHTVIGSNVVVKSGAFLHKAVVADNVYVGPHSNLRGCVVGKNTDIMRAARIEDGAVIGDECLVGEESIIQGNVRVYPFKTIEAGAFVNTSVIWESRGQAHLFGARGVSGILNVEITPELAVRLAGAYATTLKKGSTVTTARDHSRGARALKRAVISALQASAIDVRDLENVPLPVARQQTARGSAGGIMIRTTLGVPDSVDIMFFDGQGADLSQGSQRKLDRVFARQEYRRAFPGEIGDLHFPSSVFDSYTGSLLRNVDITGIAESGLKVVVDASNGSAGLVLPSLLGKLGVDSLTINPGLDEARPTESADMRRSGLVRLGEIVASSRAAFGVRFDPVGERLSLVDEKGRIIEDDRALLVMLDLIAAERRSGRVALPVTTTRIAEQVAAYHGTQVEWTTTSPDDLTRVGGEEGAIFGGDGKGGFIVPEFSSVYDGTAAFVRLIGLVARTQLTLSQIDARIPRAHVLKRDLATPWAVKGLVMRRVVEAAGDRFVDTTDGVRVVETDGRWVMVLPDPAEAVTHLWAEGPDDASAQALLDEWAAVVDSAGR

SEQ ID NO: 14732 - DNA, 2741 bp, Chlamydomonas reinhardtii
  CDS (1)..(1545)
atggccctgaagatgcgggtgagccagcgccaggcgctgggctcgcagaccttcgtctgcccccacggctcagtggtgcgcaaggccgtgagctccaaggcccgcgccgtgtcgcgccaggctcaggtcgttcgggctcaggctgtgtcgacccccgttgagaccaaggtcgcgaacggggtggccgcatcctctgctgcgggcactgggcagaacgacccggctggcgacatcagcaagacggtgctgggtattattctgggtggtggtgccggcacccgtctgtatcctctgaccaagaagcgtgccaagccggcggtgcccctgggcgccaactatcgcctgatcgatattcccgttagcaactgcctgaacagcaatgtcaccaagatttactgcctcacccagttcaactcggcgtcgctgaaccgccacctgtcccaggcctacaactcgtctgtgggcggctacaacagccgcggcttcgtggaggtgctggcggccagccagtcgtccgccaacaagagctggttccagggcaccgccgacgccgtgcgccagtacatgtggctgttcgaggaggcggtgcgcgagggcgtggaggacttcctcatcctgtcgggcgaccacctgtaccgcatggactaccgcgactttgtccgcaagcaccgcaactcgggcgccgccatcaccatcgccgcgctgccctgcgcggagaaggaggccagcgccttcggcctgatgaagatcgacgaggagggccgcgtgatcgagttcgcggagaagcccaagggcgaggcgctgaccaagatgcgcgtggacaccggcatcctgggcgtcgaccccgccaccgccgccgccaagccctacatcgcctccatgggcatctacgtcatgtccgccaaggcgctgcgcgagctgctgttgaaccgcatgccgggcgccaacgacttcggaaacgaggtcatccccggcgccaaggacgccggcttcaaggtgcaggccttcgcctttgacggctactgggaggacatcggtaccgtggaggccttctacaacgccaacctggcgctgaccgatcccgagaaggcgcagttctcgttctacgacaaggacgcgccgatctacaccatgtcgcgcttcctgccgccctccaaggtgatggactgcgacgtgaacatgtccatcatcggcgacggctgcgtgatcaaggccggctccaagatccacaactccatcatcggcatccgctcgctgatcggctccgactgcatcatcgacagcgcgatgatgatgggctcggactactacgagaccctggaggagtgcgagtacgtgcccggctgcctgcctatgggcgtgggcgatggctccatcatccgtcgcgccattgtggacaagaacgcgcgcattggtcccaagtgccagatcatcaacaaggacggcgtcaaggaggccaaccgcgaggaccagggcttcgtgatcaaggacggcattgtcgtcgtgatcaaggactcgcacatccccgccggcaccatcatctaaacgtgatggctcgggccgggaagaggcggcgcggcgcagagccggccggcgcggcggcagccggcggcgcgcggcgtgtggcggagacgttggtgatggagagcagacggaggtggcgggacctcaggcacatttcggcagctgccgtagcgaggagcagtggagagccgagcgtgtgtgggtgcacacgctagcgcgcactcacgacctgcagcagcagcagccgtggcggagatggcgggagctgctcgggtactgttgaagcgaggcgggcccttggctgcgtttttgggttggaatgttgcgcagtgacgggactctatagagtaggggggattgagtgtccttggttcggggtgaacgccatggaccggtgcggcacggcgtggcgtggcactgcgttgctgcggaagcgcaagctgcggccttcccgcaacggtgcagcagccgcatcggacgcaacaccccaggagcggcagtagctgccagtcgcgtgcggctgttttgagggagagcgctttttcgggagcgtgaacggtcggaccaagcaccggcggtggcagcggcaggccttcggccccccggcccttaaagctgccggcgccaaagcacgccgcgaggcgtgtgtgttcccgaggtgcagccgggcggtggcggctgcagggtgggtgcgagccagctggcgtgccatccagcacggcggcggttgttgcggctcggcggtggggaaggtggagcactgagcgggcgtgggtcgggacgcttcgcggctcacgcggcggttggccgttgcggctgccttccgtgggatgccgtaggaggggcgggtccttactcgctcgcgtcccacctggggggttgtagtttcttaatttagcgtgtaccatgctcaacattgtttgactcccccagaccctgcgaacctgcatctgcggaggtagagagggctcttgggtgtgtgcagatttttggttgtttggtttgggtgatggtgcaacagttttgcgcgtggcgagtgtgtgcgttctcagatgaggagaattgtttgtgctatgcagagtttgaggctgagaggaagacttttgggcacgactgcaccgtgcatccatggagcacagctgcatagaagcacgtgggcaacgcacacggcttgaaaaaaaaaaaaaaaaaaaaaaaaaaaaaaaaaaaaaaaaaaa

SEQ ID NO: 14733 - protein, 514 aa, Chlamydomonas reinhardtii
MALKMRVSQRQALGSQTFVCPHGSVVRKAVSSKARAVSRQAQVVRAQAVSTPVETKVANGVAASSAAGTGQNDPAGDISKTVLGIILGGGAGTRLYPLTKKRAKPAVPLGANYRLIDIPVSNCLNSNVTKIYCLTQFNSASLNRHLSQAYNSSVGGYNSRGFVEVLAASQSSANKSWFQGTADAVRQYMWLFEEAVREGVEDFLILSGDHLYRMDYRDFVRKHRNSGAAITIAALPCAEKEASAFGLMKIDEEGRVIEFAEKPKGEALTKMRVDTGILGVDPATAAAKPYIASMGIYVMSAKALRELLLNRMPGANDFGNEVIPGAKDAGFKVQAFAFDGYWEDIGTVEAFYNANLALTDPEKAQFSFYDKDAPIYTMSRFLPPSKVMDCDVNMSIIGDGCVIKAGSKIHNSIIGIRSLIGSDCIIDSAMMMGSDYYETLEECEYVPGCLPMGVGDGSIIRRAIVDKNARIGPKCQIINKDGVKEANREDQGFVIKDGIVVVIKDSHIPAGTII

SEQ ID NO: 14734 - DNA, 2134 bp, Perilla frutescens
  CDS (282)..(1865)
tgaaagctcacaggccaataaagctaccacctttcactcatcccacccaaccacccacaccacccctactttgatagacttctcatgcattctatagatttcttgtgagctatatatcgatcaccaactgttgtggaatagatcttcaagttcttattttcattcctttctttccctctccttttcaagattcttgattcgtgggtactaggaatttttcctataattctggatgatctagtcgcataagatcttgagctcttacaagtcagaatactgcaatggatgcttgctgtgctacattgaaatcgacatcccatttgtccaatgtgagcaaaagtgcgttttgtggtgaaaaaaatgggttttggggagagaaaattaaagggagtttaaataattgtgctagggcttatcaatttgggaaaaaattgaatcttgagaaaaggggaaggaagatcaaacctggcgttgcttattctgttctcaccaaaaaaaacatcaatgaaacactgatgataccacctcccctattcgaaaaacgaggggcgaatccgaaaattgtggctgcgatcattctgggaggaggtgctgggaaacaacttttcccgcttacaagcaaagctgccaccccagctgttccagtgggaggatgctataggctgattgacatcccgatgagcaactgcatcaacagtggcattaacaagatctttgtgctgacccagttcaattctgcttctctaaatcggcacatctctcgcacttatactggaaatggtgttagctttggggatggttttgttgaggttttggctgcaactcacacagcgggggaaacaggaaaccaatggttccagggcacggcagatgcggttaggcaatttacatgggtatttgaagatgctaaggcaaaagatattgataacatattgattctatcaggggatcatctttataggatggactacatggactttgttcagaaccacattgatcgaaatgctgacatcacactttcgtgtgcaccagtttgtgacagccgagcgtcagaatatggactggtgaagattgacagcagaggtcgtataatcctcttttctgaaaagccgaaagaggcggataggatggcaatggaagtagacacctctatcataggattgtccccagaggaagctctaaaatctccatatattgcttcgatgggagtatatgcatttaagaccgacgttttattgaagcttcttcgttggagatacccaacatcaaatgactttggatctgagatcataccctcttcagtaaaggaacacaatgtgcaggcctatatattcagagactactgggaggatattggaacgataaaatcattttatgatgccaatttagctcttacagatgagtttccaaagttcgagttttatgatccaaagactcctttctacacatcgctccgtttcttgccaccaacaaaaatcgacaattgcaagattaaagatgcgataatctcccatggatgcttcctgcgagaatgtgtttgtcaacattcgatactcggtgagcgctcccgtttagactccggggttgaacttaaggatactctgatgatgggggctgattattacccaactgaatcggagatcgcttcactcctagttcaagggaaagttccaatgggaattggtagaaatacgaaaatcagcaactgcatcatcgacaagaacgcaagaattgggaaagacgttatcatcaagaacaaagatggtgtcgaagaagctgatagatcggaggaaggattctacattcgttcggggattactatagtagttgagaaggcaacgataaatgatggaacgatcatatagatgttactgcagttgatccttcgagctgacatatgctgggatttgaggcactatcagctgaggcaccacaggaaacccgtccgttgtcgtgcaggaaacttccctcttgctcgtgtaaaaaggaatatatcgtttcttctcctaaaaaataatgcctcttattttcttgttttcctgtagtaggaaagatcgtgagtgtaagttaaactactgttgcaatagtatcaatgaataaccatattttactgttaaaaaaaaaaaaaaaaaaa

SEQ ID NO: 14735 - protein, 527 aa, Perilla frutescens
MDACCATLKSTSHLSNVSKSAFCGEKNGFWGEKIKGSLNNCARAYQFGKKLNLEKRGRKIKPGVAYSVLTKKNINETLMIPPPLFEKRGANPKIVAAIILGGGAGKQLFPLTSKAATPAVPVGGCYRLIDIPMSNCINSGINKIFVLTQFNSASLNRHISRTYTGNGVSFGDGFVEVLAATHTAGETGNQWFQGTADAVRQFTWVFEDAKAKDIDNILILSGDHLYRMDYMDFVQNHIDRNADITLSCAPVCDSRASEYGLVKIDSRGRIILFSEKPKEADRMAMEVDTSIIGLSPEEALKSPYIASMGVYAFKTDVLLKLLRWRYPTSNDFGSEIIPSSVKEHNVQAYIFRDYWEDIGTIKSFYDANLALTDEFPKFEFYDPKTPFYTSLRFLPPTKIDNCKIKDAIISHGCFLRECVCQHSILGERSRLDSGVELKDTLMMGADYYPTESEIASLLVQGKVPMGIGRNTKISNCIIDKNARIGKDVIIKNKDGVEEADRSEEGFYIRSGITIVVEKATINDGTII

SEQ ID NO: 14736 - DNA, 1887 bp, Perilla frutescens
  CDS (58)..(1620)
caaaaccagtcgtggaaatcccaattgaattgcaggtgtagcgagtgaggaatgcaaatggcggcggtggcatcgtcatcaccgatgggcttcagcaaaatttgcggcctgaattcagtttctgaactaagtgggcaatgcaagcccaccgttggtttctcaaaatcggagctttttggcggtgcagtgtgtgtgaaatctataagtaaaaatggtggcagaggcaatgccaggaccagattgccttctgcccgtgttgtttctcccaaagctgtttccgataccagctcctctcttacttgtcttgaacctgatgccaattttagtgaattggcattttttttggagtggagtggaacgcggctttaccttcttaggaaaaaaagagcaaaacctgctgtccccattggtgcaaattaccggttgaatgacattcctgttagtaattgtttgaacagcaatgtatcaaagatatatgtccttactcagttcaattctgcttttcttaatcgtcacttatcacgggcctatgcaagcaatatgggcggctataagaatgaagggtttgttgaagtttttgctgcccagcaaagcccagaaaatcctaactggttccagggcacagctgatgctgtgaggcagtatttatggctatttgaagaacatgatgtccttgaatatctggttcttgctggtgatcatttgtatcgtatggattacgagaaatttgtccaatcacacagagaaactgatgctgatataacagtggcagctctgccaatggatgaaaaacgtgctactgcattcggtctaatgaagattgatgatgaaggaaggataatagaattttcagagaagccaaagggagaagcactaaaggcaatgagggtggacacgacaattttaggcctcgatgatgagagagcaaaggaaatgccgtacattgcaagtatgggtatttatgttttcagtaagaatgcaatgttgaatttactgcgagacaaatttccaggagccaatgattttggaagtgaagttattccgggtgctacttcagttggtctgagggtccaagcctatctatatgatggttactgggaagacattgggacaatcgaagcattctacaatgccaatttaggaattacgaaaaaacctgtcccagatttcagcttctatgatcggtcggctcctatcaacacacaaccgcgttacttacctccttcaaaaatgctgaatgctgatgttacagacagtgtgattggtgagggttgcgtcattaagaattgtaagattcatcattctgtaattggattgcggtcgtgcatttcggagggtgcaatcatagaagacaccctgttgatgggagctgactattatgagaccgattcagacagaagaatcctagcagcaaaaggtggcattccaattggaatcggcaagaactcgcatatcaagcgggcaataatcgacaaaaatgttcgtattggagagaatgtgaagatcataaacagcgacaatgtgcaagaggcagcgagagagacggatggttacttcatcaagagcggtatcgtcactgtcatcaaggacgccttgattcccagctctaccattatttgaacctttgatgatgcctgctacaatcataaaaatatactagtttcctttttcaattcaattgtatattttatttcatttcacaagattgcaggggttccagcttccacaattttgtagactcactcaaaatcttgattttgttgctattaattattttcccacgcccaccttatgcttttcatcgtattggaataatagtgggcagtgatcggtggtacactttattaaatgataagtaataagttggtctaaaaaaaaaaaaaaaaa

SEQ ID NO: 14737 - protein, 520 aa, Perilla frutescens
MAAVASSSPMGFSKICGLNSVSELSGQCKPTVGFSKSELFGGAVCVKSISKNGGRGNARTRLPSARVVSPKAVSDTSSSLTCLEPDANFSELAFFLEWSGTRLYLLRKKRAKPAVPIGANYRLNDIPVSNCLNSNVSKIYVLTQFNSAFLNRHLSRAYASNMGGYKNEGFVEVFAAQQSPENPNWFQGTADAVRQYLWLFEEHDVLEYLVLAGDHLYRMDYEKFVQSHRETDADITVAALPMDEKRATAFGLMKIDDEGRIIEFSEKPKGEALKAMRVDTTILGLDDERAKEMPYIASMGIYVFSKNAMLNLLRDKFPGANDFGSEVIPGATSVGLRVQAYLYDGYWEDIGTIEAFYNANLGITKKPVPDFSFYDRSAPINTQPRYLPPSKMLNADVTDSVIGEGCVIKNCKIHHSVIGLRSCISEGAIIEDTLLMGADYYETDSDRRILAAKGGIPIGIGKNSHIKRAIIDKNVRIGENVKIINSDNVQEAARETDGYFIKSGIVTVIKDALIPSSTII

SEQ ID NO: 14738 - DNA, 1877 bp, Perilla frutescens
  CDS (76)..(1647)
ctcacacatacactcactctctctcttctctctctcacactcaaacacacgcggtggtaagtgttttgccttacaatggcagccaccgccgtattcaagtcgactccaggcaaaactgcaatcgcaaattacagtagtttggaggatgtcaattccacgtcgtttaagagactgtcgtttgcggcgtctaacgtggccggggagagaatcacatctccgccgcggctccgagtgcggcggagtcgtgccggaggtgaattggagcggcggagcccagtgatcgtgtctccgaaggcggtttccgactctcagaattcgcagacgtgccttgatcctgacgcaagcagaagtgtcttgggaattattctgggaagtggtgctggaactaagctttatcctcttacaaaaaagagggcaaaaccagctgttccttttggagcaaattatcggttaattgatatccctgttagcaattgcttgaacagtaatatatccaagatatatgtcctcactcaattcaattctgcttccctcaatcgtcatctttcgagggcatatgcaagcaacatgggtggatacaaaaatgaaggctttgttgaggttcttgctgctcagcaaagtccagaaaatcccaattggttccagggtactgcagatgcagtaaggcaatatttatggttgtttgaagagcacaatgttcttgaattcctgattcttgctggcgaccatctatacagaatggattatgagaggtttattcaggctcatagagagacagatgctgacattactgttgctgccttgcctatggatgaaaagcgtcccacagcatttggattgatgaagattgatgaagaagggcgcatcattgaatttgctgagaaaccaaagggagaacagttaaaagctatgaaggttgatactaccatattgggtcttgatgataagagagcaaaggagatgccttacattgcaagtatgggaatatatgttgttagtaaagatgtgatgttaaatcttctcagagacgagtttccggcagctaatgattttggaagtgaagttattcctggagccactgccatgggattaagagtgcaagcgtacttgtttgatggctactgggaagacattggtaccattgaagctttctacaatgccaatctggggatcacaaaaaagccagtgccagatttcagcttctatgatcgatcagctccaatatatacccaacctcgatatctgcctccttctaagatgttggatgctgatgtcacagatagcgtcattggtgagggctgcgtgatcaagaactgcaaaatccaccattctgtggttggacttagatcgtgcatagctgagggtgcaatcattgaggacaccttgctgatgggtgcagattattatgagacggacgcggacagaaggtttctggcagccaagggtggtgtgcctattggcataggtaaaaacactcacatcaagagagccatcattgacaagaatgccaggattggagaaaatgtaaagattgttaatggtgataatgtgcaagaagcagcaagagagacggacggatactttatcaagagtggcatcgtcactgtaatcaaagatgctttgattcccagtggtaccatgatctagaattcagacgagtctttcagcgctgcctttgggtaggtcctcaacacaactcggcctctcaagttacggggggtggagagttttcagcttatgggtataatcttgctgaacatgttcctgttgttgcataatagctgagatgaaaacagacttgattactcgttgaatagcgaaataatttataatacaataaacattagtttcatctcaaaaaaaaaaaaaaaaaaaaa

SEQ ID NO: 14739 - protein, 523 aa, Perilla frutescens
MAATAVFKSTPGKTAIANYSSLEDVNSTSFKRLSFAASNVAGERITSPPRLRVRRSRAGGELERRSPVIVSPKAVSDSQNSQTCLDPDASRSVLGIILGSGAGTKLYPLTKKRAKPAVPFGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRPTAFGLMKIDEEGRIIEFAEKPKGEQLKAMKVDTTILGLDDKRAKEMPYIASMGIYVVSKDVMLNLLRDEFPAANDFGSEVIPGATAMGLRVQAYLFDGYWEDIGTIEAFYNANLGITKKPVPDFSFYDRSAPIYTQPRYLPPSKMLDADVTDSVIGEGCVIKNCKIHHSVVGLRSCIAEGAIIEDTLLMGADYYETDADRRFLAAKGGVPIGIGKNTHIKRAIIDKNARIGENVKIVNGDNVQEAARETDGYFIKSGIVTVIKDALIPSGTMI

SEQ ID NO: 14740 - DNA, 2034 bp, Citrus unshiu
  CDS (119)..(1714)
ataaagctaaaaccgccaccttcaacatcttcaattcacgcatttcactcccattttcaaccatttgattttgatcaccccatttgtgcgttaggctcctggaagtgaagcaagtgcaatggattcttgttgtgtgggcttgagagctaatacccatgtggtgaaagctagcaaatacggttcaaaaattggagataatgcgttgtggggagagaggatcagagggagtgtacgcaatgatggttgtactaagcagttgaaaaaaagtttgaaagctgaaaagagagatgagaaggtcaaacccggtgttgcttatgctattatgacatcaaaacatcccaatgaggttatgaccttagcaccacctaggcttgagagaagaagagtagatccgaaaaatgttgctgcaatcattttaggtggcggtgcagggactaagctctttcctcttaccttaagagcagcaacaccagctgttccagtttctggctgttacaggcttatagacatccctatcaacagtggcataaacaagatcttcgtgttgacccaattcaactcagcttccctcaatcggcatatagcacgcacatatttcgggaatggtaccaattttggggatggatttgtggaggttctagcagccactcaaacgcctggggaatctggaaagaattggtttcaaggaacagctgatgccgtgacgagatttacatgggtatttgaggatgccaagaataggaacattgaaaatgtagctatcttgtgtggggatcatctttctatcttgtgtggggatcatctttatcgaatggattatatggattttatccagagtcatgttgatagagatgctgatattacaatttcatgtgcagcagtaggtgaaagccgcgcatcagattatggattggtgaagatagacaatatgggccgcatcgcccagtttgctgaaaaaccaagcggtgcaaatctgaaagctatgcaagtagataccagtcttctgggattctctcctcaagaagccaggaagtccccatatgttgcatcaatgggagtctatgtatttaaaaaagatgttttattaaaacttttgaggtggagatatcctacatccaatgactttggatctgagatcatcccagccgccatcatggagcatgatgtccaagcatatatcttcagagactactgggaggatattggaacaataaagtctttctatgaagctaacatggccctcaccaaagagtctccagcgtttcatttttatgacccgaagacacctttctacacttctcctcgtttcttaccgcccacaaaaattgataactgccggatgaaggatgcaataatttcgcatggatgtttcttgagggaatgtactgtggagcactcaatagtgggtgaacgctcacgtatagattatggtgttgagctaaaggacaccgtgatgttgggtgcagactattatcaaactgaatcggaaattgcttctctgttagctgagggaaaggtcccaattggggttggacgcaatacaaaaatcaggaactgcataattgacaagaatgtgaagataggaaaagatgtggtcattgtgaacaaagatggtgttcaggaagctgatagaccagaacttggattctacattcgttcaggaatcaccattataatggagaaagcaacaattgaagatggaatggtcatatagatgagtctcatacctttcatgaactggtttaaaatggggattggaaagccgtaatgtccgtggctgatgaggaagctatgaagatcacaagagcagcattttggcctggaaagaagcaagctgcgtgtttatactacatgtatattagaagctcctatcctatatgtataaaacgagcctaggacaacaatagatgcgagcagttttcaaataaaattagtagactgattctgatcagttcactgcttttcttcctgtgtagagcatcaaacttttggtataattaattaacagactatgctaaaaaaaaaaaaaaaaaa

SEQ ID NO: 14741 - protein, 531 aa, Citrus unshiu
MDSCCVGLRANTHVVKASKYGSKIGDNALWGERIRGSVRNDGCTKQLKKSLKAEKRDEKVKPGVAYAIMTSKHPNEVMTLAPPRLERRRVDPKNVAAIILGGGAGTKLFPLTLRAATPAVPVSGCYRLIDIPINSGINKIFVLTQFNSASLNRHIARTYFGNGTNFGDGFVEVLAATQTPGESGKNWFQGTADAVTRFTWVFEDAKNRNIENVAILCGDHLSILCGDHLYRMDYMDFIQSHVDRDADITISCAAVGESRASDYGLVKIDNMGRIAQFAEKPSGANLKAMQVDTSLLGFSPQEARKSPYVASMGVYVFKKDVLLKLLRWRYPTSNDFGSEIIPAAIMEHDVQAYIFRDYWEDIGTIKSFYEANMALTKESPAFHFYDPKTPFYTSPRFLPPTKIDNCRMKDAIISHGCFLRECTVEHSIVGERSRIDYGVELKDTVMLGADYYQTESEIASLLAEGKVPIGVGRNTKIRNCIIDKNVKIGKDVVIVNKDGVQEADRPELGFYIRSGITIIMEKATIEDGMVI

SEQ ID NO: 14742 - DNA, 1889 bp, Citrus unshiu
  CDS (69)..(1616)
actcactcaggctcagctcgcttaacgattacgttaacgttaacagattgtaccgattaatggcgagtatggcgtcgatcggatcgctcaaagttccgtcatctccgtcaactgcagcaacgtcgtctaactccaacaatcacagccgcaggagtgtggttaaacgactggcgttctcgtcgtctcagctctccggtgacaagattttttctaaagctgtcaccggtgatcggcgaagggagaggcgtcgatcgttgtgtctccttcaagcggtgtcggattcgaaaaattcgccccttgatcctgaagccagtcgaagagtcttggggattatacttggaggtggagcagggactcgcttgtatccacttacgaagaagagggcaaagcctgctgttccattgggagctaattacaggctgattgatattcctgtgagcaattgtttgaatagtaacatttcaaagatctatgttctcactcagttcaattctgcgtccctgaatcgacacctatcgagggcgtatgctagcaacatgggtggttacaagaatgaaggatttgttgaagttcttgctgcacagcagagtccagagaatcccaattggtttcagggtacagctgatgctgtgaggcagtatttgtggctgtttgaggagcacaatgttctggaatttctcgttcttgctggtgatcatttgtaccgaatggactatgagagatttattcaggcacacagagaaactgatgcggatatcacagtagctgctctgccaatggatgaaaaactggctactgcttttggtctgatgaagatcgatgaagagggacgcataattgaattttctgagaaaccaaaaggagagcagttgaaagctatgaaggttgatactactattttgggtcttgatgatgcgagaggcaaagagatgcctttcatagctagcatgggtatttacgttatcagcaaggatgtgatgctgagtcttcttagagataaatttcctggagcaaatgattttgggagcgaagttattcctggtgcaacttccattgggatgagagtgcaagcatatttatatgatggctactgggaagacattggaacaattgaggctttctacaatgcgaatctggggatcaccaaaaagccaattccggatttcagcttctatgaccgttctgatccaatctatacacagcctagatatctacctccttctaagatgcttgatgctgatgtcactgatagtgtaattggtgaattctgtgtgattaagaattgcaaaattcaccattctgttgttgggcttcgatcttgcatatcagaaggtgcaattatcgaagatactttacttatgggagcagattattatgagacggatgcggacaggaggtttttggctgcaaagggtagtgttccaattggtattggcaagaattctcacatcaagagagcaataattgacaaaaatgctcgaattgggaataatgtgaagatcgtcaacagagacagtgtgcaagaagcagcaagggaaacagatggatacttcatcaagagcgggattgacacaataatcaaggatgccttgattcccagtggaaccataatctaaactgtcgtcttctcttctcagtttcatcccaagctacgggcaccttcccctctacgctcgagaatgtcgtaatatcgagtctgcttccactttacctttggccatctttttgctataagctgtatatttccgggcggtgtaatgttaattatgagaggaaaataggacctggaaaagggacatgctgtaaaggtctattatgcagaaataaaatctttcattctattctaatgtctgcatctaccctctttatcaaaaaaaaaaaaaaaaaaa

SEQ ID NO: 14743 - protein, 515 aa, Citrus unshiu
MASIGSLKVPSSPSTAATSSNSNNHSRRSVVKRLAFSSSQLSGDKIFSKAVTGDRRRERRRSLCLLQAVSDSKNSPLDPEASRRVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKLATAFGLMKIDEEGRIIEFSEKPKGEQLKAMKVDTTILGLDDARGKEMPFIASMGIYVISKDVMLSLLRDKFPGANDFGSEVIPGATSIGMRVQAYLYDGYWEDIGTIEAFYNANLGITKKPIPDFSFYDRSDPIYTQPRYLPPSKMLDADVTDSVIGEFCVIKNCKIHHSVVGLRSCISEGAIIEDTLLMGADYYETDADRRFLAAKGSVPIGIGKNSHIKRAIIDKNARIGNNVKIVNRDSVQEAARETDGYFIKSGIDTIIKDALIPSGTII

SEQ ID NO: 14744 - DNA, 1563 bp, Lycopersicon hirsutum
  CDS (1)..(1563)
atgaaatcgacggttcatttggggagagtgagcactggtggctttaacaatggagagaaggagatttttggggagaagatgagagggagtttgaacaacaatctcaggattaatcagttgtcgaaaagtttgaaacttgagaagaaggagaagaagattaaacctggggttgcttactctgtgatcactactgaaaatgacacagagactgtgttcgtagatatgccacgtcttgagagacgccgggcaaatcccaaggatgtggctgcagtcatattaggaggaggcgaagggaccaagttattcccacttacaagtagaactgcaacccctgctgttccggttggaggatgctacaggctcatagacatcccgatgagcaactgtatcaacagtgctattaacaagatttttgtgctgacacagtacaattctgctgccctgaatcgtcacattgctcgaacgtattttggcaatggtgtgagctttggagatggatttgtcgaggtactagctgcaactcagacacctggggaagcaggaaaaaaatggtttcaaggaacagcagatgctgtcagaaaatttatatgggtttttgaggacgctaagaacaagaatattgaaaatatccttgtattatctggggatcatctttataggatggattatatggagttggtgcagaaccatattgacagaaatgctgatattactctttcatgtgcaccagctgaggacagccgagcatcagattttgggctggtcaagattgacagcagaggcagagttgtccagtttgctgaaaaaccaaaaggttttgagcttaaagcaatgcaagtagatactactcttgttggattatctccacaagatgcgaagaaatccccttatattgcttcaatgggagtttatgttttcaagacagatgtattgctgaagctcttgaaatggagctaccccacttctaatgattttggctctgaaattataccagcagctattgatgattacaatgtccaagcatacattttcaaagactattgggaggacattggaacaattaaatctttctataatgctagcttggcgctcacacaagagtttccagagttccaattttatgatccaaaaacacctttttacacatctcctaggttccttccaccaaccaagatagacaattgcaagattaaggatgccataatttctcatggatgtttcttgcgagattgctctgtggaacactccatagtgggtgaaagatcacgcttagactgtggtgttgaactgaaggatactttcatgatgggagcagactactaccaaacagaatctgagattgcctccctgttagcagaggggaaagtaccgattgggattggggaaaatacaaaaataaggaaatgtatcattgacaagaacgcaaagataggaaaaaatgtttcaatcattaataaagatggtgttcaagaggcagaccgaccagaggaaggattctacatacgatcagggataaccattatatcagagaaagccacaattagagatggaacagttatatga

SEQ ID NO: 14745 - protein, 520 aa, Lycopersicon hirsutum
MKSTVHLGRVSTGGFNNGEKEIFGEKMRGSLNNNLRINQLSKSLKLEKKEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 14746 - DNA, 1140 bp, Leishmania major
  CDS (1)..(1140)
atgtcttcatccgatggccagggaatgcgggcagtgattctggtcggcggctttggtactcggctccgtccgttgacgctgacgacgccgaagcccctcgtcccattttgcaacaagccgatgatcattcaccaaatcgaggcgttgaaggcggttggcgtgacggaggtgattctggctgttgcgtaccggccggaggcgatgaaagagcagatggacgagtggtcacggaagcttggtgttctcttcgtgttctccgtcgaggaggagccgctcggcacggccggcccgcttgccctcgcccgcgatatcctgatgcaggatgacaagccgttttttgtgctcaactccgatgtcacctgcccgtttccgatgcaggagctgctggacttccacaaggcgcatggcggcgagggcaccatcatggtctcgcaggtgacgcagtgggagaagtacggtgtcgtcgtctactcgccgcagaattaccagatcgagcggtttgtggagaagccgagcagctttcttggggaccgaatcaacgccggcatttatatcttcaacaagagcatcctggaccgtattcctccctgccgaacgtccatcgagaaggagatcttcccttcgatggctgcagaggggcagctctacgcattcaacctggagggcttctggatggatatcggccagcccaaggactacatccttggcatgaccaagtacattccgttcttggttcatagtaaccgcgaaacggagaagttgcacacggaggccacgaaacaccagcgtggtggccgctttactgtgatcggcgcctctctgattgacccctccgcaaagatcggcgatggtgccgtgattggcccctatgcgtcgattggcgccaactgcgttattggcgagtcgtgccgcatcgataatgctgccatcttggagaactccaaggtcggcaagggttcaatggtgtctcgcagcattgtgggctggaacaaccgcatcggcagctggtgccacatcaaggacatatctgtgctcggcgatgacgtggaggtcgaggatggcgtggttctcattggcaccaaggtgctccccaacaaggatgtcggcgagcaccacttcgagcctggtatcatcatgtag

SEQ ID NO: 14747 - protein, 379 aa, Leishmania major
MSSSDGQGMRAVILVGGFGTRLRPLTLTTPKPLVPFCNKPMIIHQIEALKAVGVTEVILAVAYRPEAMKEQMDEWSRKLGVLFVFSVEEEPLGTAGPLALARDILMQDDKPFFVLNSDVTCPFPMQELLDFHKAHGGEGTIMVSQVTQWEKYGVVVYSPQNYQIERFVEKPSSFLGDRINAGIYIFNKSILDRIPPCRTSIEKEIFPSMAAEGQLYAFNLEGFWMDIGQPKDYILGMTKYIPFLVHSNRETEKLHTEATKHQRGGRFTVIGASLIDPSAKIGDGAVIGPYASIGANCVIGESCRIDNAAILENSKVGKGSMVSRSIVGWNNRIGSWCHIKDISVLGDDVEVEDGVVLIGTKVLPNKDVGEHHFEPGIIM

SEQ ID NO: 14748 - DNA, 1083 bp, Homo sapiens
  CDS (1)..(1083)
atgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcggcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtga

SEQ ID NO: 14749 - protein, 360 aa, Homo sapiens
MKALILVGGYGTRLRPLTLSTPKPLVDFCNKPILLHQVEALAAAGVDHVILAVSYMSQVLEKEMKAQEQRLGIRISMSHEEEPLGTAGPLALARDLLSETADPFFVLNSDVICDFPFQAMVQFHRHHGQEGSILVTKVEEPSKYGVVVCEADTGRIHRFVEKPQVFVSNKINAGMYILSPAVLRRIQLQPTSIEKEVFPIMAKEGQLYAMELQGFWMDIGQPKDFLTGMCLFLQSLRQKQPERLCSGPGIVGNVLVDPSARIGQNCSIGPNVSLGPGVVVEDGVCIRRCTVLRDARIRSHSWLESCIVGWRCRVGQWVRMENVTVLGEDVIVNDELYLNGASVLPHKSIGESVPEPRIIM

SEQ ID NO: 14750 - DNA, 1086 bp, Candida glabrata
  CDS (1)..(1086)
atgaagggtttaattctagttggtggttacggtaccagattgagacctttgactttgactgtcccaaagccattggttgagttcggtaacagaccaatgatcttgcaccagattgaagctttggccaacgctggtgtcaccgatatcgtcttggctgtcaactgcagaccagaagtcatggttgagactttgcaaaagtacgagaaggagtatggtgtcagcatcactttctccgtcgaaaccgagccattgggtaccgctggtccattgaagttggccgagaaggttttaaagaaggacaactctccattcttcgttctaaactccgatgtcatctgtgaatacccattcaaggaattggctgacttccacaaggcccacggtggtaagggtaccattgtcgctaccaaggtcgacgaaccatccaagtacggtgtcatcgtccatgacattgccactccaaacttgatcgacagattcgtcgagaagccaaaggaattcgttggtaacagaatcaacgctggtttgtacatcttgaacccagaagtcattgacttgatcgaaatgaagccaacctctatcgaaaccgagactttcccaatccttgttgaacaaaagtccttgtactccttcgacttggaaggtttctggatggatgtcggtcaaccaaaggatttcttgtccggtaccgttctatacttgaactctgtctccaagaagaacccagaaaagttgaccaagggtgacaacattgtcggtaacgttatggttgacccatctgccaagattgctgcctctgctaaggtcggtccagatgtagttatcggtccaaacgtcactatcggtgaaggtgtcagaatcaccagatccgttgtcctttccgactccagtattcaagaccactccctagtaaagtccaccattgtcggctggaagtctactgttggtaagtggtgtcgtttggaaggtgtcactgttttgggtgacaacgttgttgtcaaggatgaagtttacgttaacggtggtaaggtcttgcctcacaagtccatctctgctaacgttccaagtgaagccattattatgtaa

SEQ ID NO: 14751 - protein, 361 aa, Candida glabrata
MKGLILVGGYGTRLRPLTLTVPKPLVEFGNRPMILHQIEALANAGVTDIVLAVNCRPEVMVETLQKYEKEYGVSITFSVETEPLGTAGPLKLAEKVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIETETFPILVEQKSLYSFDLEGFWMDVGQPKDFLSGTVLYLNSVSKKNPEKLTKGDNIVGNVMVDPSAKIAASAKVGPDVVIGPNVTIGEGVRITRSVVLSDSSIQDHSLVKSTIVGWKSTVGKWCRLEGVTVLGDNVVVKDEVYVNGGKVLPHKSISANVPSEAIIM

SEQ ID NO: 14752 - DNA, 1218 bp, Vibrio vulnificus
  CDS (1)..(1218)
atggctggtgttttgggaatgattcttgctggcggtgaaggttcaaggctacgtcctttgacggaatctcgtagtaaacctgcggtgcctttcggcggtagttaccgcttaatcgacttcgcgttaaacaactttgtgaatgctgacttgatgcgtatttacgtgttaacgcagtttaaatctcaatctctgttccatcatatgaaaaaagggtggaacatcaacggtattactgatcgttttattgaccccattcccgcacagatgcgcactggcaaacgttggtatgaaggtactgccgacgctatctaccaaaacctacgttttatggagctgtctgaaccagaacaagtgtgtatctttggttcggatcatatttacaagatggacattaagcagatgcttagtttccacaaagagaaactggccgcattaaccgtttctgctttaagaatgccattagcagaagcgtcgcagtttggtgtgattgaagtcgatgcagaagggcgtatggtgggctttgaagagaaaccgagcgcgcctaaatcgattccgggtgacccagactttgccttggtttcaatgggtaactatatctttgaagcggatgtgctgttcgctgagttgattgaagatgcggacaacgaaaactcatcccacgattttgggaaagatattattcctaagatgttcccacgtggtgatgtattcgtgtacgactttagccaaaaccgcatttccggagaaaaagcggaagtgtattggcgtgatgtcggtaccattgatgcttactggcaagcgcacatggatctgttgaaaacagacgcgccattctctctatacaaccgaaaatggccgctgcacacctatcagccaccgttgcctccagcgacgtttaccgattcagataacgggcgtgtacagattattgatagtctagtttgcaatggcagctacgtacgtggttcacgtatcgaaaagtctgtgctaggtttccgtagtaatatcgcatcagcctgcgatattagcgagtctattttattgggtgatgtcaaagttggggaaggctgcgtgttacgccgtgttattgttgacaaggacgtagatatcgcgccaggaacgcaaataggtgtgaatttgcaggaagataagaaaatcttccatgtctctgatgacggtatcgttgttattccaaaaggagcaagagttggctactaa

SEQ ID NO: 14753 - protein, 405 aa, Vibrio vulnificus
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKLAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKIFHVSDDGIVVIPKGARVGY

SEQ ID NO: 14754 - DNA, 1215 bp, Vibrio parahaemolyticus
  CDS (1)..(1215)
atgcaagacgcactcgctgtaattttagcaggcgggatgggctcacgacttagcccactcactgatgatcgagccaaacctgcggtaccatttggcggcaaatacagaatcatcgattttacgctaactaattgtcttaattcaggtttacgtaaaattctagtgcttactcaatacaaatctcactcactacaaaagcaccttcgtgacggttggtcgatttttaatcccgaacttggtgagtacattacggcagttccgcctcaaatgcgcaaaggtggtgcatggtatgagggtaccgccgacgccatctaccacaacttgtggttactatcgcgaaacgacgcaaaatacgttgttgtgttatctggtgaccatatttatcgtatggattacgcagcgatgcttgaggagcataaagagaaaggggcaaagctaaccgtcgcttgtatggatgttccagtaaaggacgcctctgctttcggagtaatgggaatcgctgaaaacggactggttaagtcttttgtcgagaagcctgaaaacccacctactcttccagacgataatgccaagagccttgcatcaatggggatctacatctttgatatggatgtgctcaaagaagcgctgaccgaagatgcgaaactggaaacgtctagccatgactttggcaacgacattattccaaaattgatcgacaccgaatcggtttacgcttacaagttttgtggcagcaaaggtcgtgtcgataaagattgttactggcgtgatgtcgggacaattgactccttctatgaagcaaatatggatttattggaaccagtacctccgatgaacctttatcaatctaactgggctatccgcacttacgaacctcaatttccaccagcgagaaccgtctcttctgcaacaggaaacgaaggtattttcatcaactcgatcatagctaccggtgttatcaactcaggcggctcagtccagcactcgatcatttcatcaaatgtgcgcattcaagacagcgcgaccgttgtggattccatcatttttgatgatgtagaagtcggtgaaggcagccaactggtgaattgcatcgtcgataaacacgttcgcataccaccgaacacacaaatcggcatcaataaggttgaagacgccaaacgcttcaaaatctcagaaaaaggcattgttgttataccggagagctaccagttctga

SEQ ID NO: 14755 - protein, 404 aa, Vibrio parahaemolyticus
MQDALAVILAGGMGSRLSPLTDDRAKPAVPFGGKYRIIDFTLTNCLNSGLRKILVLTQYKSHSLQKHLRDGWSIFNPELGEYITAVPPQMRKGGAWYEGTADAIYHNLWLLSRNDAKYVVVLSGDHIYRMDYAAMLEEHKEKGAKLTVACMDVPVKDASAFGVMGIAENGLVKSFVEKPENPPTLPDDNAKSLASMGIYIFDMDVLKEALTEDAKLETSSHDFGNDIIPKLIDTESVYAYKFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPNTQIGINKVEDAKRFKISEKGIVVIPESYQF

SEQ ID NO: 14756 - DNA, 2025 bp, Hordeum vulgare
  CDS (189)..(1760)
acgaccacctccgaactcaacgcctccacggaccatctctctcctctcccctcccctcaccaccaccaccaccaccaccccttctccctccctgcatttgattcgttcatattcatccgtcgcttgcccggtcgccaccccgtcgatccctcaccccgccgtccccggcagttgcaggtggactgctaatgtcatcgatgcagttcagcagcgtgctgcccctggagggcaaggcgtgcgtttccccagtcaggagagagggatcggcctgcgagcgcctcaagatcggggacagcagcagcatcaggcacgagagagcgtccaggaggatgtgcaacggcggcgccaggggccccgccgccaccggtgcgcagtgcgtgctcacctccgacgccagcccggccgacacccttgttctccggacgtccttccggaggaattacgccgatccgaacgaggtcgcggccgtcatactcggcggcggcaccgggactcagctcttcccgctcacaagcacaagggccacacctgctgttcctattggaggatgttacaggctcatcgatattcccatgagcaactgcttcaacagtggcatcaacaagatattcgtcatgacccagttcaactcggcatctctcaatcgccacattcaccgcacctacctcggcgggggaatcaatttcactgatggatctgttgaggtattggccgcgacacaaatgcctggggaggctgctggatggttccgcggaacagcggatgccgtcagaaaatttatctgggtgcttgaggactactataagcataaatccatagagcacattttgatcttgtcgggcgatcagctttatcgcatggattacatggagcttgtgcagaaacatgtggatgacaatgctgacattactttatcatgtgcccctgttggagagagccgggcatctgagtacgggctagtgaagttcgacagttcaggccgtgtgatccagttttctgagaagccaaagggcgacgatctggaagcgatgaaagtggataccagttttctcaatttcgccatagacgaccctgctaaatatccatacattgcttcgatgggagtttatgtcttcaagagagatgttctgctgaaccttctaaagtcaagatacgcagaactacatgactttgggtctgaaatcctcccgagagctctgcatgatcacaatgtacaggcatatgtcttcactgactactgggaggacattggaacaatcagatccttcttcgatgcgaacatggccctctgcgaacagcctccaaagtttgaattttatgatccaaaaacccccttcttcacttcgcctcggtacttaccgccaacaaagtcagacaagtgcaggatcaaagaagcgatcatttcgcacggctgcttcttgcgtgaatgcaaaatcgagcactccatcatcggcgttcgttcacgcctaaactccggaagcgagctcaagaacgcgatgatgatgggcgcggactcgtacgagaccgaggacgagatctcgaggctgatgtctgagggcaaggttcccatcggcgtcggggagaacacaaagatcagcaactgcatcatcgacatgaacgcgaggataggaagggacgtggtcatctcaaacaaggagggggtgcaagaagccgacaggccggaggaagggtactacatcaggtccgggatcgtggtgatccagaagaacgcgaccatcaaggacggcaccgtcgtgtagggcgtgccgggtcggcgcgacggggttctgcgacaacctgtgcgctgcgtcggtcgtcatcatcttctcaaactccgggactgaagaagtgatccggggacgggagacgtttgaagcttgaatgactgagactgaaagtgaaggcgcagcagaggcaggcagcattagtagtaagtagtaagtaagtagcagtggaacaaagtaatagtcgttcgtttttcccctgtaataaataagaggctgtgtgttgaggtaaaaaaaaaaa

SEQ ID NO: 14757 - protein, 523 aa, Hordeum vulgare
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 14758 - DNA, 1164 bp, Bacillus stearothermophilus
  CDS (1)..(1164)
atgaaaaagaaatgcatcgccatgttattggccggcgggcaaggaagtcggcttcgctcgctgacgacaaacatcgctaaaccggccgtgccattcggcgggaagtaccggatcattgattttacattaagcaattgcacgaattccggcattgatacggtcggagtgctgactcaatatcagccactcctccttcactcgtacatcggcattggaagcgcgtgggatttggaccggcgaaatggtggtgtcaccgttcttccgccgtattccgtctcttccggtgtgaaatggtatgaaggcaccgcaaacgcggtttatcaaaatatcaattacatcgaacaatataatccggattacgtgctcgtattgtctggcgaccatatttacaagatggattatcagcacatgctcgactatcatatcgccaaacaggcggatgtgacgatttcggtcattgaggtgccatgggaagaagcgagccggtttgggattatgaatacgaacgaagagatggaaattgttgagtttgccgaaaaaccggctgaaccgaaaagcaatttggcatcgatgggcatttatattttcaactggccgctattgaagcaatatttgcaaatcgacaacgcgaatccgcattcttcacacgattttggcaaggatgtcatcccgatgttgcttcgggagaaaaagcggccgtttgcgtatccgtttgaaggatactggaaagatgtcggtacggtgaaaagtttatgggaagcgaacatggacttgcttgatgagaacaatgagctcgacttgttcgaccgttcatggcgcatttattccgtcaatccgaatcagccgccgcaatatatttctccggaagcggaagtgagtgactcactcgtcaatgaaggatgcgtcgtcgaaggaacggtggagcgttcagtactgttccaaggcgttcgtatcggtaaaggggcggtcgtgaaagagtcggtcattatgcccggagcggcagtcagcgaaggagcgtatgtcgaacgggcgattgttactcctgattcgatcatcccgccgcattcgtcggtttgcccggaagatgctgacgatgtcgtgttggtgaccgccgaatggcttaagcaatcgaatgaggaaacagctaggaaggatgaagcataa

SEQ ID NO: 14759 - protein, 387 aa, Bacillus stearothermophilus
MKKKCIAMLLAGGQGSRLRSLTTNIAKPAVPFGGKYRIIDFTLSNCTNSGIDTVGVLTQYQPLLLHSYIGIGSAWDLDRRNGGVTVLPPYSVSSGVKWYEGTANAVYQNINYIEQYNPDYVLVLSGDHIYKMDYQHMLDYHIAKQADVTISVIEVPWEEASRFGIMNTNEEMEIVEFAEKPAEPKSNLASMGIYIFNWPLLKQYLQIDNANPHSSHDFGKDVIPMLLREKKRPFAYPFEGYWKDVGTVKSLWEANMDLLDENNELDLFDRSWRIYSVNPNQPPQYISPEAEVSDSLVNEGCVVEGTVERSVLFQGVRIGKGAVVKESVIMPGAAVSEGAYVERAIVTPDSIIPPHSSVCPEDADDVVLVTAEWLKQSNEETARKDEA

SEQ ID NO: 14760 - DNA, 2040 bp, Clostridium cellulolyticum
  CDS (510)..(1790)
aggagaatcatgtggtggattatctgcctttccctgaactggttgaactggctgaaaatatggtatttgattatgagaaggtaatacctgttataaaaaagaaactggatggctacaacctaaataattataaaaccttcgttttagggtgtacccatttccctatatatataaatgctttcaaggaggtacttcctccgtttattgacataatagatggaagtgaaggaacaatcagatatctcaaactgttgcttgaggaaaggcatctgatcagtacaaatattaatggtggaaatatagttttttttgattcaggcaggctaatacaaaataaagataggttaaatacatttaagtggttaatttcccactgctaacaattttttttgtaataaaatagtaatttctatattacttataaagggaattgctaattaaatgtagaaattatctacagtacattgtacgtaaagtaacgaaaatcagttaaaccgggagttggtgcaatgattaggaaagaaatgatagcaatgttgctggccggagggcagggaagcaggctgggcgtccttactaaaaatgtagctaagccagcggttttatatgggggaaagtatagaataatcgatttttcccttagtaactgtacaaattctggtattgatacagtaggtgttctgacccaatatcaacctttaaagctcaatgcccacatcggtattggtaagccgtgggatatggacaggatagagggaggagtaaccatactttcgccgtatctcaaggctgaaatgggagaatggtttaaagggactgcaaatgcggtttaccagaatatacagtacattgacaagtattctcctcattacgtaattattttgtccggtgatcacatctataaaatggactattctaaaatgcttgatttccataaggagaatcatgccgatgcaacaatttcagttataaatgtgccatatgaagaggcaagcaggtacggtattatgaattgtcatgaaaatggcaaaatatatgaatttgaagaaaaacccaaaaatccaaaaagtacacttgcatctatgggagtatacatttttacgtggtcaactctgagagagtatctgataaaggataatgaatgctccgattcggtaaatgacttcggaaaaaatataatccccgcaatgcttggagacggcaaaagtatgtgggcatatcagtattccggctattggagagatgtgggaacgattcaagccttttgggagtcaagtatggacttggtaagcagagtacctcaatttaatctattcgatcccgaatggagaatatatacccctaatccggtcaaaccagctcactatatagcaagctctgcgtgtgtaaaaaaatcaataatagccgaaggctgctcggttcatggaaccgttatcaattctattttatttcctggtgcatatatagaagaaggtgcagttattcaggattctattattatgtcaaattcaagggtatgcaaaaacgcatatataaacaggtctattatcagcgaacaggctataataggtgaaaaagcaaggcttggagaagggcccgacgttccgaacgaatacaaaccgggaatttatgactcgggaattacagtcgtgggagaaaagtcaagcatacccgcagatcctgtaataggtaagaacgtcatgatagatataggagcttcggcagttgattttacatctttaaatgttcaatccggcaaaagcgtattcaaaggtggtgtagctgaatgaaaaacgtaatgggaataataatgtccggtggacgcaacacaaagctcaaggagctttcaaccatgcgatccagtccggcagtgcctgtaggaggtaaatacagggcgatagattttatcctttcaaacatggtaaactctggaattaccaatataggtgtaatagcacagtacagtttcaggtcgttgatggatcaccttggttcaggcaaggaatgggacctagacagaaaaacagatggcccgacgtt

SEQ ID NO: 14761 - protein, 426 aa, Clostridium cellulolyticum
MIRKEMIAMLLAGGQGSRLGVLTKNVAKPAVLYGGKYRIIDFSLSNCTNSGIDTVGVLTQYQPLKLNAHIGIGKPWDMDRIEGGVTILSPYLKAEMGEWFKGTANAVYQNIQYIDKYSPHYVIILSGDHIYKMDYSKMLDFHKENHADATISVINVPYEEASRYGIMNCHENGKIYEFEEKPKNPKSTLASMGVYIFTWSTLREYLIKDNECSDSVNDFGKNIIPAMLGDGKSMWAYQYSGYWRDVGTIQAFWESSMDLVSRVPQFNLFDPEWRIYTPNPVKPAHYIASSACVKKSIIAEGCSVHGTVINSILFPGAYIEEGAVIQDSIIMSNSRVCKNAYINRSIISEQAIIGEKARLGEGPDVPNEYKPGIYDSGITVVGEKSSIPADPVIGKNVMIDIGASAVDFTSLNVQSGKSVFKGGVAE

SEQ ID NO: 14762 - DNA, 1182 bp, Clostridium perfringens
  CDS (1)..(1182)
atggaggggagacttgtgtcaaaaaaagagatagttgcaatgatattggctgggggtcaaggatctagattaggtgtattaactaaaaatttagctaagccagcagttccttttggaggaaaatatagaataatagattttcctttaagtaactgttctaattcaggtatatatactgttggtgttttaacacagtataagcctttaaaattaaatgaacatattggtattggtgatacatgggatttagatagaagagatggaggggtaagtatattgcctccttatcaaaaagaaaaaggcggagattggtataaaggaactgccaatgcaatttatcaaaatattgaattcatagaaagatatgacccagaatatgttcttattttatcaggagatcatatttataaaatggattatgataaaatgttagaaatgcataaacaaaaagaagctgatgctactatagcagtaataaatgttcctatgcatgaggctagtagatttggaataatgaatacaaatgaagatctatcaatatatgagtttgaagaaaagccagaacatccaaagagtacaaatgcttcaatgggaatatatatatttaattggaaaattttaaagaaatttttagaagaggatgagttagatcaaagttcaagcaatgattttggaaaaaacataattcctaaaatgttgaattcaggaaaaaaacttatagcatatccatttaatggttattggaaagatgttggaactatagagagtttatgggaagctaatatggatttactaaagtatgaagatgaattaagtctttatgatagtgaatggaaaatttattctgcaaatccagttagacctgctcaatttattggaaaagatgcagaaataaagtcgtcattaacggttgaaggatgtatagtacatggtaaggtggaaaattcagttttatttcaaggtgtatatgtgggaaaaggagctatagttaaagatgctgtaataatgccaaatacaaaaattgaagataatgttttaatagaaaaagctattataggtagtgaagctattgtttgtaaaggatgtaaaataggagatggaaataaaatttctgtaatagcatctaaagaagttgttataggtagtaaagaagtaatagaagaatgtgctatggtaaagtag

SEQ ID NO: 14763 - protein, 393 aa, Clostridium perfringens
MEGRLVSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDQSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEVIEECAMVK

SEQ ID NO: 14764 - DNA, 1218 bp, Corynebacterium glutamicum
  CDS (1)..(1218)
atgaagggtagaccaaatgttctagcaatcgttctcgcaggtggcgagggcaaacgactttttccgttgacggaggaccgagctaagcctgcggtcccattcggcggaacttacagattgatcgactttgttttgtcgaacctggtgaactccggattcctcaagatcgcggtactgactcagtacaagtcgcattcattggataggcatatttcattgtcgtggaacgtgtctggtccaacggggcagtacattgcttctgttcctgcgcagcagcgcctgggcaagcgatggttcactggttccgcggatgcaattttgcagtctctgaacttgatctctgatgagaaaccggattatgtcatcgttttcggcgcggaccacgtgtatcgcatggacccaagccagatgctagatgagcacattgcatctggtcgcgcggtgtctgtggcaggtattcgcgttccacgtgaggaagcaactgcgtttggttgcatccagtccgatgtcgacggcaacataaccgagttcttggaaaagccagctgaccctccgggaacccctgatgatcctgacatgacttacgcgtcgatgggtaactacattttcaccactgaagccctgatccaggcgctgaaagatgatgaaaataacgagaacagtgatcatgacatgggcggagacatcattccgtacttcgtctctcgcaatgatgcgcatgtttatgatttctccggaaacattgttcctggcgcaactgagcgtgacaagggctactggcgcgacgtcggtaccattgatgcgttctacgagtgccacatggacctgatttccgtgcacccaatcttcaatctgtataactctgagtggccaatccacacgacctctgaaggtaacttgcctccggctaagttcgttcggggcggtatcgcgcagtcgtcgatggtgtcttcaggttccatcatttctgctgggactgttcgcaactccgtgctgtccaacaacgttgtcgtcgaagagggcgcaacggtggaaggtgcagtgctgatgccaggcgtgcgcatcggtaagggtgctgttgtccgccatgcgattctggacaagaacgtggttgtccgcgacggagagctcatcggtgtcgaccaagtgcgcgatgcgcagcgcttcaaggtgagcgccggcggcgtcgtggttgtcggtaagaaccaggtagtctaa

SEQ ID NO: 14765 - protein, 405 aa, Corynebacterium glutamicum
MKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 14766 - DNA, 1242 bp, Deinococcus radiodurans
  CDS (1)..(1242)
atgaaaccacgtgttctcggcatgattctcgcgggtggtcagggctcgcgcctggccccgctgacgcagaaacggtccaagcccgccgtgccgtttggcagcaaataccgcatcatcgacttcgccatcaacaacttcatcaactcgggcatgttctcggtctacgtgctgacccagtacaaggcgcagagcctcaccgagcacattcagcgcggctggcgcttcggcaccttcctgagcgactacttcatcacgctcgtgccggcgcagatgtatcgcttcgaggaactcggcgacgcctggtaccggggcaccgccgacgccgtgtaccagaacatgcacctcatcgacaacttcgaggccgactacgtggcgattttttccggtgaccacatctacaagatgaacgtggaacacatgctggaaaaacacatcgagacgcgggccgacgtgaccatcgccgcttacccaatgccgcagtcgcaggcgcaccagttcggcgtgatgcaggtggacgagcgctggcgcgtgaccgagttccacgagaaggtgcccgacccgcccaccatccccggtcaagccgacctgagcctgacgagcatgggcaattacatcttcagccgccgggcgctcgaagaactgctcgaagccagcatcagcgggcaggaaaccggctacgacttcggccacaacgtgattccgcgtgcgctctccgacggctaccacgtccaggcctatgacttccacaaaaatcccatccccggtcaggagcgtcccaacacctactggcgcgacgtgggcacgctcgacgcctacttcgaggcgaacatggacctcgtgtcggtcaaccccgagttcgacatctacaaccccgagtggccgctgcgcaccagcagcgaattctcgccgcccgccaagttcgtgcacgagtccgagggccgcaaggggcaggcgttcaactccatcatggccgggggcgccatcatcagcggcggcaccgtgcgcgacagcgtgctcgggcgcaacgtccgcacccactcctactcgctggtcgaaagctgcgttctgttcgacgacgtgcaggtgggccggcactcgcacctgcgccgcgtcatcgtagacaaggacgtggtgattccgcccggcaccaccatcggcctgaaccgcgagcacgacgagcagcgcggcttcaccgtcaccgagcacggcgtggtcgtggtgcccaaggggtacgtgttctga

SEQ ID NO: 14767 - protein, 413 aa, Deinococcus radiodurans
MKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 14768 - DNA, 1155 bp, Fusobacterium nucleatum
  CDS (1)..(1155)
atggtaatgaagaaaaaaagaattattgctatgatattagcaggaggacaagggactcgtctaaaagaattaacagaggacttagcaaaaccagctgtggcttttgggggaaagtaccgaataattgattttactttaacaaattgctctaattctggaatagatactgttggtgtcttaactcaatatgaaccacgtatattgaataatcatattggcagaggttctccttgggatttagatagaatggatggtggagttacagtattacaacctcatacaagaaaaaatgatgaaaaaggttggtataagggaacagctaatgccatctatcaaaatataaaatttatagaagaatatgatcctgaatatgttttaattttatctggagatcatatctataagatgaattatgataagatgttacaatttcatattcaaaaagatgcagatgctacaataggagttttcaaagttcctttagtagatgcaccaagttttggaattatgaatacaaaagacgatatgtctatatatgaatttgaagaaaagccaaaagaaccaaaaagtgatttagcttcaatgggtatatatatttttaattggaaattattaaaaaaatatttagatgaagacgaaaaagatcctaattcaagtaatgattttggaaaaaatataattccaaatatgttaaatgatggaaaaaagatgtttgcatatccatttaaaggatattggagagatgttggaactatccaaagtttctgggatgcacatatggacttattatcagaagataatgagcttgatttatttgataaatcttggagagtaaatacaagacaaggtatatacactccatcttattttactaaggaatcaaaaattaaaaatacactgatagataagggatgtattgtagaaggagaaatagagcattctgttatattttctggtgttaaaataggtaaaaattcgaaaattatagactctataattatggcagatactgaaattggagataatgtaactattcaaaaagccataatagcaaatgatgtaaaaatagtagataatatagttattggtgatggtaaaaaaattgctgttgtaggggagaaaaaaattatagatagtcaatcattggtaaaataa

SEQ ID NO: 14769 - protein, 384 aa, Fusobacterium nucleatum
MVMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDEKGWYKGTANAIYQNIKFIEEYDPEYVLILSGDHIYKMNYDKMLQFHIQKDADATIGVFKVPLVDAPSFGIMNTKDDMSIYEFEEKPKEPKSDLASMGIYIFNWKLLKKYLDEDEKDPNSSNDFGKNIIPNMLNDGKKMFAYPFKGYWRDVGTIQSFWDAHMDLLSEDNELDLFDKSWRVNTRQGIYTPSYFTKESKIKNTLIDKGCIVEGEIEHSVIFSGVKIGKNSKIIDSIIMADTEIGDNVTIQKAIIANDVKIVDNIVIGDGKKIAVVGEKKIIDSQSLVK

SEQ ID NO: 14770 - DNA, 1314 bp, Haemophilus influenzae
  CDS (1)..(1314)
atggagatccttatgaaatctggcgaccttaacaaatatgatttagttaaaaacgctttggtacttgttctcgcaggtggacgtggttcacgtttacacgaattgacagataaacgtgcaaaaccagcgctttattttggtggtaatcgtcgcattattgattttgcactttctaattgtattaattcagatttaaaccgaattggggtcgtgactcaatatgcggcacactccttgcttcttcatttgcaaacaggctggtctttcttaccgcaagagcgtggcgaatttgtcgatatgttgccagctcgtcagcaaattgacgattctacttggtatcgtggcacggcggatgcggtatatcaaaatatggctattattaaaaatcactatcgcccgaaatatattttgatcttagcgggcgaccatatttacaaacaagattacagcgtgatgttaatggatcacgtcaatagtggggcaaaatgtactgttggttgcattgaagtgccccgttctgaagcacacgaatttggcgtaatggctgtaaacgaaaacttgaaagtaaaagctttcgtggaaaaaccaaaagatccgccagcaatggtgggtaaacctgatgtttcgcttgcctcaatggggatttatgtatttgatgcggattatctttataaaatgcttgagcaggaagttaataccccgcaaactagccatgatttcggtaaagatgtattgccaaaatgtttagaagaaggtgcgctttatgctcacccatttagccgttcttgcatgggacgcaacaccgagggcgaaatttactggcgtgatgtagggacacttgatagcttctggcaatctaatatcgacttagtctctgaaaatccacaattagatatttacgaccaaagctggccaattcgtggtaatcctattcaggcttatccatcaaaatttttctacaaacactctaatgtgcaccctgtagataactcacttatcggcggcggttgtgtgattaccgatgcgtcgatcagcaattctgtattattcgaccacattaaaattgatgcattttcaaaagtggatcactgcgtggtgctaccacaagttaaaatcggtaaaaattgcgtgttgaaaaattgtattatcgaccgcgaatgtgaaattcctgatggtatgcaaattggtgtagatatggaagaagataaaaaacgcttccgtattagctctacaggtaaagtgattcttgtgacctcgaaaatgttaaagatacttgagggacacgagattggcgaagaaggacatttagattag

SEQ ID NO: 14771 - protein, 437 aa, Haemophilus influenzae
MEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 14772 - DNA, 1140 bp, Lactobacillus plantarum
  CDS (1)..(1140)
atgcaagatgaaatgttagggattattttagcgggcggtcagggcacccggcttggtaagttgacaaaggatacggctaagcccgccgtgccattcggcggtcgttaccgaattattgattttacactcagcaactgtgctaactcgggtgtgaatactgttggggttatcacgcaatatcaacccctagaactgaatgcacatattggtagcggtgcgagctggggctttgatagcttaaatggtggggtgacggttttacaaccatactcgtctagtgaaggtgagaagttctttcaagggacggcgcacgccatttatcaaaatatcgaatatattgatcaacaagaccccaagtacctgctcgtcttatctggcgatcatatttataagatggattatgacgctatgctgaaatatcatcaggagaagaaggcttcgttgaccgttggggtgatccacgtgactaacgaagaagccaaacgctttggcatgatgaatacggatgcgacggatcgaatcattgagtttgaggaaaaaccggaacatcctaagagtgataaagcctcgatgggtatttatatcttcaattggccgactttgcgggattacttagttaagagttatgctaccgataagtcacttgaagactttggtaaaaatgtcattccatcatacttagccaataatgaatccgtttacgcttatgcttttaagggttactggcgagatgttggaacgattaagagtctgtggcaagccaatatggaattcctatcgccccataaccggttaaatatcggcgatcgttactggcggatttactctaaagcagaggtgctaccaccgatgtttttgacggaaacgagccaggtcaataatgccatggtcgttgatagttgttacgttgcgggcgaaattgatcattcaatcttatcgcaacgcgtgtcagttgggatgggtagtcgcgtggttgacagtatgattatgcccggtgcaacgattggaaaaaatgtggtgattgaccacgcattgattggcgaagatgcagtgattggtgatgatgcccagattattggtacgactgataagattgcagttgttgggtatcacgaaacgatgggggtggaacaaccatga

SEQ ID NO: 14773 - protein, 379 aa, Lactobacillus plantarum
MQDEMLGIILAGGQGTRLGKLTKDTAKPAVPFGGRYRIIDFTLSNCANSGVNTVGVITQYQPLELNAHIGSGASWGFDSLNGGVTVLQPYSSSEGEKFFQGTAHAIYQNIEYIDQQDPKYLLVLSGDHIYKMDYDAMLKYHQEKKASLTVGVIHVTNEEAKRFGMMNTDATDRIIEFEEKPEHPKSDKASMGIYIFNWPTLRDYLVKSYATDKSLEDFGKNVIPSYLANNESVYAYAFKGYWRDVGTIKSLWQANMEFLSPHNRLNIGDRYWRIYSKAEVLPPMFLTETSQVNNAMVVDSCYVAGEIDHSILSQRVSVGMGSRVVDSMIMPGATIGKNVVIDHALIGEDAVIGDDAQIIGTTDKIAVVGYHETMGVEQP

SEQ ID NO: 14774 - DNA, 1320 bp, Pasteurella multocida
  CDS (1)..(1320)
atggaggtcattatgaatagtagcattgtaaaattgcctaataaatatgagttagtgaaagatacgttagtcttaattctggcagggggtcgggggtctcgcctgtatgagttgacggataaacgtgcaaaaccagcactgtatttcggggggaatcgtcggattatcgattttgcattatcaaattgcttaaattcaggtttaaaccgcattggtgtcgtgacacaatatgcggcgcattctttgctacgtcatttacaaaacggttggtcattcttacccgctgagcgcggcgaatttattgatatgttacctgcgcgtcagcagattgatgattcaacgtggtaccgtggtacggccgatgcggtttatcaaaatatggcgatcattcgtgatcattattgccctaaatatatcctgattttggctggggatcatatttacaaacaagattatagccaaatgttattggatcacattcatagtggcgcaaaatgtacagtcggttgtattgaagttgaacgtgaaaaagccacggaatttggtgtgatggccgtgaatgaaaacttaaaagtgaagtcatttgtggaaaaaccaaaagatccaccagcgatggtcggtaaaccaaacacttcactcgcctccatggggatttatgtgtttgatgcggattatctttatgatgtgttagaacgtgaagtcagttcaccttatacctcacatgactttggtaaagatattttaccaaaagcattagaagaaggcgtattgtatgcgcatccatttagccgttcgtgcatgggacgcaatactgaaggggaaatttactggcgtgatgtggggacattagacagtttctggcaatcgaatattgacttagtgtgtgaaaatccacagttagatatttatgaccaaagttggccaattcgtgggaacccagtacaaacctatccatcaaaattcttctataagaaagaaaatgcgcgtccagtagataattccttgatttctggtggttgcgtgattacagatgcatctattagttattccgtcttatttgaccggattaaaattaatgaaggttctcaaattgatcactgcgtcgtgttaccacaagtgacgattggtaaaaactgtaaattaaaacgttgtatcattgatcgccattctgtgattccagatggcatggaaattggcgtagatttagaacttgatcgtcaacgttttagagtcagctctggtggtgttgtattggtgacaccatccatgttaaagaagcttaatggtgaagaagtggcgtcagaagcccatcttgattaa

SEQ ID NO: 14775 - protein, 439 aa, Pasteurella multocida
MEVIMNSSIVKLPNKYELVKDTLVLILAGGRGSRLYELTDKRAKPALYFGGNRRIIDFALSNCLNSGLNRIGVVTQYAAHSLLRHLQNGWSFLPAERGEFIDMLPARQQIDDSTWYRGTADAVYQNMAIIRDHYCPKYILILAGDHIYKQDYSQMLLDHIHSGAKCTVGCIEVEREKATEFGVMAVNENLKVKSFVEKPKDPPAMVGKPNTSLASMGIYVFDADYLYDVLEREVSSPYTSHDFGKDILPKALEEGVLYAHPFSRSCMGRNTEGEIYWRDVGTLDSFWQSNIDLVCENPQLDIYDQSWPIRGNPVQTYPSKFFYKKENARPVDNSLISGGCVITDASISYSVLFDRIKINEGSQIDHCVVLPQVTIGKNCKLKRCIIDRHSVIPDGMEIGVDLELDRQRFRVSSGGVVLVTPSMLKKLNGEEVASEAHLD

SEQ ID NO: 14776 - DNA, 1266 bp, Rhizobium loti
  CDS (1)..(1266)
atggcagacttgaaacggacccagccgctggcgcgcgatgccatggcctatgtactggccggcggccgcggcagccgcctcaaggaactgaccgaccgtcgcgccaagccggcggtctatttcggcggcaagacgcgcatcatcgacttcgcgctctccaatgcgctcaactccggcattcgccgcctcggcgtcgccacgcagtacaaggcgcattcgctgatccgccacctgcagcgcggctggaacttcctgcggcccgaacgaaacgaaagcttcgacatcctgccggccagccagcgcgtctctgaaacgcaatggtatgaaggcactgccgacgccgtctaccagaacatcgacatcatcgaggcctacggccccgaatacatggtcatcctcgccggcgaccacatctacaagatggactacgagatgatgctgcgtcagcatgtcgacgccaatgccgacgtgaccgtcggctgcctcgaagtgccgcgcatggaagcgacaggcttcggcgtcatgcatgtcgatgccaaggacaacatcatcgccttcgtcgaaaagcccgccgatccgccgggcattccgggcaatccggacttcgccctggcgtcgatgggcatctacgtcttcaagaccaagttcctgatggagcagttgcgccgcgacgccgccgagccgggctcaagccgcgatttcggcaaggacatcatcccctacatcgtccagcacggtaaggcgattgcgcaccgtttcaccaaatcctgcgtgcgctcgaccgccgagaacgaagcctactggcgcgatgtcggaacggtcgacgcctattgggaagccaatatcgacctgactgatatcacgcccgagctcgacctctacgaccgcgactggccgatctggacctatgccgagttgaagccgccggcaaaattcgtccatgacgaggatggccggcgcggctcggccgtttcctcgctggtctcaggggattgcatcgtctcgggcgcgacactgaagaagagcctgatcttcactggcgcgcgcatcaattcctattcgacgctggaagaggtggtcatgctgcccgacgttcatgtcggccggaacgcaaagttgaagcgcgtcgtcatcgaccatggtgttaggataccggaggggctggtggtcggcgaggatcccgcgctcgacgcaaagcgcttccgcgtttcggagaagggcatctgcctgatcacacaggacatgatcaacaaactcgggctctag

SEQ ID NO: 14777 - protein, 421 aa, Rhizobium loti
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYEMMLRQHVDANADVTVGCLEVPRMEATGFGVMHVDAKDNIIAFVEKPADPPGIPGNPDFALASMGIYVFKTKFLMEQLRRDAAEPGSSRDFGKDIIPYIVQHGKAIAHRFTKSCVRSTAENEAYWRDVGTVDAYWEANIDLTDITPELDLYDRDWPIWTYAELKPPAKFVHDEDGRRGSAVSSLVSGDCIVSGATLKKSLIFTGARINSYSTLEEVVMLPDVHVGRNAKLKRVVIDHGVRIPEGLVVGEDPALDAKRFRVSEKGICLITQDMINKLGL

SEQ ID NO: 14778 - DNA, 1263 bp, Rhizobium meliloti
  CDS (1)..(1263)
atggtggaaaaacgtacgcaacccctggcccgtgatgccatggcctatgtgctcgccggcggccgcggcagccggctcaaggaactcaccgaccggcgtgcgaaacctgccgtctacttcggcggaaaggcgcggatcatcgatttcgcgctttccaatgcgctgaattccggcatccgtcgaatcggcgtcgccacgcagtacaaggcccactcgctgatccggcatctccagcgcggctggaacttcttccggccggagcgtaacgagagcttcgatatcctgccggcgagccagcgcgtttccgaaacgcagtggtacgagggcaccgccgacgcggtctatcagaacatcgatatcatcgaggaccatggcgtcgaatacatggtgattctcgccggcgatcacgtctacaagatggactacgaactgatgctgcagcagcacgtcgattcgggcgccgacgtaaccgtcggctgcctggaagtgccgcgcatggaggcgacgggcttcggcgtcatgcatgtggacaacgcggaccgcatcatcgccttcgtcgaaaagccggcggatccgccgggcatccccggcaatccggacatggcactcgcgtccatgggcatctacgtgttccacacgaaattcctgatggacatgttgcgtcgggatgccgctgatcccaaatcgagccgcgacttcggcaaggacatcattccctatatcgtcgaacacggcaaagcggtggcccaccgcttcacccattcctgcgtccggtccgacttcgagcgcgaggcctattggcgcgacgtcggcaccatcgacgcctactggcaggccaatatcgatctcacccatatcacgcccgagctcgacatctacgacagcacctggccgatctggaccttctctgaaatcaagccgccggccaaattcgtccatgacgacgagaaccgccgcggctcggccacgtcctcgctcgtctcgggcgattgcatcatctcgggtgccgcgctcaacaggagcctgctcttcaccggggtccgggtgaattcatactccagactcgaaaatgccgtagttctccccgacgtgacgatcgggcggcattcgattctgcgcaatgtcgtcatcgacagccgcgtcgtcattccggagggcctggtcgtcggtgacgatccggagctcgacgcgaaacgcttccgccgcacggagagcggcgtttgcctgatcacgcaaacgatgatcgacaagctgggaatgtag

SEQ ID NO: 14779 - protein, 420 aa, Rhizobium meliloti
MVEKRTQPLARDAMAYVLAGGRGSRLKELTDRRAKPAVYFGGKARIIDFALSNALNSGIRRIGVATQYKAHSLIRHLQRGWNFFRPERNESFDILPASQRVSETQWYEGTADAVYQNIDIIEDHGVEYMVILAGDHVYKMDYELMLQQHVDSGADVTVGCLEVPRMEATGFGVMHVDNADRIIAFVEKPADPPGIPGNPDMALASMGIYVFHTKFLMDMLRRDAADPKSSRDFGKDIIPYIVEHGKAVAHRFTHSCVRSDFEREAYWRDVGTIDAYWQANIDLTHITPELDIYDSTWPIWTFSEIKPPAKFVHDDENRRGSATSSLVSGDCIISGAALNRSLLFTGVRVNSYSRLENAVVLPDVTIGRHSILRNVVIDSRVVIPEGLVVGDDPELDAKRFRRTESGVCLITQTMIDKLGM

SEQ ID NO: 14780 - DNA, 1263 bp, Rhizobium tropici
  CDS (1)..(1263)
atggtagaaaaacgttttccagccgctggccgcgatgccatggcctacgttcttgccggggggcgcggcagccgcctgaaagaactgaccgaccgccgtgccaagccagccgtctatttcggcggcaagaccagaatcatcgattttgcgctgtcaaacgcgctcaattccggcatccgccgcatcggcgtcgcgacgcagtataaggcgcactcgctgatccgccatatgcaacgcggctggaacttcttccgcccagagcgaaacgaaagcttcgatatcctgccggcctcgcagcgcgtctcggaaacgcaatggtatgaaggcaccgccgacgccgtctaccagaacatcgacatcatcgagccctacggtccggagtatatggtcatccttgccggcgatcatatctacaagatggactacgaatggatgctgcagcagcacgtcgattccggcgcagacgtcactatcggctgcctggaagtgccgcgcatggaggccgtcggcttcggcgtcatgcatgtcgatgacaaggaccggatcatagatttcgtcgagaaaccggccgatccgccggggatccccggcaatcccgatttcgcgctcgcctcgatgggcatctacgtcttccatacgaagttcctgatcgaatgcctgaagcgcgatgcggccgacccgaattccagccgcgacttcggcaaggacatcatcccccatatcgtcaagaacggtaaggcggtcgcccatcgcttcacgcagtcctgcgttcgctcggatttcgagcgtgaagcctattggcgcgacgtcggcacgatcgatgcctactggcaggcgaatatcgacctgaccgccgtggtgccggaactcgacatctacgacaagtcctggccgatatggacttatgcggaaatcagcccgccggccaaatttgtccatgacgacgaggaccgccgcggttcggcagtctcctccgtcgtcgccggcgattgcatcatatccggggccagcctctacaacagcctgctctttaccggcgtgcgcgccaattcctattccaagctggagggtgcggtcgtgttgccgagcgtcaaggttggccgccgggcacagctcaagaatgtcgtcatcgaccacggcgtcaccattcccgaaggtctggtggtcggtgaagatccggaactggatgccaaacgctggcgccgcacggaaagcggcatctgcctcatcacccaatcgatgatcgacaagctggatctgtaa

SEQ ID NO: 14781 - protein, 420 aa, Rhizobium tropici
MVEKRFPAAGRDAMAYVLAGGRGSRLKELTDRRAKPAVYFGGKTRIIDFALSNALNSGIRRIGVATQYKAHSLIRHMQRGWNFFRPERNESFDILPASQRVSETQWYEGTADAVYQNIDIIEPYGPEYMVILAGDHIYKMDYEWMLQQHVDSGADVTIGCLEVPRMEAVGFGVMHVDDKDRIIDFVEKPADPPGIPGNPDFALASMGIYVFHTKFLIECLKRDAADPNSSRDFGKDIIPHIVKNGKAVAHRFTQSCVRSDFEREAYWRDVGTIDAYWQANIDLTAVVPELDIYDKSWPIWTYAEISPPAKFVHDDEDRRGSAVSSVVAGDCIISGASLYNSLLFTGVRANSYSKLEGAVVLPSVKVGRRAQLKNVVIDHGVTIPEGLVVGEDPELDAKRWRRTESGICLITQSMIDKLDL

SEQ ID NO: 14782 - DNA, 1300 bp, Rhodospirillum rubrum
  CDS (20)..(1291)
aaatcatcaggataccgccatggaccagattaccgaatttcaactcgacatcaatcgggcgttgaaggaaacgctcgccttggtcctggcgggaggccgcggttcgcgtttgcgcgatctgaccaatcgggaatcaaagcccgccgttccctttggcggcaaataccgcatcatcgatttcccgctttcgaactgcatgaattccgggatccgccgcatgtgcgtgattacccagtaccgggcccataccctgatccatcacatccagcgcggctggggcttcctgcgcgccgaaatcggcgagttcgtcgagctgtggccggcccagcagcagaccgacaaggagagctggtatctgggaaccgccgacgccgtccaccagaaccttgatctgatccgcatgcatgatccgcgcttcgtgctgatcctggcgggcgatcacatctacaagcaagattactcgaagcttctcgcccaccacatcgcccggggatcggattgcacggtcgcttgcgtcgacgttccgcgcgaagaggccaccggctatggctgcgtcgaggtcgacaacgacgacaacatcgtccacttccttgaaaagccggccaatccgccgggcatccccggccgccccgaccgcgccttcgcctcgatgggcatctatatcttcaatgccgatttcctctacgaaatccttgaatccgatgcgctgaacgaagccagccagcatgacttcggccgcgacatcattccctcgcaggtcggcaaggcgcgcatcgtcgcccaccgcttttcccaatcctgcgtctattcggtcggccgccgcgaaccctattggcgcgacgtcggcaccgtcgacgcgtactggtcggccaatatcgatctggtcagcgtcaccccggccctggatctgtacgacgccgactggccgatctggacctatcagatgcagcggccgccggcgaagttcgttttcgacaccgacgagcgccggggcatggccaaggacagcctggtttcggcgggctgcatcgtctcgggcggcgccgtgaccggctccttgctgtttaacgacgtgcgggtgaattcctatagctcggtcatcgatacggtgatcttgccgatgggcgacatcggccgccatgcccgcctgaccaaatgcatcctcgataccggttgtcgcattcccgaagggctggtcatcggcgaggatccgatcctcgacgccaagcgcttccacgtcaccgaacagggcatcaccctggtcacgccagaccgcctcgccctgctctaaaatatccgt

SEQ ID NO: 14783 - protein, 423 aa, Rhodospirillum rubrum
MDQITEFQLDINRALKETLALVLAGGRGSRLRDLTNRESKPAVPFGGKYRIIDFPLSNCMNSGIRRMCVITQYRAHTLIHHIQRGWGFLRAEIGEFVELWPAQQQTDKESWYLGTADAVHQNLDLIRMHDPRFVLILAGDHIYKQDYSKLLAHHIARGSDCTVACVDVPREEATGYGCVEVDNDDNIVHFLEKPANPPGIPGRPDRAFASMGIYIFNADFLYEILESDALNEASQHDFGRDIIPSQVGKARIVAHRFSQSCVYSVGRREPYWRDVGTVDAYWSANIDLVSVTPALDLYDADWPIWTYQMQRPPAKFVFDTDERRGMAKDSLVSAGCIVSGGAVTGSLLFNDVRVNSYSSVIDTVILPMGDIGRHARLTKCILDTGCRIPEGLVIGEDPILDAKRFHVTEQGITLVTPDRLALL

SEQ ID NO: 14784 - DNA, 1272 bp, Rhodobacter sphaeroides
  CDS (1)..(1272)
atgaaggcgcaacccccactcaggctgaccgcgcaggcgatggccttcgtgctggccggcggccgcggcagccggctcaaggagctgacggaccggcgcgcgaaacccgccgtctatttcggcggcaaggcgcggatcatcgacttcgccctgtcgaacgcgatgaactcgggcatccgcaagatggccatcgccacccagtacaaggcccacagcctgatccggcacatccagcgcggctggaacttcttccgcgaggagcggaacgaatatctcgacatcctgccggcaagccagcgggtcgacgagaaccgctggtatctgggcacggccgatgcggtgacccagaatatcgacatcgtggacagctacgacatcaagtatgtgatcatcctcgcgggcgatcacgtctacaagatggattacgagatcatgctgcgccagcattgcgagaccggcgcggatgtgaccatcggctgcctgaccgtgccgcgggccgaggccacggccttcggcgtgatgcatgtggatgcgaacctgcgtatcaccgactttctcgaaaagcccgccgacccgccgggcatccccggcgacgaggccaatgcgctggcctcgatggggatctatgtcttcgactgggcattcctgcgcgacctgctgatccgcgacgccgaggatccgaactcgagccacgacttcggccacgacctgatccccgccatcgtgaagaacggcaaggccatggcgcaccgtttctcggacagctgcgtgatgaccggcctcgagaccgagccctactggcgcgacgtgggcacgatcgatgccttctggcaggccaacatcgacctcaccgacttcacgcccaagctcgatctctacgaccgcgaatggccgatctggacctattcgcagatcgtgccgccggccaagttcatccatgacagcgagaaccggcgcggcacggccatctcgtcgctggtttcgggggactgcatcgtttcgggcagcgagatccgcagctcgctgctgttcaccggctgccggacgcacagctattcctcgatgagccatgtggtggcactgccgcatgtgacggtgaaccggaaggcggatctgacgaattgcgtgctcgaccgcggcgtggtcgtgccggaagggctggtgatcgggcaggatgcggaggaagatgcgcgctggttccgccgctcggagggcggcatcgtgctggtgacgcaggacatgctcgacgcccgggcgcgggcgctgaactga

SEQ ID NO: 14785 - protein, 423 aa, Rhodobacter sphaeroides
MKAQPPLRLTAQAMAFVLAGGRGSRLKELTDRRAKPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGIPGDEANALASMGIYVFDWAFLRDLLIRDAEDPNSSHDFGHDLIPAIVKNGKAMAHRFSDSCVMTGLETEPYWRDVGTIDAFWQANIDLTDFTPKLDLYDREWPIWTYSQIVPPAKFIHDSENRRGTAISSLVSGDCIVSGSEIRSSLLFTGCRTHSYSSMSHVVALPHVTVNRKADLTNCVLDRGVVVPEGLVIGQDAEEDARWFRRSEGGIVLVTQDMLDARARALN

SEQ ID NO: 14786 - DNA, 1200 bp, Streptomyces coelicolor
  CDS (1)..(1200)
atgctcggcatcgtgctggcgggcggagagggcaaacgcctgatgcccctgaccgcggaccgcgccaaacccgcggtcaccttcggcggcacctaccggctcgtcgacttcgtcctgtccaacctggtcaacggcgacatcctgcggatctgcgtcctcacccagtacaagtcgcactccctggaccggcacatcaccaccacctggcggatgtccagcctgctcggcaactacgtcactccggtccccgcccagcagcgcctcggcccccgctggttcctcggcagcgccgacgccatcctgcagtccctgaacctggtgcacgacgaacagcccgagtacgtggcggtgttcggcgccgaccacgtgtaccggatggacccgcgccagatgctcgcccagcacatcgagtccggcgcgggcgtcaccgtcgccgggatacgggtcccgcgcgccgagtcgccgtccttcggcgtgatcacgccgggctcggacgggcagaccgtcaccggcttcctggagaagcccgccgaccctcccggcctggccgacgaccccgggtgcgtcttcgcctcgatgggcaactacgtcttcaccaccaaggccctcgtcgaggccctgcaccgggacgccgaggacccggactccgtgcacgacatgggcggttcgatcctgccccagctcaccgaccggggcgaggccgcgctgtacgacttcagcgccaaccacgtccccggggagaccacccgcgaccaggggtactggcgggacgtgggcacgctggacgcctactacgacgcccacatggacctgatcgccgagcggcccgcgttcaacctctacaaccgggactggccggtctacacccactccacccagctctcgccggcccgcttcaacgccgggggcatcgccagcgagtcgatcatcagcgccggctgcctgatccgcggacaggtcacccggtccgtgctctccccgggggtggtggtcgaccccggcgcggtcgtgcagggctcggtgctgcacgacaacgtgcacatcggccggggtgcggtggtgcgcggggcggtgctggacaagaacgtgcaggtgccgccgggcgcgacgatcggcgtcaacccgcagcgggacggcgagttgtacaccgtctccaagggcggcgtgatcgcgctgggcaagggacagcgggtgccgtga

SEQ ID NO: 14787 - protein, 399 aa, Streptomyces coelicolor
MLGIVLAGGEGKRLMPLTADRAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSFGVITPGSDGQTVTGFLEKPADPPGLADDPGCVFASMGNYVFTTKALVEALHRDAEDPDSVHDMGGSILPQLTDRGEAALYDFSANHVPGETTRDQGYWRDVGTLDAYYDAHMDLIAERPAFNLYNRDWPVYTHSTQLSPARFNAGGIASESIISAGCLIRGQVTRSVLSPGVVVDPGAVVQGSVLHDNVHIGRGAVVRGAVLDKNVQVPPGATIGVNPQRDGELYTVSKGGVIALGKGQRVP

SEQ ID NO: 14788 - DNA, 1610 bp, Thermus caldophilus
  CDS (141)..(1385)
ccgctcctgcccgaagaagaggggcggccggggacgggtgggcggggtgaaccagcgcacggaggcgacccgcatggggaacactataccggtcccgccttgggggcttcgggtagactggccgtaaaggggggagaaggatggtcaaggtggaagtgctgggaatgattcttgccggaggccagggtagccggctttaccccctcacggccaagcgggccaagcctgccgtgcccttcggggccaagtaccgcatcattgacttcgtcctcaacaacttcgtgaactccggcatctacgccatctacgtcctcacccagtacaaggcccagtccctcacggagcacatccagcgctactggcgcttcggggcctttttggaggaccacttcatcctcctcgtgcccgcccagatgtaccgctacgaggagctcggacccgtctggtaccggggcacggcggacgccatctaccagaacctccacctggtgcacaaccacgcccccaaggcggtggccgtcttcggcggggaccacatcttcaagatgaacatccgccacatggtggagtaccactacgacacccgggccgacatcaccatcgccgcctaccccgtccccgtggccgaggccacccgcttcggcgtgttgcaggtggacgaggagtggcgcatcaccgagttccaggagaagccagaggagcccaagcccattcccggccgccccgacatggccctcgcctccatgggcaactacatcttccgcaccgaggccctctttgagcttttggaggcggacgccagggacgagaccagcgcccacgacttcggcaagggcgtcatcccccgggccattagggtggggtacagggtctacgcctacgacttccaccgcaaccccatccccggccaggaggggccgaacctctactggcgggacgtggggaccctggacgcgtattacgaggccagcatggacctggtgaaggtggaccccgtgtttggcctctgcagcccggtgtggcccctccgcaccgccaacctcttcagccccccggccaagttcgtccacgagaccggggagcgggtggggcgcgccctgaatagcctcctcgcgggcggggtcatcgtgagcggggggacggtgcgggagtccgtactcttccgccgggtgcgggtgaactcctatagcctggtggagcgctccgtcctctttgacgacgtggaggtggggcgctactgccgcatcaggaacgccatcattgacaagaacgtgaagatccctccccacaccgagatcggctacgacctggagctggaccgggcccggggcttcaccgtcacccccgagggcgtggtcgtggtgcccaagggctaccgcttttagccatggagaagcatcccggtaagctcttttaccgcctaagccgcctggccccaggggacgccctgcccttcaagcggggcccaaggctaaggtctacgccaaccccctggagacccaggccctgccccccttccgccaggaccgggggaccccccctcttccgggccatggcccacctcaggcccctcctccccgaggtgggggcctccctcaccctgaaggacc

SEQ ID NO: 14789 - protein, 414 aa, Thermus caldophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKGVIPRAIRVGYRVYAYDFHRNPIPGQEGPNLYWRDVGTLDAYYEASMDLVKVDPVFGLCSPVWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 14790 - DNA, 1032 bp, Bacillus stearothermophilus
  CDS (1)..(1032)
atgaacaacaagatgttaggcgtcattgacgcgacaacgtatattgaggcgttggagccgctcatcgagcagcgttcgatcgccgcagtaccatttgccgggcggtaccggctcattgacttcgtgctctcaagcatggtcaattccggcattgaaagtgtcgctatttttccgaaatatcagtatcgctctctcatggaccatttagggtcagggaagaactgggatttaaaccgaaaacgggacgggctgtttttcttcccgtcgccggatttgctgttttctggcgagcgccgggtcggagcgtttgctcattttgagcagcatattgactattttttgcggagccggcaaaaatatgcggtcattgcgaacggctatacggtatgtaacatcgattttgacgccgtcttgaaccgtcatatcgaaaatggctgcgatgtgaccgaaatccgccatcgaggtcggtcgctggaaatgtatttgcttgaaacgtcgctgttgcttgacttaatcgccgactacaaaaaccacggttactatagcattgtcgatgtcatccgcgattaccatcgttcgttgtcgatttgcgagtatgaatatagcgggtatgcggcggtcattgactcggtggaacagtattttcgctcaagcatggagctgctcgaccgagacgtctgggaacaactctttctcccgtcgcatccgatttatacgaaagtcaaggacgagccgccgacgaaatatggacgggaggggaacgtgaagcgttcgatgatcgccaacggctgcgtcattgagggaacggtggagaacagcgtcttgttccgctccgtcaaaattggcaagggagcggttgtgcgcaatagcattattatgcaaaaatgccaaatcggtgacggttgtgtccttgatggcgtcattattgataaagatgccaaggttgaaccaggtgtcgtcctcaaaggaacgaaagaacaaccgtttatcgtccgcaaaggaacggtgcaaggggaggttatcagccgatga

SEQ ID NO: 14791 - protein, 343 aa, Bacillus stearothermophilus
MNNKMLGVIDATTYIEALEPLIEQRSIAAVPFAGRYRLIDFVLSSMVNSGIESVAIFPKYQYRSLMDHLGSGKNWDLNRKRDGLFFFPSPDLLFSGERRVGAFAHFEQHIDYFLRSRQKYAVIANGYTVCNIDFDAVLNRHIENGCDVTEIRHRGRSLEMYLLETSLLLDLIADYKNHGYYSIVDVIRDYHRSLSICEYEYSGYAAVIDSVEQYFRSSMELLDRDVWEQLFLPSHPIYTKVKDEPPTKYGREGNVKRSMIANGCVIEGTVENSVLFRSVKIGKGAVVRNSIIMQKCQIGDGCVLDGVIIDKDAKVEPGVVLKGTKEQPFIVRKGTVQGEVISR

SEQ ID NO: 14792 - DNA, 1800 bp, Arabidopsis thaliana
  CDS (36)..(1598)
ctctcaattttgccttcctttgatcgaatactacaatggcgtctgtatctgcaattggagttctcaaggtacctcctgcttcgacttccaattccaccggaaaagccacggaggcggttcccacgaggactctttctttctcctcctctgttacttcatccgacgacaagatttcactcaaatccaccgtctcccgtctttgtaaatctgttgttcgcaggaatccgatcatcgtctctcccaaagccgtctcagattctcaaaactctcaaacttgtctcgatcctgatgctagcagcagtgttttggggataatcttaggaggtggagctggaactcgtctttatccacttacgaagaagagagcgaaaccagctgtgcctcttggtgctaactataggcttattgatattcctgtgagcaactgtttgaatagcaacatatccaagatctatgttcttactcagttcaattccgcgtctttgaatcgtcatctttcacgagcttatgctagtaacatgggaggttataagaatgaaggattcgttgaagttctcgctgctcaacagagtcctgaaaaccccaactggttccaggggacagctgatgccgtcaggcaatacttgtggttgttcgaggagcataatgtcttggagtatctcattcttgctggggatcatttgtatagaatggactatgagaagtttattcaagcacatagggagactgatgctgatatcacagtagctgcattaccaatggacgagcaacgagccactgcttttgggctgatgaagattgatgaggaaggacgtattattgaatttgctgaaaaaccaaaaggggagcacctaaaggccatgaaggttgacacaacaattctaggtcttgatgatcagagagccaaggagatgcctttcattgctagtatgggtatttatgttgtaagcagagatgtaatgctagacttactacggaatcagtttcctggagctaatgactttggaagtgaagtcattcccggtgccacttcccttggactgagggtgcaagcttacctatatgatggttactgggaagacattggtactatagaggcattttataacgctaatcttggaatcaccaagaaaccagttcctgattttagtttctatgaccgttctgctccgatctacacacagccgcgttatttaccaccgtctaagatgcttgatgctgatgttactgacagtgtcatcggagagggctgtgttatcaagaactgcaaaattcatcactctgtggttggactccgttcctgcatatcagaaggtgctattattgaagattcgttattaatgggagctgattattacgagactgctacggaaaagagcctcttaagcgcgaaaggaagtgtacccataggtattgggaaaaactcgcacatcaaaagggccatcatcgacaaaaacgcacgtatcggtgacaatgtcaagatcataaacagcgacaacgtgcaagaggcagcgagagagactgatggatatttcataaagagcggaattgtaacggttatcaaagacgccttaatcccaaccggcactgtcatctgaagtacacataatgctcctttgtttatttcttcatctttctaatgccctatcaataagttttctttatgctttttaagccccaataaatctactactagttgtaatgctgcttacgaaagagattacgaaatcatgttttcacaataccattgtctcttttgagaaaaaagaagaccctatgaatttcactaaatttatcttt

SEQ ID NO: 14793 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEQRATAFGLMKIDEEGRIIEFAEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 14794 - DNA, 1761 bp, Brassica napus
  CDS (33)..(1595)
aagagtgaagctcctcctctcgaacaacaacaatggcgacaatggctgcaatcggatccttaaaagtcccttcctcttcctcgaaccacacccgtagattatcatcttcttctcaacggaagactctctcgttctcgtcgtcttctcttaccggagagaaactcaacccgacgcaggagatcatcatctccaatctcccacgtggcaacgagagaagaacgccatcgatcgtctctccaaaagcagtttccgattcgcaaaactcgcaaacttgccttgatcctgacgctagcagaagtgtgttggggataattctgggaggtggtgctggaacgagattgtatccgctaacgaagaagagagcgaagccagctgttcctctcggcgctaactaccgtctcattgatatcccagtgagcaattgcttgaacagtaacatctccaagatctatgtccttactcagttcaactcagcttctctcaaccgccatctctcccgagcttacgccagcaacatgggtggttacaagaacgaaggcttcgtcgaggttcttgctgctcaacagagtcccgagaatcccaattggtttcaggggactgctgatgcagtgaggcagtacttgtggctgtttgaagagcacaatgtgttggagtttttggttcttgcaggggatcatttgtaccgtatggactacgagaagttcattcaagcgcatcgtgagaccgacgctgatatcactgttgctgctcttcctatggatgagaaacgtgccacggcttttggacttatgaagattgatgacgaaggaaggatcattgagtttgctgagaagcctaaaggagagcagttaaaggctatgaaggttgatacaacaatcttgggacttgatgacgaaagggccaaagagatgccctttattgctagtatggggatatatgttgttagcaagaatgtgatgttggacttgctccgagaccagttccctggagctaatgacttcgggagtgaagttatccctggtgctactgatcttggactcagagtgcaagcttatctgtatgatggatactgggaagatattggtaccattgaagccttttacaatgctaatcttgggatcaccaagaaaccagtaccagatttcagcttctatgaccgttcagcaccaatctacacacagcctcggtacttacctccatccaagatgcttgatgccgatgttaccgatagtgtgatcggtgaaggttgtgtcatcaagaattgcaaaatccaccattccgtcattggtcttcggtcttgcatatcggagggtgcaatcatagaagacaccttgttgatgggtgctgactactacgagactgatgcggataggacactcctggctgcaaaaggcagcatcccgattggcattggccgagactctcacattaaaagagctatcattgacaagaatgctcgtattggtgacaacgtcaagatcatcaacacggacaatgtgcaagaagctgccagagagacggatggatacttcatcaagagcggcattgttacagtgatcaaggatgctctgattcctagtggaactgttatctaagagacaccaccaccccgtttgacaatcttcttaatatctcatggttttgacctcgagttagcttccactgatgctatctctaatgttatccgaggtcagggcctatgcatcctcctgccttatccctaaataatattctctactttgtattctagtctttggcgat

SEQ ID NO: 14795 - protein, 520 aa, Brassica napus
MATMAAIGSLKVPSSSSNHTRRLSSSSQRKTLSFSSSSLTGEKLNPTQEIIISNLPRGNERRTPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 14796 - DNA, 24 bp, Primer
atggttagtttagagaagaacgat

SEQ ID NO: 14797 - DNA, 24 bp, Primer
ttatcgctcctgtttatgccctaa

SEQ ID NO: 14798 - DNA, 2217 bp, Saccharomyces cerevisiae
  CDS (422)..(1714)
ggccttcagtttttagctcaaaaagagcaaataagtaccactagttaatagaacatatatatatacatgaatagcctcatcacatagcacagaaagtaagctttcaaaacactgatgatcggctcttattctggcgtactcattttcagcatctcaaaccgcgctgtttttttctcactttttgatacaataggtatgcaaaggagaatggcaggtgtgccaaggaaaaaaaatatgaggaactatagcctaaaatgaagcctcctctgatgtgggagggaccccaatttaggtcaataatgattttttaaatttatattcttgtcttaatgaaacttgagtcaagtcgaccagtttcctgacgattttgatatagaataatattgctcgtttggccggcaacagattacataagaagcagatggatgatataagcggaaggcaaactttacctcgaataaaccgtttgttggagcacgtgggaaatccccaagatagtttgtcaatcctacatatagcgggaacaaatggtaaggagacagtatctaaatttttgacatccatattgcagcatccggggcaacagcggcaaagggtcttgattggtaggtatactacatcttccttgctaaacgccaaagaagaggatattagcattaataatgaagccatttccttgatagagtattctaggatcgagaaggaacttatagaagcagatagttctttgaaattacagtgcaacaacctcgaactgctaacaagcgtagctctcgtatacttcgctaagaaaaattgccaatggtgcataatagaaactggtttagctggaaaacaggaccctggaagtataattgctggtcaaagtagagtctgttgcgccattactaacgtgggcattagcgatgaagcttttttatgcaagtttttgtctcaaattactgaaagttccacaaataaagcaatttttctattagacggttctaatgacgaatttgtacgaaatacgataacgaaacggtgccatgatgttggatgtccattagaaatcaccgacccttctcttagggattacaatgtacacacagacacatggggcactcttgaagttcgcctgccatacagtgaagaagaatatcaaatatttaatttgagagttgcgatagcggttttagactttttgagcaaggaaaaaaaggtttgtatttcaaaggatcaactatcccaaggtttaatatctgtggattggccaagaagtttacatcgcttggattactgttatgaatctactagtggaaagaaaatcgcattactattagacaacgcaaataatgcgaaggcagctcgaaatttagcctgccatttaaggaccacgtacggtgatacgccattaacatttgtcattgctataacaactgggaaaaaggtgtctcccttacttgatccgctaatacgtccacaagattatgttattgtgactagatttgggtcagtggttggaatgccgtggatccaatccctagaaccggtgaatcttctcgcatttatcaaaaaccggtatacgagaaatgttaacatgcagccggatcttcaaagtgtctggaccttccttgaaacaagtgggttaaagacgattgttcctgttatcgtatgtggatcactgtatatctgcaaagagctattgcgcttacacaactgtcacttgccagtatagtttttagatatatgatcatatcctacaatgcaattaccgatattgatagaggaccagtctgccaagggcatccggggatatatcatattttccttcttttataacggcatgtaactttacttttactttaaactatggcattacattccagcttttcaagagttattagtgattcattacttataaagtttttccgaccacattttgatactttgtacctgatatagataaaacaattaccttataaattgattctctcatatttatcttgatgagaaaacgattgaggagatttgtgtgtaatttggttctcgtaacaaataccattaaataatccttgactagtaatacataccaaacaaagaacgatttgcggatactcagccgcacgaaaatttctaaaattgaactaaatcctttaggatatataaaagggcacaaagtgagaacgtaaaaacagcattataaagatattgtaatgaagaaatttatgctcatttagt

SEQ ID NO: 14799 - protein, 430 aa, Saccharomyces cerevisiae
MDDISGRQTLPRINRLLEHVGNPQDSLSILHIAGTNGKETVSKFLTSILQHPGQQRQRVLIGRYTTSSLLNAKEEDISINNEAISLIEYSRIEKELIEADSSLKLQCNNLELLTSVALVYFAKKNCQWCIIETGLAGKQDPGSIIAGQSRVCCAITNVGISDEAFLCKFLSQITESSTNKAIFLLDGSNDEFVRNTITKRCHDVGCPLEITDPSLRDYNVHTDTWGTLEVRLPYSEEEYQIFNLRVAIAVLDFLSKEKKVCISKDQLSQGLISVDWPRSLHRLDYCYESTSGKKIALLLDNANNAKAARNLACHLRTTYGDTPLTFVIAITTGKKVSPLLDPLIRPQDYVIVTRFGSVVGMPWIQSLEPVNLLAFIKNRYTRNVNMQPDLQSVWTFLETSGLKTIVPVIVCGSLYICKELLRLHNCHLPV

SEQ ID NO: 14800 - DNA, 1287 bp, Lactobacillus casei
  CDS (1)..(1287)
atgaattacacagaaacggttgcctacattcattcttttccgcgtttggccaagaccggtgaccatcggcggattttaacgttattacatgcactcggcaatccgcagcaacaagggcggtatattcacgtgactggtactaatggaaaaggctcagccgctaatgcgattgcacatgtccttgaggcaagcggtttgacagtcgggttatatacctcgccgtttatcatgcggtttaatgaacggatcatgattgaccatgaaccgattccggatgctgcgttagtcaatgcggttgcgtttgtcagggctgcactggagcggcttcagcagcaacaagctgattttaacgtgacggaatttgaattcattaccgcgctgggctattggtattttcgtcagcgtcaggttgatgttgcggtgattgaagtcggtattggcggcgacacggattcgaccaatgtcatcacgccggttgtcagtgttttgaccgaggttgctttagatcaccagaagttgctggggcatacgattacggcgattgccaagcataaggccggtattatcaaacggggtattccggttgtaaccggtaacttggtgccggatgctgctgccgttgtcgcagccaaggtcgcgacaacagggagtcaatggttgcgttttgaccgcgatttttcggttcctaaggctaagcttcacggttggggccaacggtttacttatgaagaccaagatggacgtattagtgatttggaggtgccgttggttggcgattaccagcaacgtaatatggcaattgcgattcaaacggcaaaagtgtatgccaagcagacagaatggcctttgacgccccagaatattcgccaagggcttgctgccagtcattggccagcccgactcgaaaagataagtgatacgcctttgatcgtcattgacggggcgcacaatccggatggcatcaatggtttgattacggcgctaaagcaacttttttcccaacccattactgttattgccggcatcttggcggataaagactatgcggcgatggcggataggctgaccgcggcattttccacggtttatctggttccggtgccggggacgccgcgcgccttgcctgaggctggttatgaggcgctgcacgaaggtcggttaaaggattcgtggcaggaagcattggcggcgagtcttaatgatgtgccggatcagccgattgtgatcaccggttcgctgtatttagcctcagctgttcgtcaaactttattagggggaaaatcatga

SEQ ID NO: 14801 - protein, 428 aa, Lactobacillus casei
MNYTETVAYIHSFPRLAKTGDHRRILTLLHALGNPQQQGRYIHVTGTNGKGSAANAIAHVLEASGLTVGLYTSPFIMRFNERIMIDHEPIPDAALVNAVAFVRAALERLQQQQADFNVTEFEFITALGYWYFRQRQVDVAVIEVGIGGDTDSTNVITPVVSVLTEVALDHQKLLGHTITAIAKHKAGIIKRGIPVVTGNLVPDAAAVVAAKVATTGSQWLRFDRDFSVPKAKLHGWGQRFTYEDQDGRISDLEVPLVGDYQQRNMAIAIQTAKVYAKQTEWPLTPQNIRQGLAASHWPARLEKISDTPLIVIDGAHNPDGINGLITALKQLFSQPITVIAGILADKDYAAMADRLTAAFSTVYLVPVPGTPRALPEAGYEALHEGRLKDSWQEALAASLNDVPDQPIVITGSLYLASAVRQTLLGGKS

SEQ ID NO: 14802 - DNA, 1254 bp, Nostoc sp. PCC 7120
  CDS (1)..(1254)
atgaatatcaattccctactgcaaccatttcaccatttcggcgttaacctcggactttcgcggattatcaaattgctggacaaccttggcaatccccatgagcgagttcccataattcatgtagctggcacaaatggtaaaggttctgtttgtgcttatctttcctcggtgttgactgaggctggttatcgtacagggcgctacacttcgccgcatttagtcgattggccagagcgtatttgcctgaatgaacagcagatttctcatgatgaattgtgtcaattagttttaacagtccaagcagctatttgttttgatgatgaatacccgactttatttgaagtaattaccgccgccgcttggttatattttgcccagcaaacaatcgatgtggcagtggtagaagtaggattgggtggacggttggatgctactaatgtaattgctgatcctttggtgacagtgataacttctatcagtcgggaacattggcaacaattggggccgactgtcgctgatattgctggggaaaaagcggggattctcaaaccgggttgtccggttgtggttgggactttgccatcggatgcagaaaaagtggtgcgatcgcgcgctcaagaattacaatgtcctttaattctgcctcaacctgctcgtcaaatctctccccaattagcagaatatcaaagtattcaaaacacaaaaacaattaaatatcctctacctttacaaggacaaattcaactcaataattctgctttggcactagcagctttagaaattttgcaacaaaaaggctggcagatttctgaagcagaaattattaatggcatggcaaaaactaaatggccagggcgaatgcaatggattacttggcaaaaccacaaattattaattgatggcgctcataatccggcggcggctcacgtactcagaaactatgtagataccctaaataatcaatcagtaacttgggttatgggaatgttatctacgaaagaccacgccgatatttttcaagctttattaagaccaaacgaccaattatatttagttccagtaccagataataattcagctaacccagaggttttatccaagttagctagtgatgtttgtccaaaattaagcacttgtcaaactttttcaaatttaccattagccatagaaaccgcattcaactcaacagataacttagtagtgttatgtggttccttatatttaattggtcattttttagcttctaaaggctag

SEQ ID NO: 14803 - protein, 417 aa, Nostoc sp. PCC 7120
MNINSLLQPFHHFGVNLGLSRIIKLLDNLGNPHERVPIIHVAGTNGKGSVCAYLSSVLTEAGYRTGRYTSPHLVDWPERICLNEQQISHDELCQLVLTVQAAICFDDEYPTLFEVITAAAWLYFAQQTIDVAVVEVGLGGRLDATNVIADPLVTVITSISREHWQQLGPTVADIAGEKAGILKPGCPVVVGTLPSDAEKVVRSRAQELQCPLILPQPARQISPQLAEYQSIQNTKTIKYPLPLQGQIQLNNSALALAALEILQQKGWQISEAEIINGMAKTKWPGRMQWITWQNHKLLIDGAHNPAAAHVLRNYVDTLNNQSVTWVMGMLSTKDHADIFQALLRPNDQLYLVPVPDNNSANPEVLSKLASDVCPKLSTCQTFSNLPLAIETAFNSTDNLVVLCGSLYLIGHFLASKG

SEQ ID NO: 14804 - DNA, 1290 bp, Listeria innocua
  CDS (1)..(1290)
atggcattaaaatcgtatcaggaagctttggattggattcatggaacgcttcgtttaggaataaaacccggcttagctcgaatggaatatataatggaaaagcttaaccatccggaaaaggctaataagtgggtacatatagctggcactaatgggaaagggtctactctaacatttattagaagtagtttagaagaagcaggatataaaacaggaacttttacttctccttatattgaaacttttaatgaacgaattagtgtaaatggtattcctgttagtgatcaaatgattgtagatttagcaaatagaataaaacctatagctgaagaacttgaaaaaactgtatacggtcccccatctgaatttgaaattattacagcaatgatgttcttgtgttttgcagaatatgagtcaatcgatattggcatcatagaagtcgggcttggaggaagactagattccacaaatgttttaacgcctttaatctctgtaattacaaccattgggatggatcatatggagtttttgggaaatagtatcgaacaaatagctggtgaaaaagcagggattataaaaccaggtatacctgttatttctggagttattcaaaaagaagcgcaagaagtaataataaataatgctgttagaaacaattcgaatgttgcatggctaaacaaagatttctgcattcaaaatagaggcgatgaaatcacatttagaacatcccatggagacgaaataccggacataaccattggcttgttaggaatacatcagttaaataatgcagcagttgcaataaaagtactacagtatctaaacacattttcatcctatgaaattaatcaatcagcaattaaacagggattaaagaaagctttttggccaggaagaatggaattgcttgatgtgaaaccatttattatgctggacggagcacacaatcctgaaggtgtaacaacctttgctaattcaataaaaacatatcctgggcataaaaaaataatagttagcatacttaaagataaaaattatcaagaaatgatagctttattaaagacaattcctgatactgaaattttattgacaacctttgattatcctcgggcaatgagtgattacgaagtcacacaaattggaactatagaaggtatttctactaatccaaactggaagcaagcattagatgatataaaggaaatcaaaaatgatactaagtttttcgttacaggctcgctttatttcatttctgaagtccgtaagtatttgcttacatcgcacaactaa

SEQ ID NO: 14805 - protein, 429 aa, Listeria innocua
MALKSYQEALDWIHGTLRLGIKPGLARMEYIMEKLNHPEKANKWVHIAGTNGKGSTLTFIRSSLEEAGYKTGTFTSPYIETFNERISVNGIPVSDQMIVDLANRIKPIAEELEKTVYGPPSEFEIITAMMFLCFAEYESIDIGIIEVGLGGRLDSTNVLTPLISVITTIGMDHMEFLGNSIEQIAGEKAGIIKPGIPVISGVIQKEAQEVIINNAVRNNSNVAWLNKDFCIQNRGDEITFRTSHGDEIPDITIGLLGIHQLNNAAVAIKVLQYLNTFSSYEINQSAIKQGLKKAFWPGRMELLDVKPFIMLDGAHNPEGVTTFANSIKTYPGHKKIIVSILKDKNYQEMIALLKTIPDTEILLTTFDYPRAMSDYEVTQIGTIEGISTNPNWKQALDDIKEIKNDTKFFVTGSLYFISEVRKYLLTSHN

SEQ ID NO: 14806 - DNA, 1800 bp, Bacillus subtilis
  CDS (231)..(1523)
gaatttgataaactgacaaaagaagttgagcgtgtccaaaagaaacttggaaatgaaggatttatgaaaaaagcgcctgcacacgtaattgatgaagaacgtgaaaaagaaaaagattatgtggcgaagcgtgacgctgttcaaaaacgaatggctgagctgaagggttaatgaaaagccggggcggtttctagagaaaccgccttgtcttataaaagaggggattatcaatgtttactgcatatcaagatgcgcgcagctggattcacgggaggctgaaattcggggtgaagcccggacttggtcgaatgaaacagctgatggcgcggttaggacatcctgaaaaaaaaatccgagcgttccacgtcgcaggaacaaacggtaaaggatcaactgtcgcttttatccgttctatgctgcaggaagccggatatacggttggaacatttacatcgccttatattattacgtttaatgaacggatcagcgtaaacgggataccgatttcagatgaggaatggacagcactcgtcaatcaaatgaaaccgcacgttgaagcccttgatcaaacggaatacggacagccgacagaatttgaaattatgacagcttgtgcatttttatattttgcagagtttcataaggtcgattttgttatttttgaaacaggtctgggcggtagattcgattctactaatgtggttgaaccgctcttaactgtgattacaagcatcggacacgatcatatgaacattttgggaaacaccattgaagaaattgcaggagaaaaggccggcattattaaagaaggtattccaatcgttacagcagttacccagccggaagctttacaggtcatccgccatgaagccgaacggcatgctgcgccgttccagtcattgcatgatgcatgtgttattttcaatgaagaggctctgcctgcaggagaacagttttcattcaaaacggaagagaaatgctatgaagatattcggacatctctgattggcacccatcaaagacaaaatgctgctttgtccattttggctgcggagtggctcaataaggagaatatcgcccatatcagtgacgaagcgttaaggagcgggcttgtgaaggctgcttggccgggacggttagagcttgttcaggaacatcctccggtatatttagacggtgcgcataacgaagaaggtgttgaaaagctggcggaaacgatgaagcagcgtttcgccaattcacgcatttctgtggtgtttagcgcgttaaaggacaaaccgtatcagaacatgattaaaagactggaaaccattgctcatgcgattcattttgcttcttttgatttcccgcgtgcttcccttgcaaaagatctctatgatgcaagtgaaatcagcaataaaagctggagtgaagatccagacgatgtaatcaaattcatagaaagtaaaaagggctcaaatgaaattgtgctgattaccggatctctttactttatttctgacattcgaaaaaggttgaaataaaagcatccggctccggcagaatcaaaaaaagattctgccgtttttttcatgtgtaaaattgaatattcccaattggagctcaggatgtccattttgctacaatccataccagaactcaatgagtaaaggtgtgttgtctatgctatccattctttttatcttcgggcttatccttggttctttttactatacggccgggtgccgtatccccttacatctatctattattgcgccccgttcatcatgcccgttttgccggcgaacattaactcctgca

SEQ ID NO: 14807 - protein, 430 aa, Bacillus subtilis
MFTAYQDARSWIHGRLKFGVKPGLGRMKQLMARLGHPEKKIRAFHVAGTNGKGSTVAFIRSMLQEAGYTVGTFTSPYIITFNERISVNGIPISDEEWTALVNQMKPHVEALDQTEYGQPTEFEIMTACAFLYFAEFHKVDFVIFETGLGGRFDSTNVVEPLLTVITSIGHDHMNILGNTIEEIAGEKAGIIKEGIPIVTAVTQPEALQVIRHEAERHAAPFQSLHDACVIFNEEALPAGEQFSFKTEEKCYEDIRTSLIGTHQRQNAALSILAAEWLNKENIAHISDEALRSGLVKAAWPGRLELVQEHPPVYLDGAHNEEGVEKLAETMKQRFANSRISVVFSALKDKPYQNMIKRLETIAHAIHFASFDFPRASLAKDLYDASEISNKSWSEDPDDVIKFIESKKGSNEIVLITGSLYFISDIRKRLK

SEQ ID NO: 14808 - DNA, 1275 bp, Neisseria meningitidis
  CDS (1)..(1275)
atgaaaacactacaagactggctctcgcatttggaaaccgcccacagcggcggtttgatcgacatgggtttggagcgcacgagcgaagtgaaaaaacgcatgaagctcgagccgcaatgccccgtcgtcgttgtcgcgggaaccaacggcaaaggttcggtctgtgcctacctgacacagatttacaaacaggcgggctacaaaatcggtacgctgaccagcccgcatttattgcgttacaacgaacgcatcgccatcaacgccgaacccgtttcggacgatacgattattgcctctttcgagcgcatcgaagccgcgcgcggcgaaatatcactgacttattttgaattcaatgccttggcggctgtcgacatcttcatgcgcgaacaggttgacgtgatgatattggaagtcggcttgggcggccgcttggacgcggtcaacgcgtttgacggcgattgcgcggtggttaccagcgtggatttggaccatcaggcatttttgggcgatacggtcgagcaggtcggctttgaaaaagcaggcgtgttccgtagcggcaaacccgccatctgcggtcaaaaccccgcgcccaaatcgttgctttcacacgccgaagccataggcgcgaaactgctgatggtgcagcgcgatttcgagtttcacgcgatggaaaacatccaatggaactaccgcttccggccgcaacattcagacgaccccgcgcgcaaccgcaatgccctgcccttccccgcattgcgcggcacataccagctttccaatgccgcctgcgcgctgaccgtattggaatgcttgaacgacaaattgccggtggacatcggtgccatcaagcgcggtttgttgctggttgaaaatcccggacgcttccaagtcctgcccggccggccgctgaccgttttggatgtcggacacaatccccacgccgcccgcgccctgcgccgcagcctgattaatttggcgtttgcgcaaaaacgcaccgccgtgttcagcatgttgtccgacaaagacatagacggcgtgttggaaaccgttaaagaccagtttgacgagtggtatatcgcaccgttggatgtaccgcgcggcatgacgctcgagagcctgcaaaacaaactgcacgaacacagcatcgaaaacatacaaacattcgccgccgtccgcgaagcataccgggcggcagcctcaaaagcgggcgagaacgacagaatcgtcgttttcggctcatttcataccgttgccgatgtcatgtcggtactttaa

SEQ ID NO: 14809 - protein, 424 aa, Neisseria meningitidis
MKTLQDWLSHLETAHSGGLIDMGLERTSEVKKRMKLEPQCPVVVVAGTNGKGSVCAYLTQIYKQAGYKIGTLTSPHLLRYNERIAINAEPVSDDTIIASFERIEAARGEISLTYFEFNALAAVDIFMREQVDVMILEVGLGGRLDAVNAFDGDCAVVTSVDLDHQAFLGDTVEQVGFEKAGVFRSGKPAICGQNPAPKSLLSHAEAIGAKLLMVQRDFEFHAMENIQWNYRFRPQHSDDPARNRNALPFPALRGTYQLSNAACALTVLECLNDKLPVDIGAIKRGLLLVENPGRFQVLPGRPLTVLDVGHNPHAARALRRSLINLAFAQKRTAVFSMLSDKDIDGVLETVKDQFDEWYIAPLDVPRGMTLESLQNKLHEHSIENIQTFAAVREAYRAAASKAGENDRIVVFGSFHTVADVMSVL

SEQ ID NO: 14810 - DNA, 1323 bp, Streptococcus pneumoniae
  CDS (1)..(1323)
atgaaagaaattgaaaacaatcaatggattgctaactaccggacggatcaaccgcattttggcttggaacgaatggtggaactgttagctttgcgtggcaatccccatctcaaactcaaggtcctccatatcggaggaactaacggcaagggctcgactattgcttttttgaaaaagatgctagaaaagctagggctgagagttggcgtgtttagctcgccctatctcattcattacacagaccagattagcatcaatggggaatcgatctcagaagcgaggctagaagctctcatggcagactatcagtctttgctggagggagaagcggtcgccaatttacagggcacaaccgagtttgagattatcacagccctggcctatgactactttgcctcagagcaagtagatgtggccatcatggaagttggcatgggtggactttttgatagtaccaatgtctgtcagcccattttgacaggaattacaactattggcttggatcatgtggccttacttggtgacaccttggaggccatagcagagcagaaggcaggtattatcaaacaagggatgcccttggtaacagggcgtattgctccagaagccttggctgtgattgaccgcattgcggaagggaaagatgcgccgagacttgcctacgggacagattatcaggttcgtcatcaagaaagtgtggtgacaggggaagtctttgactatacaagtgctgtcagacaaggtcgcttccagactagcctgcttggtttgtaccaaatagagaatgctgggatggccatagctttacttgatactttttgtcaagaagatggtcgagagctagcaagcaatgactttcttggtcaagccttggaagaaacaagttggccagggcgtttggaaatcgtgtcaagagatcccttgatgattttggatggagcccataatccccatgctatcaaggccttgttggtaaccttgcaagaacgttttgcggattatcataaggaaatcctcttcacttgtatcaaaaccaaagccttggaggatatgttggacttgctgggagccatgccagataccgagcttactctaacacattttgcggatagtcgggcgacggatgaaagcgtgctgaaagaggcagctaagtctagaaatctcagctaccaagattggcatgattttctagagcagaatgtgacagataaaaaagaagagaaacaaacagttaggattgtcacaggttccttgtatttcttgagccaagtgagggtctatctgatggagaggaagaacgagaatggatacacaaaagattga

SEQ ID NO: 14811 - protein, 440 aa, Streptococcus pneumoniae
MKEIENNQWIANYRTDQPHFGLERMVELLALRGNPHLKLKVLHIGGTNGKGSTIAFLKKMLEKLGLRVGVFSSPYLIHYTDQISINGESISEARLEALMADYQSLLEGEAVANLQGTTEFEIITALAYDYFASEQVDVAIMEVGMGGLFDSTNVCQPILTGITTIGLDHVALLGDTLEAIAEQKAGIIKQGMPLVTGRIAPEALAVIDRIAEGKDAPRLAYGTDYQVRHQESVVTGEVFDYTSAVRQGRFQTSLLGLYQIENAGMAIALLDTFCQEDGRELASNDFLGQALEETSWPGRLEIVSRDPLMILDGAHNPHAIKALLVTLQERFADYHKEILFTCIKTKALEDMLDLLGAMPDTELTLTHFADSRATDESVLKEAAKSRNLSYQDWHDFLEQNVTDKKEEKQTVRIVTGSLYFLSQVRVYLMERKNENGYTKD

SEQ ID NO: 14812 - DNA, 1293 bp, Thermotoga maritima
  CDS (1)..(1293)
atggcatacctcgaagttctcaggtatctctaccacaaaagacctatgggaaaggtgaaaccaggtcttgagaggatctcaatgctactttcaaagctgggaaatccccatctggaatacaaaaccatacacataggtggcacgaacggaaagggttctgttgcaaacatggtcagtaacattctggtatctcaagggtacagagtgggatcatattactcccctcatctgagcacgttcagagaaaggataaggttaaacgaagagtacatatccgaagaggacgtggtgaagatctacgaaacaatggagccgattctgaacgagctcgacaaagaagaaatattctccccaagcttttttgaagttgtaacggcgatggcttttctctatttcgcggaaaaaaacgttgacattgccgtcctggaagttggtcttggaggcagactggacgcaacgaacgtggtgttccctctttgttccaccattgtcacggtggacagagatcacgaaaaaacgttgggatacaccatagaacagatcgcatgggaaaaatccggaataataaaagaaagagttccccttgtgacaggggaaagaaaaagagaagccctcaaagtgatggaagatgttgcccgaaagaagagctcaaggatgtacgtcatcgacaaggatttttccgttaaggttaaatctctgaaacttcacgaaaacagattcgattactgtggggaaaacaccttcgaagatctcgtcctgaccatgaacggtcctcaccagatagaaaacgccggtgttgccctgaagactcttgaagcaacaggacttccgttgagcgagaaagcaatacgcgaaggcttgaaaaatgcgaagaatctgggaagatttgaaatcttagagaaaaacgggaagatgtacatcctcgatggagcgcacaaccctcacggagcggaaagccttgtcagaagcttgaaattgtacttcaacggcgaacccttgagcctggtaataggtattctggacgacaagaaccgggaggacattcttcgaaagtacaccggaatcttcgaaagggtcatagtcacccgtgttccttcacctcgtatgaaagacatgaacagccttgttgacatggcaaagaaattcttcaaaaacgtggaagtcatagaagatcccctggaagcgatcgaatctactgaaagagccacggttgttacaggatcactgtttctagtgggatacgtaagggagttcctgacaaccggaaagataaatgaggagtggaaactatga

SEQ ID NO: 14813 - protein, 430 aa, Thermotoga maritima
MAYLEVLRYLYHKRPMGKVKPGLERISMLLSKLGNPHLEYKTIHIGGTNGKGSVANMVSNILVSQGYRVGSYYSPHLSTFRERIRLNEEYISEEDVVKIYETMEPILNELDKEEIFSPSFFEVVTAMAFLYFAEKNVDIAVLEVGLGGRLDATNVVFPLCSTIVTVDRDHEKTLGYTIEQIAWEKSGIIKERVPLVTGERKREALKVMEDVARKKSSRMYVIDKDFSVKVKSLKLHENRFDYCGENTFEDLVLTMNGPHQIENAGVALKTLEATGLPLSEKAIREGLKNAKNLGRFEILEKNGKMYILDGAHNPHGAESLVRSLKLYFNGEPLSLVIGILDDKNREDILRKYTGIFERVIVTRVPSPRMKDMNSLVDMAKKFFKNVEVIEDPLEAIESTERATVVTGSLFLVGYVREFLTTGKINEEWKL

SEQ ID NO: 14814 - DNA, 1272 bp, Staphylococcus aureus
  CDS (1)..(1272)
atgaattacctagagagcttgtattggatacacgaaagaactaaatttggcatcaaaccaggtgttaaacgtatggaatggatgctagcacaatttaataatcctcaaaataacattaagggtattcatgtaggtggcacaaatggtaaaggctctacagttgcttaccttagaacagctttagttgaaaatggttatgaagtaggtacatttacgtcgccgtttattgaaacatttaatgaacgaattagtctaaatggtgtgccaatatcaaatgacgctattgtagaattagtatcacgtattaaaccagtaagtgaaatgatggaacgtgaaacagatttaggtgttgcaactgaattcgaaataatcacagcgatgatgtttttatattttggtgaaatacatcctgttgattttgtcattgttgaggctggattgggtataaagaacgattcgacaaatgtctttacaccggttttatcaatcttaactagtatcggtctagaccatacagatattttaggtggtacttatctagatattgctagggataaaggcgcgattataaagcctaacgttccagtgatatatgctgttaaaaatgaagatgcattaaaatatgttcgtgaacgcgcaattgaacaacatgcaaagccaattgaattagatagagaaattgttgttgtatcgcaaaatgatgaatttacttaccgttataaagattatgaattagaaacaatcattttaagcatgttaggtgaacatcagaaacaaaatgctgcattagccataacagctcttattgaattaaatgaacaaggattaattgaattagatttcaataagatgatagacggtattgaatcagttcgttggactggacgtattgagcaggtgcatgacaaacctttaatcattttggatggcgcacataattcagagagtatagatgctctaattgatacaattaaacagtaccatgataaagaaaaagtagatattttgttctcagcaataaacggaaaaccgattaacgagatggtcaaacatttaagtttaattgcgcatacgttttatgcaactgaatttgattttccgaaagcgttacgcaaagaagaaattgtaggtagtattgaaaatgatgaaatacaattagtagatgactacgttgaatttataaaaaattatcaaggtgatacattagtaattaccggtagtctgtatttcataagtgaagttaaatcaaaattagactttgaagcattataa

SEQ ID NO: 14815 - protein, 423 aa, Staphylococcus aureus
MNYLESLYWIHERTKFGIKPGVKRMEWMLAQFNNPQNNIKGIHVGGTNGKGSTVAYLRTALVENGYEVGTFTSPFIETFNERISLNGVPISNDAIVELVSRIKPVSEMMERETDLGVATEFEIITAMMFLYFGEIHPVDFVIVEAGLGIKNDSTNVFTPVLSILTSIGLDHTDILGGTYLDIARDKGAIIKPNVPVIYAVKNEDALKYVRERAIEQHAKPIELDREIVVVSQNDEFTYRYKDYELETIILSMLGEHQKQNAALAITALIELNEQGLIELDFNKMIDGIESVRWTGRIEQVHDKPLIILDGAHNSESIDALIDTIKQYHDKEKVDILFSAINGKPINEMVKHLSLIAHTFYATEFDFPKALRKEEIVGSIENDEIQLVDDYVEFIKNYQGDTLVITGSLYFISEVKSKLDFEAL

SEQ ID NO: 14816 - DNA, 1293 bp, Bacillus halodurans
  CDS (1)..(1293)
atgcaaaatgaaaggcaagccattgaatggattcattcttttttaccgtttggaattaagccaggtttacaacgaattgaatggatgttggagaagcttggacacccagaaaaagagttaaacgttgttcatatcggtggaacgaacggaaagggttcaacggttagctttatgcgttgcatgctcaccgaagcaggctacaacgtaggtacgtttacatctccttatattgaacattttagggaacgtattgcttataaaggcgaaccgatcagtagcgaagagcttgtacgaagctgcttaaatattatcgacgtggtcgaagagctcaaaaggacagatttggggagccccacggagtttgaggttattacggtcatagcctttgacttttttgcccgtgtgaaccctgacatcgttctactagaggtcgggcttggggggagacttgactccacaaatattgtgaccccgcttctatcgattattacgtcaattggacacgatcacatgaacgtattggggggaacccttgaaagcattgcttatgaaaaagcggggattattaagccggatattccagccatcgttcatgttaaacaacctgaagcgtttcgggtgattcaggataaggcgaacaaggtgaaagctccgctctttgcttacggaactgatttccactccttgcccaaaagtgtgacaatggataaacagtttttttcatatcaatcacaatcaggtctcaccctatcattagaaacggtaatgaaaggccaccatcaaatagagaatgcaagtatggcgattcaagccatcgaacaattacgatccatgaaacactacgagctctctaatgaccatattgttagggggattaggaacacgacatggattgggcgttttgaaaaaatatctgaagcaccgcttacgtttgtagatggagctcataatgaagaaggcatgaaagcactagccgaattactagcgcttcactttccaacgtataagtatcgctttgtcatggctgtaacgaaagaaaaagagatgaaagctttactggccccttatgttgaccttcccgcttcttttacttttacgacatttgaatttgaacgagctcagaaagcagagcaattgtatgaacaagcgcctgtttataacaaatccatttgtgcagattggaaagtggccattaggcgagaacgagaaagttgtaaagctaatgaaatggttatcatctgcgggtcactttattttatttcaaaagttagggcgtttctgttagagagataa

SEQ ID NO: 14817 - protein, 430 aa, Bacillus halodurans
MQNERQAIEWIHSFLPFGIKPGLQRIEWMLEKLGHPEKELNVVHIGGTNGKGSTVSFMRCMLTEAGYNVGTFTSPYIEHFRERIAYKGEPISSEELVRSCLNIIDVVEELKRTDLGSPTEFEVITVIAFDFFARVNPDIVLLEVGLGGRLDSTNIVTPLLSIITSIGHDHMNVLGGTLESIAYEKAGIIKPDIPAIVHVKQPEAFRVIQDKANKVKAPLFAYGTDFHSLPKSVTMDKQFFSYQSQSGLTLSLETVMKGHHQIENASMAIQAIEQLRSMKHYELSNDHIVRGIRNTTWIGRFEKISEAPLTFVDGAHNEEGMKALAELLALHFPTYKYRFVMAVTKEKEMKALLAPYVDLPASFTFTTFEFERAQKAEQLYEQAPVYNKSICADWKVAIRRERESCKANEMVIICGSLYFISKVRAFLLER

SEQ ID NO: 14818 - DNA, 1284 bp, Lactococcus lactis subsp. lactis
  CDS (1)..(1284)
atgtctatagaagaagcattggaatggatacattcacgtttaaaatttaatattcgcccaggcctaagtcgtgtttcggcccttttagaattgcttggtcatccagaagagtctttgtcaatgattcacgttgctggaacaaatggaaaaggctccacagtcgctttcacacgctcaatctttatgcaggcaggtctgaaggttgcttctttcacaagtcctttcatcaccacttttggtgagcggatgtcgattaatgcactcccgattgctgatgataaattaatttattatgtagaaatgatccaaccacttgttgctgaacttgataaagatgctgaactgactggaattaccgaatttgaaattatcacggcaatggcttttaaatatttctctgatgagcaggttgatttagcggttattgaagttggtttaggtggacttcttgattcaacaaatgtgattaaacctgttgtttctggaattacaacaattggtttagatcatattgatattcttggttcgaccattgaagaaatcgcagctcaaaaggctggaattattaaaccaggaattccagtagttgttggaaatattgaattaaaagcacttcgggttatatgggaagtggctagaaaaaatacagcgcgtgtttatcaatttccatatgattatcgtacggaagtggaagaacacgaacattttaatttcttttctggtcaagaagcaatattggatattgaaaaatctttagttggcttacatcaaatagaaaatgctggtatggctattgaactttctctggtttatgcaagtaaggttgggattgaattgactgaggatgtgattcgctctggaattcgtgaggctttttggccagctcgtatggaaaaattgggtgaaaaaccactcattttactggatggtgctcataatgttcatgcgatgaatcgtttgcttgaaaatcttagctctgagtttccagataaaaaaattacaatcattttttcagccattaccacaaaagatattagtcaaatgataaaaatgcttcaaactgtgaaaaattcgcatctgattttgacaacttttgattatccaaaagctttgaatttgggagattttcaaagattggaagaagaaggggttgaattggctccaagttgggaattagctttagttcgtgcgcaaaaaaatttagctgaagatgatttgttattagttacaggctctctctatttctcatctcaagttcgtgagtttttgaaaaaagagaagtaa

SEQ ID NO: 14819 - protein, 427 aa, Lactococcus lactis subsp. lactis
MSIEEALEWIHSRLKFNIRPGLSRVSALLELLGHPEESLSMIHVAGTNGKGSTVAFTRSIFMQAGLKVASFTSPFITTFGERMSINALPIADDKLIYYVEMIQPLVAELDKDAELTGITEFEIITAMAFKYFSDEQVDLAVIEVGLGGLLDSTNVIKPVVSGITTIGLDHIDILGSTIEEIAAQKAGIIKPGIPVVVGNIELKALRVIWEVARKNTARVYQFPYDYRTEVEEHEHFNFFSGQEAILDIEKSLVGLHQIENAGMAIELSLVYASKVGIELTEDVIRSGIREAFWPARMEKLGEKPLILLDGAHNVHAMNRLLENLSSEFPDKKITIIFSAITTKDISQMIKMLQTVKNSHLILTTFDYPKALNLGDFQRLEEEGVELAPSWELALVRAQKNLAEDDLLLVTGSLYFSSQVREFLKKEK

SEQ ID NO: 14820 - DNA, 1464 bp, Mycobacterium tuberculosis
  CDS (1)..(1464)
atgaattcgacgaattccggcccgcctgactcgggatcggccaccggcgtcgtgcccactccggacgagatcgcgtccctgctgcaggttgagcatctactcgaccaacgctggccggagacccgcatcgatccgagcctgacccggatcagcgcgttgatggacctgctgggctcgccccaacgcagctatccgtcgatccatatcgcgggcaccaacggcaagacctcggtggcgcgcatggtcgacgcgctggtcaccgcgctgcaccggcgcaccggccgaaccaccagcccacacctgcagtcaccggtggaacgcatttcgatcgacggcaagccgatcagcccggcgcagtatgtggcgacctaccgggagatcgagccgttggtggcgctgatcgaccagcagtcgcaggcttctgcgggtaagggtggcccggcgatgagcaagttcgaggtgctcaccgcgatggcgttcgcggcctttgcggacgcgcccgtcgacgtggcagtggtcgaggtgggcatgggcggacgttgggacgccaccaacgtgatcaacgcaccggtcgccgtcatcaccccgatcagcattgatcacgtcgactatctcggtgccgatatcgccgggatcgccggggagaaggcgggcatcatcactcgggcccccgacggttcgccggacaccgtcgcggtcatcgggcgtcaggtcccgaaggtcatggaggtgctgctggccgaatcggtgcgcgccgacgcgtcggtggcccgggaggattccgaattcgcggtgctacggcgacagatcgcggtcggcggtcaggtactgcaactgcagggcctcggcggggtttactccgacatctacttgccgctgcacggtgaacaccaggcgcacaacgcggtgctcgccctcgcttccgtcgaggcctttttcggtgccggtgcgcagcgtcagctcgacggcgacgccgtccgggccggctttgccgccgtcaccagtcccggccggttggagcgcatgcgcagcgcacccacggtgttcatcgacgccgcgcacaatccggccggggcgagtgctctggcacaaacgctggcgcatgagttcgacttccgatttctggtcggggtgctcagcgtgctgggcgacaaggacgtggacggcatcctggccgcactggagccggtgttcgattccgtcgtcgtgacccacaacgggtcgccgcgggcgctggatgtcgaggccctggcgctggcggccggcgagcggttcggacccgaccgggtgcgcaccgccgagaacctgcgcgatgctatcgacgttgccacctcactggtcgacgacgccgccgccgacccggatgtggccggggacgcattctcgagaaccgggatcgtcatcaccggctcggttgtcaccgcaggggcggctcggaccttgttcggtcgtgatccgcaatga

SEQ ID NO: 14821 - protein, 487 aa, Mycobacterium tuberculosis
MNSTNSGPPDSGSATGVVPTPDEIASLLQVEHLLDQRWPETRIDPSLTRISALMDLLGSPQRSYPSIHIAGTNGKTSVARMVDALVTALHRRTGRTTSPHLQSPVERISIDGKPISPAQYVATYREIEPLVALIDQQSQASAGKGGPAMSKFEVLTAMAFAAFADAPVDVAVVEVGMGGRWDATNVINAPVAVITPISIDHVDYLGADIAGIAGEKAGIITRAPDGSPDTVAVIGRQVPKVMEVLLAESVRADASVAREDSEFAVLRRQIAVGGQVLQLQGLGGVYSDIYLPLHGEHQAHNAVLALASVEAFFGAGAQRQLDGDAVRAGFAAVTSPGRLERMRSAPTVFIDAAHNPAGASALAQTLAHEFDFRFLVGVLSVLGDKDVDGILAALEPVFDSVVVTHNGSPRALDVEALALAAGERFGPDRVRTAENLRDAIDVATSLVDDAAADPDVAGDAFSRTGIVITGSVVTAGAARTLFGRDPQ

SEQ ID NO: 14822 - DNA, 1296 bp, Clostridium acetobutylicum
  CDS (1)..(1296)
atgaattacgaagaagctattaactatatacatggttctttaaaatttggtataaatcttggacttgagagaattcttcgacttcttgaaattttagggaatccccataaaaaaataaagtgcatacatgtagcgggtaccaatggaaaaggatcaaccacagcaatgataagccaaattttaattgaagctggatatagggttggaatgtatacctctccatatatagaagaatttgaagaaagaattcaaataaataataataatatatcaaagtatgatttatgcgttataatagaaaaggtaagcgatgcagtagataaattaaaatgcgaaggaattgaaaatccaactgaatttgaaataataacagcagcagcgtttttatatttttgtattaaaaaagtagactatgcagtaattgaggttggactaggaggcagatttgatgctacaaatgttataaaccctatcttaacggttataacttcaattagttatgatcatatggcaattctaggtgatactttgggtaagatagcttatgaaaaggcaggtattattaaggagaaggtccctttagttatgtatccccaacataaagaggcagaagaagttataaaaagagcagctcatgaaaaagaagtaagtataattgacgttaggaaaggtaaagctgaatttatagataatttgcttgaagataataaatattttcaatatatacatattaaaaccttaagagatcagtatgatgtgaagttagctcttcttggaaagcatcagattatcaatgctgtaactgcagttatggctattgaaacgttaaaaaatgtaggagtaaaggtagcaaaagatcatattttaaatggattgtctaaggtaagatggaaaggaagacttgaagttctaaagagtaatccacttgttgttgtagatggagctcataattcagatggaatactaaagcttaaagaaagtataggagttcactttaaatacaaaagattaatacttatacttggaatattagcggataaagaagtaaaaaagatggtagaattaataactaaagatgcatataaaattataacagtttcaccacataataatagagcagaagatgagaaagaattgtgtaaaatggtcaaggtatacaataatgaatgtgaagctgaaaaagattataaaagggcttatgaaaaggctatttcctattataaagagggagatatgattcttatatgtggatcgctttatatgataggagatatgattaaacttattaagagataa

SEQ ID NO: 14823 - protein, 431 aa, Clostridium acetobutylicum
MNYEEAINYIHGSLKFGINLGLERILRLLEILGNPHKKIKCIHVAGTNGKGSTTAMISQILIEAGYRVGMYTSPYIEEFEERIQINNNNISKYDLCVIIEKVSDAVDKLKCEGIENPTEFEIITAAAFLYFCIKKVDYAVIEVGLGGRFDATNVINPILTVITSISYDHMAILGDTLGKIAYEKAGIIKEKVPLVMYPQHKEAEEVIKRAAHEKEVSIIDVRKGKAEFIDNLLEDNKYFQYIHIKTLRDQYDVKLALLGKHQIINAVTAVMAIETLKNVGVKVAKDHILNGLSKVRWKGRLEVLKSNPLVVVDGAHNSDGILKLKESIGVHFKYKRLILILGILADKEVKKMVELITKDAYKIITVSPHNNRAEDEKELCKMVKVYNNECEAEKDYKRAYEKAISYYKEGDMILICGSLYMIGDMIKLIKR

SEQ ID NO: 14824 - DNA, 1302 bp, Rickettsia prowazekii
  CDS (1)..(1302)
atgttaatgccgcattttccgctgcctacctggcaaaatcaagttaaatatgatttagataatattaaaagactattgaaggctttaggtaatccacatttaagtctgcctccagtcatacatatagccggtacaaacggtaaaggttcaagtagtgctatgcttaaaagtatctttacacttgctggttatacggtacattgctatacatctcctcatttattagaatttaatgaacgcatcatagtagcaggcgagaaaatctcagataatgcattatggcaagtttgtgagcatgtacggatagcaagcgaaaaatttaatattgaatctaatttttttgaaggtattacggcagcagcgtttctagcattcgcacaaacaaaagctgatatattaattttagaaacaggacttggtggacgattagacgcaacaaatatatttgagcatcctttaattaccttaattacgcctatttcttatgatcatatgaatgtgcttggtaatacattacacatgatagcagttgagaaagctggtattatgaaagcttgcgtaccttgcgtaatcagtatgcaaaccttagaagtttatgcaacattatttgcaaaagctgaagagctagatgtgcctacattttgctacgaatatgatttcggtattcaaaagacagacaatggatttatttattcgtcacgcaattttacttatgaatttccctctccttcactactcggtgatcatcaattaataaatgctgcaagtgttattgctttaataagtttaataaatcaacaattttatatcaacaacgaaattatctctaaaggactacaaaatacaatttggcaagctaggattgaaaaaatagagccgcaaaaatattctaaattaataggtgagaatgttcaaatttgggtagatgcagctcataataatagtggagctcaagttttagcaaattgggtgcgtgttaatttaaaaacaccgatatatttaatacttggtatgactaaaaatagagatataaaggcattttgctcttactttaatgatttgacaattaaaggttacggtgttaaagttttgtccgaaccgctaagtcatagtgccgcaataataaatttggaaggcagaaagagtggtattgattttactgaaagtgactcacttgaagcagcaattagtgatataaagaaaagaaatggtgataataaaacaaatattataataaccggatcgctttatttagcttccgatttttataagttattatccaattgttatctaacggattga

SEQ ID NO: 14825 - protein, 433 aa, Rickettsia prowazekii
MLMPHFPLPTWQNQVKYDLDNIKRLLKALGNPHLSLPPVIHIAGTNGKGSSSAMLKSIFTLAGYTVHCYTSPHLLEFNERIIVAGEKISDNALWQVCEHVRIASEKFNIESNFFEGITAAAFLAFAQTKADILILETGLGGRLDATNIFEHPLITLITPISYDHMNVLGNTLHMIAVEKAGIMKACVPCVISMQTLEVYATLFAKAEELDVPTFCYEYDFGIQKTDNGFIYSSRNFTYEFPSPSLLGDHQLINAASVIALISLINQQFYINNEIISKGLQNTIWQARIEKIEPQKYSKLIGENVQIWVDAAHNNSGAQVLANWVRVNLKTPIYLILGMTKNRDIKAFCSYFNDLTIKGYGVKVLSEPLSHSAAIINLEGRKSGIDFTESDSLEAAISDIKKRNGDNKTNIIITGSLYLASDFYKLLSNCYLTD

SEQ ID NO: 14826 - DNA, 1458 bp, Mycobacterium leprae
  CDS (1)..(1458)
atgaccgcagagctgcctgactggggatccggacgtcttgaaaccaatgtcgctgctctcacaccggacaaggtcgcctccctgttgcaggttgaacacctgctggaccagcgctggccagagacctgtatcgaaccgagtttgactcggatcagtgcgttaatggatgttctcggctcaccgcaactcagttatccgtcgatacacgtcgctggcaccaacgggaagacctcggtgacgaggatggttgacgcgctgctaaccgcgctgcaccagcgcactggccgctttaccagccctcacctgcagtcggtagtcgaacgcatcgcgattgactcaaaaccgatcagcccggcgcaatatgtagcaacttaccgtgaggttgaaccgtttgtgcagatgatcgatgcccagtcgcagtcctctggggggccggcgctgagcaagttcgaggtagtcaccgcgatggcgttcgccgcgttcgcgaatgcgcccgtcgacatcgcggtggttgaggtgggcctcggtgggcgatgggatgcgaccaacgtgattaatgcatcggtcgccgtgatcaccccggtcagcatcgaccacgtcgagtatcttggcaacgacgttgcagcgatcgcccgcgagaaggcgggcattatcacgaaagctcccgaaggcgcgccagacaccgtcgtggtaatcggtcgtcaggtacctgcggcgatgggggtgctgttggctcaatcggcacatgccggcgctcgagtcgtccgtcaggattcggagttcgcggtcttggaccgtcaggtcgcaatcggtggtcaggtgttgcagctgcaggggcttggtggagtttataatgacatttacctgccgttacatggcgaacaccaggcgcacaacgcggtcttggtgcttgctgcggtcgaggcgttttatggtgccggggtgcagcgccagctcgatgtcgaggcggtgcggtccggtttcgccgctgtcatcagccccggcaggttggaacgcatgcgcagtgccccgacggtgttcatcgacgccgctcacaatcccgccggagcgaatgcgttggcgcgcacgctgtctgacgaatttaatttccgaaccctggtcggggtgctcagcgtgctggcaaacaaggacgttgatggcatcctggccgcactggagctggtgctggattatatcgttgtgactgacaacggctcgccgcgggcgttggatgttgagtcgctggcgttggtggcgcgggagcggttcggccccgaccgggtaatcagcgcggcgaacctgcgtgacgctatcgacgcagcgactgcactggtcgacgacgccgctgccaatgaggaaatcgaagggctcggagtctccggccgtgggatcgtcatcaccggctcggtgatcaccgccggaatcgcacggactttgtttggccgtgacccacaatga

SEQ ID NO: 14827 - protein, 485 aa, Mycobacterium leprae
MTAELPDWGSGRLETNVAALTPDKVASLLQVEHLLDQRWPETCIEPSLTRISALMDVLGSPQLSYPSIHVAGTNGKTSVTRMVDALLTALHQRTGRFTSPHLQSVVERIAIDSKPISPAQYVATYREVEPFVQMIDAQSQSSGGPALSKFEVVTAMAFAAFANAPVDIAVVEVGLGGRWDATNVINASVAVITPVSIDHVEYLGNDVAAIAREKAGIITKAPEGAPDTVVVIGRQVPAAMGVLLAQSAHAGARVVRQDSEFAVLDRQVAIGGQVLQLQGLGGVYNDIYLPLHGEHQAHNAVLVLAAVEAFYGAGVQRQLDVEAVRSGFAAVISPGRLERMRSAPTVFIDAAHNPAGANALARTLSDEFNFRTLVGVLSVLANKDVDGILAALELVLDYIVVTDNGSPRALDVESLALVARERFGPDRVISAANLRDAIDAATALVDDAAANEEIEGLGVSGRGIVITGSVITAGIARTLFGRDPQ

SEQ ID NO: 14828 - DNA, 1284 bp, Saccharomyces cerevisiae
  CDS (1)..(1284)
atggccattgaattgggactttcccgtattacaaaactactagagcatttaggcaatccgcaaaactcacttagagtgctgcacattgcagggacaaatggtaaaggttcagtatgtacttacctatcttctgtgttgcaacaaaagtcctaccaaattggaaaatttaccactccacacttggtgcatgttactgattccattacaatcaacaataagccgattccgttagagagataccagaatattagattacaactagaagctttaaacaagtcacactctttaaaatgtacggaattcgagctattaacatgtaccgcattcaaatatttttatgatgtgcagtgccaatggtgtgtcatagaagtaggccttggcggaagacttgatgcgaccaatgttattccaggcgcaaataaggcatgttgtggtattactaaaatcagtttggatcatgaaagctttttaggtaacaccttgtctgaaatctctaaagagaaagcaggtataataacagaaggggtacccttcacagtgattgatggaaccaatgaggcaagtgttataaatgttgtgaaagaaagatgcaaggctttagggtctgaactatccgttacagattctcaacttaacggaaatatgattgacaccaactcctggggttgttttgacttggcaaaattgccactgaatggagaatatcagatatttaatctcagggtggccatgggtatgttagactacttacaaatgaacgaacttattgatattaccaagaatgaagtaagtacgagattggcgaaggttgattggccaggaaggttatatcgtatggattatcgctttgacaaagtaagtaataggacagtgcctatattaatggacggtgcccacaatggctcagctgcagtagagttagttaagtacctaagaaaggagtacggaaaccagcctttgacctttgtgatggcagtaacgcatgggaaaaacttggagccgctgctccagccattattgaggcctatagatcaagtaattcttactcggtttaataatgtggaaggtatgccctggattcatgccactgatcctgaagaaataaaagattttattttgactcaaggatacacaaaggagatagtgattgaaaatgatttacatcaggtattgccttctctggcgcatgtatcagacgagcaaagacggccaattgttgtatgcggttcactgtatttatgtggtgaattattacggattcacaatagtcacttgagaaactaa

SEQ ID NO: 14829 - protein, 427 aa, Saccharomyces cerevisiae
MAIELGLSRITKLLEHLGNPQNSLRVLHIAGTNGKGSVCTYLSSVLQQKSYQIGKFTTPHLVHVTDSITINNKPIPLERYQNIRLQLEALNKSHSLKCTEFELLTCTAFKYFYDVQCQWCVIEVGLGGRLDATNVIPGANKACCGITKISLDHESFLGNTLSEISKEKAGIITEGVPFTVIDGTNEASVINVVKERCKALGSELSVTDSQLNGNMIDTNSWGCFDLAKLPLNGEYQIFNLRVAMGMLDYLQMNELIDITKNEVSTRLAKVDWPGRLYRMDYRFDKVSNRTVPILMDGAHNGSAAVELVKYLRKEYGNQPLTFVMAVTHGKNLEPLLQPLLRPIDQVILTRFNNVEGMPWIHATDPEEIKDFILTQGYTKEIVIENDLHQVLPSLAHVSDEQRRPIVVCGSLYLCGELLRIHNSHLRN

SEQ ID NO: 14830 - DNA, 1287 bp, Synechocystis sp
  CDS (1)..(1287)
atggatatcaacaccctactggaaccctataaaaccgccggcgttaatctgggtctggagcgcatccatggcctactggccaagttgggcaatccccaggcaaaagtgccctatgtccatgtggggggcaccaatggcaagggatcggtgtgtgcctatctgtccagtgtgttggcggaagcgggctataaggtgggccgctacacttctccccatttaattgattggcgggaaagggtttggcttgataaccgtttcattgatgacgctagtttaatcggggcattgcaacaagtaacggcgatcgccccggcggatagttctgatcgcccgactttgtttgaggtgtttactgcggcggtgtggctttattttgcccaggcagaggtggacatcgcggtgatggaagtggggctggggggcagactggatgctaccaacgtcccagaaccttgtttgcttagcattattacctctttaagtcgggaacattggcaggttttggggccaaccgtagctcacattgccagggaaaaagctggcattctcaaagcccagaggccagtatttttaggcaacattcccccagaagcgcaggcagtttttcaagaacgcattgccgaattacattgccccgattattgggttacccccgccattgccacggaaaaaaatggtcaaccctgggctagttggcaaggttttgaatatcccctggtcctattgggagattttcagctacaaaactcggccctggcgatcgccgctttgcaggaattaaaacaccagggttgggataaattaacaccggaggttatccaacggggcatgggtaaagctgtctggcctggacgattgcagtgggtggactacaacggacaaaaaatccttttagacggggcccacaatccggcggcggccaaagctctggcaaactatacccatgggttagttgatcaatcggataattacctgcccaccattacctgggtgatgggtatgctcagcaccaaggaacatgaccaaatttttcagcatttacttcgtcccggcgatcgcctgttattagtgccagtgccggaccatgacagcggggatttaccaacgttggagcagttagcctggcagattatgccggatttaaaagaggttacactgtttgatgattgttttacagccttggaaagtttagagaaaaccaacgaaaattctgaacaattgactgttctctgtggttccctttatttagtgggctactttttaaaaagattacagtcttcccactaa

SEQ ID NO: 14831 - protein, 428 aa, Synechocystis sp
MDINTLLEPYKTAGVNLGLERIHGLLAKLGNPQAKVPYVHVGGTNGKGSVCAYLSSVLAEAGYKVGRYTSPHLIDWRERVWLDNRFIDDASLIGALQQVTAIAPADSSDRPTLFEVFTAAVWLYFAQAEVDIAVMEVGLGGRLDATNVPEPCLLSIITSLSREHWQVLGPTVAHIAREKAGILKAQRPVFLGNIPPEAQAVFQERIAELHCPDYWVTPAIATEKNGQPWASWQGFEYPLVLLGDFQLQNSALAIAALQELKHQGWDKLTPEVIQRGMGKAVWPGRLQWVDYNGQKILLDGAHNPAAAKALANYTHGLVDQSDNYLPTITWVMGMLSTKEHDQIFQHLLRPGDRLLLVPVPDHDSGDLPTLEQLAWQIMPDLKEVTLFDDCFTALESLEKTNENSEQLTVLCGSLYLVGYFLKRLQSSH

SEQ ID NO: 14832 - DNA, 1254 bp, Schizosaccharomyces pombe
  CDS (1)..(1254)
atgcctattcagctaggtcttcagcgtatgctacagctcttgaagcaccttggcaatccacaggaatcgttttgtgctgtacaaattgctgggactaatggtaaaggtagcatttgtagctatatatacacgagtcttttgcaagctgctattaaaacaggacgctatacaagtcctcatttcttagagccaagagataccataagcataaatggtcagattgctagtgaagagatatttaatacttgttggaagcaggtgattgaagtggatagaagatttcgtacaaaagcgacggaatttgaattgttaactgctactgcgttccaatgttttcatcattcaggtgttcgtgtggctgtaattgaaacaggaatgggtggtcgtttggatgctactaatgtatttgaagaaccagttctttcaataatttcacgtatttgcttggaccatcaagcatttttaggaaataccttagaggctattgctaaagaaaaggctgggatctttaaaaagaatgttccgtgcgtggttgatgggttaaatgaagttaacgtcctaaatcaattaaaattaagtgcagaggaaacgagggcacatccgttttatttggcaaaaggaaaatcaggtgaaaacaaaaatgagtggatcatcaatactccaaattggggaaccaatacttttagtactccattgaagggggattatcaaggacaaaatttggcttgtgcagtaactgctctcgatatcctttcttcgtcattttcaattatgcttccccatgtacaaaatggtgtaaaaaatacatcttggcctggaaggcttgacattcgttcggttccttctttgggtgatattttatttgacggagcacacaataaagaagctgcgattgagcttgcgaaatttgtaaattcgcaaagacgtgagcacaataaatcagtatcatgggtagtagctttcactaacacaaaagacgttactgggattatgaaaatccttcttcgtaaaggagataccgttatagcgacaaatttttcttcagtaagtgggatgccctggattaaatcaatggaacctgaagttataaaaaacagtatatcttcggaatcttctgtggaatgctatactgcagataatctaacaataagcgaaattttaagactggcaaaagagaagaattccagcgtaattgtatgcggtagtctttatcttctaggagacatgtatcgttatttaaaactggacgtatag

SEQ ID NO: 14833 - protein, 417 aa, Schizosaccharomyces pombe
MPIQLGLQRMLQLLKHLGNPQESFCAVQIAGTNGKGSICSYIYTSLLQAAIKTGRYTSPHFLEPRDTISINGQIASEEIFNTCWKQVIEVDRRFRTKATEFELLTATAFQCFHHSGVRVAVIETGMGGRLDATNVFEEPVLSIISRICLDHQAFLGNTLEAIAKEKAGIFKKNVPCVVDGLNEVNVLNQLKLSAEETRAHPFYLAKGKSGENKNEWIINTPNWGTNTFSTPLKGDYQGQNLACAVTALDILSSSFSIMLPHVQNGVKNTSWPGRLDIRSVPSLGDILFDGAHNKEAAIELAKFVNSQRREHNKSVSWVVAFTNTKDVTGIMKILLRKGDTVIATNFSSVSGMPWIKSMEPEVIKNSISSESSVECYTADNLTISEILRLAKEKNSSVIVCGSLYLLGDMYRYLKLDV

SEQ ID NO: 14834 - DNA, 1341 bp, Candida glabrata
  CDS (1)..(1341)
atgtcaatcaggcttggtcttggaaggattggtagactgcttgaatttataggtaatccacatcagcatttgaaagtattacacatagctggaactaacggtaagggttctgtctgtacatacttatcaacagtactacaacaacagaggacacattttcgcgttggcaagtttactaccccacatcttatccatgttacagaatcgatatcaattaacgatcaacctatacccaactcccaatacttgtcgataagaaatcaacttgatatcttgaatagtgagcatcgattagggtgtaccgaatttgagctactgacatgcaccgcgctacaatatttcaaagagatggaatgccattggtgtgtagtagaagtcggattaggggggcgtgaagatgcaacaaatataattccaggatcattcaaactatgttgtggtataactaaaataggtttggatcatgaaagtttcttaggaaatacattggaagagatagcaagagaaaaggccggtattattactgaaggtgtagagtgtgctgttatagatggctctaacgataaaactgtcctagataaagtgaagcagcattgcgaaagtatgcactgcaaactcattatcactgaaggttcaatgaattcccatactgttcgtactgctgcatggggaacaattgaatttaatcaaaagcttccattaaatggagaatatcaaatttttaacctacgagtagcactagctatacttgatgagttacaaagatctaaatatataaatgttagccgacaagaacttgttgcaggtctagatcaagttcaatggccaggccgtcttcatgatttagatttttgtttccttttatcagagggtgatgatagaaaaaaacttacattccctgtattaatcgatggggctcataacgccagtgcagcaattgagctttccaaacacttacgtaagcaatttggagataaaccattgacatttgtaattgcagttacagctgggaaaaatctgaatacactactcagacctttactccgagcccaagatcgagtaattgccacgaaattcagctctgttgatgggatgccatggatccaaccaacagatcctaaagacttgagctcatttataaaaagcaaattcaccaccaactgtatttcagagaatagtttatgcgatgtatttaatttactatctgaggaatattaccataatgatgcctctgaaataagtccagtaattgtatgcggctcactttatttatgtggtgagctgttaagaatgcacaagagaaattcgcaaactaagggcactaatgcagaaagctcatga

SEQ ID NO: 14835 - protein, 446 aa, Candida glabrata
MSIRLGLGRIGRLLEFIGNPHQHLKVLHIAGTNGKGSVCTYLSTVLQQQRTHFRVGKFTTPHLIHVTESISINDQPIPNSQYLSIRNQLDILNSEHRLGCTEFELLTCTALQYFKEMECHWCVVEVGLGGREDATNIIPGSFKLCCGITKIGLDHESFLGNTLEEIAREKAGIITEGVECAVIDGSNDKTVLDKVKQHCESMHCKLIITEGSMNSHTVRTAAWGTIEFNQKLPLNGEYQIFNLRVALAILDELQRSKYINVSRQELVAGLDQVQWPGRLHDLDFCFLLSEGDDRKKLTFPVLIDGAHNASAAIELSKHLRKQFGDKPLTFVIAVTAGKNLNTLLRPLLRAQDRVIATKFSSVDGMPWIQPTDPKDLSSFIKSKFTTNCISENSLCDVFNLLSEEYYHNDASEISPVIVCGSLYLCGELLRMHKRNSQTKGTNAESS

SEQ ID NO: 14836 - DNA, 1320 bp, Bartonella quintana str
  CDS (1)..(1320)
atgaaaaaaaaccaagtacaaagaatagtagatggtttactaaaaaactatccgaaaaaatttgatctttctttagagcgtattttacgtcttttaaaaagcattggtagtccacatttaaagcttgcacctattattcacattgctggaacaaatggaaaaggatctgcttcagctatttgtcgcgctcttttggaaagtgcaggctaccgtgttcatgtctacagctcacctcatctggttaactggaatgaacgttgtcgactagggcaaacaggaagcggacaacttgtcacagaggaactattagccgaaacaattcatcaagttgtaaaagcgaatgatcaaaaacccatcactgtgtttgaaattctcaccgcagctgcctttatactgtttagcacacatccagctgattgtgttattttagaagttgggttaggaggacattttgatgctacaaatgtgattaacaagccagctgtatcccttatcatgcctattgactatgatcacgaaacctttcttggaaaaacaattgcacaaatcgcttttcaaaaagggggaattataaaaccgcaagtcccagtggttatcggtaagcaagagcatgatgaaaccctttctgttttaacgacccttgctgataaaaataaagcaccttattccttatttgagcaagattatcaaagctatacagaacatggacatatggtctttcaaaacaatcaaggtctcataaatcttccacttcctaacctgattggaatgcatcaaattgccaatgctggagcttctcttgaagcaatttatcaagcaggttttcgactttcagaacaagcaattagtcatgctttgcaaaatatttactggccagcacggatgcaacatcttacccatggaaatttagttgatcaaatgtctcctggtattgatttatggttagatggcggtcacaatcccgctgctggaaaagttgttgcggcagaacttattcaatggaaaaaaaaatcaaaccgtcctattattatgattgccagtatgctcaataccaaagatactgtcggctattttcgccctttagcaaaccttgtcgataaagtttatacgattccgttgatcgacaacaacgcaagtctttgtccaacgattttagctgaatcagcgagaaaagtagggcttcttgccaacccgcaagcacatcttcaagaggccttacagagaattaacacagagtatagagaagcaatcgtcctcataggtggttctctttaccttgcgggtgatattttacgtgacaataaaacaccgccatgttag

SEQ ID NO: 14837 - protein, 439 aa, Bartonella quintana str
MKKNQVQRIVDGLLKNYPKKFDLSLERILRLLKSIGSPHLKLAPIIHIAGTNGKGSASAICRALLESAGYRVHVYSSPHLVNWNERCRLGQTGSGQLVTEELLAETIHQVVKANDQKPITVFEILTAAAFILFSTHPADCVILEVGLGGHFDATNVINKPAVSLIMPIDYDHETFLGKTIAQIAFQKGGIIKPQVPVVIGKQEHDETLSVLTTLADKNKAPYSLFEQDYQSYTEHGHMVFQNNQGLINLPLPNLIGMHQIANAGASLEAIYQAGFRLSEQAISHALQNIYWPARMQHLTHGNLVDQMSPGIDLWLDGGHNPAAGKVVAAELIQWKKKSNRPIIMIASMLNTKDTVGYFRPLANLVDKVYTIPLIDNNASLCPTILAESARKVGLLANPQAHLQEALQRINTEYREAIVLIGGSLYLAGDILRDNKTPPC

SEQ ID NO: 14838 - DNA, 1320 bp, Bartonella henselae
  CDS (1)..(1320)
atgaaaaaaaaccacgtgcaaaggataatcgatgatttactgaaaaactatcctaaaaaatttgatctttctttagagcgtatccttcgtcttttagaaagccttgataatcctcatttaaagcttgcacctgttattcatattgctggcacaaatggtaaaggatctgcttcagctatttgtcgtgctcttttggaaagcgcaggctaccgcgttcatgtctatagctcacctcatctggttaattggaatgaacgctgccgaatcggtcaaagagaaggtgggaaacttgtcacagaagaacaattggctgaaacaattcagcaagttgtcaaggcgaacggtcaaaaattaattactgtttttgaaatttttactgctgctgcctttatactgtttagcacacatccagctgatgtcgtgattttagaggttggtttaggaggacgttttgatgctacaaatgtgattaaaaagccagctgtatcccttattatgcccattgattatgatcatgagacctttcttggaaacacaatttcacaaatcgcttttcaaaaagggggaattatcaaatcgggagttcctgtggttatcagtaaacaagatcatgatgaaaccctttctactttaataacccttactgataaaaataaagcaccttattttctgtttgatcaagattatcaaagttatacagaacacggacgtatggtctttcaaaacaatcaaggtctcatggatcttccattgcctaacctgattggagcgcatcaaattgccaataccggagcttcccttgaagcaatttatcaagcaggttttcaactttcagaaaaaacaataagtcacgcgctgcaaaatatttactggccagcacgaatgcaacatcttacccatggaaatttggttgatcagatgtctcctggtattgatttatggttagatggcggtcacaatcccgctgctgcaaaaattgttgcagcagaacttacgaaatggaaacaaaaatcaaaccgtcctattattatgattgttggtatgctcaataccaaggatgctgtcagttattttcgtcctttaacaaaccttgtcgatacagtttatacgatcccgttgatcaataacaacgcaggtatttgtccaacgattttagctgaagcagctagaaaagtaggacttcctgctaacccgcaagcccatttccaagaagccttacagagaattaacgcagagcataaagaggtaattgtcctgataggcgggtccctttatcttgccggtgatattttacgtgacaacaaaacaccaccatgttag

SEQ ID NO: 14839 - protein, 439 aa, Bartonella henselae
MKKNHVQRIIDDLLKNYPKKFDLSLERILRLLESLDNPHLKLAPVIHIAGTNGKGSASAICRALLESAGYRVHVYSSPHLVNWNERCRIGQREGGKLVTEEQLAETIQQVVKANGQKLITVFEIFTAAAFILFSTHPADVVILEVGLGGRFDATNVIKKPAVSLIMPIDYDHETFLGNTISQIAFQKGGIIKSGVPVVISKQDHDETLSTLITLTDKNKAPYFLFDQDYQSYTEHGRMVFQNNQGLMDLPLPNLIGAHQIANTGASLEAIYQAGFQLSEKTISHALQNIYWPARMQHLTHGNLVDQMSPGIDLWLDGGHNPAAAKIVAAELTKWKQKSNRPIIMIVGMLNTKDAVSYFRPLTNLVDTVYTIPLINNNAGICPTILAEAARKVGLPANPQAHFQEALQRINAEHKEVIVLIGGSLYLAGDILRDNKTPPC

SEQ ID NO: 14840 - DNA, 1302 bp, Bacillus anthracis str
  CDS (1)..(1302)
atgatacatacatacgaagaagcgatagggtggattcatagccgattgaaatttggtattaaaccgggattagaaagaatgagatggatgctagaagagctcggaaatccagagcgccacataaaatgtgttcatcttgctggtacaaatggaaaaggttcaacgttaacatatatgcgctacatgttagaagacgcaaaatataaggtaggaacatttacctcaccttatattgaaacatttaacgagcgtattagtgtgaacggaacaccaattgcagatgaagagattactgaacttgtaaagatggtaaagccagtcgttgaaaaactagacgagacggatttaggggaagcgactgagtttgaaattattactgttatggcaatttgttatttcggtaaagttaatttctgtgatgttgttttatttgaaacaggacttggagggcgttttgactctacaaatgtgattcatcctgttctcacgattattacgaatatcggccacgatcatatgcacattttaggtaatacactaggagaaattgcatatgaaaaggcggggattattaagtctggtgttccggttattactggtgtgcaagatgaggaagcgttgcaagtcattcaaaaagttgcaaaggaaaatcgtgcaaacttatatgagatgggcaaccattttacagcgttacataaacagtctagtgaaaatggcgaacagtttgatttcacttgtcctttcgcctcttttgaagatgtgcggatcgcaatgaaaggcagccatcaagtaggaaacgcagcacttgcacttatggcagtcatgtatgtaaaaacatacttatcatttttaattgaggaagaagaaataagaactggattacaggaagcgtattgggtagggcgctttgaaaaattgcaaagtaatccagatattattatagatggtgctcataacccagaaggtattgaaagccttgtgaaaacggtagaatcacattacaaagataaaaacgtaatagttttatttactgctcttggtgataaacaattgcataatatggtaggtcaattagaaaccattgccgatgaaattatttttacaacattcgcctttgatcgtgctatttcagcaggcgagcttgcgtcgtatgcaaagaaagagtcaaaattagtttttgaaaattggaaagaggcaattgatacgaaggttgaaatgattggagaaaatgatgtttttatcataacaggttctctttatttcatttcggaagttcgaaaatatattcgcgagaaaaactag

SEQ ID NO: 14841 - protein, 433 aa, Bacillus anthracis str
MIHTYEEAIGWIHSRLKFGIKPGLERMRWMLEELGNPERHIKCVHLAGTNGKGSTLTYMRYMLEDAKYKVGTFTSPYIETFNERISVNGTPIADEEITELVKMVKPVVEKLDETDLGEATEFEIITVMAICYFGKVNFCDVVLFETGLGGRFDSTNVIHPVLTIITNIGHDHMHILGNTLGEIAYEKAGIIKSGVPVITGVQDEEALQVIQKVAKENRANLYEMGNHFTALHKQSSENGEQFDFTCPFASFEDVRIAMKGSHQVGNAALALMAVMYVKTYLSFLIEEEEIRTGLQEAYWVGRFEKLQSNPDIIIDGAHNPEGIESLVKTVESHYKDKNVIVLFTALGDKQLHNMVGQLETIADEIIFTTFAFDRAISAGELASYAKKESKLVFENWKEAIDTKVEMIGENDVFIITGSLYFISEVRKYIREKN

SEQ ID NO: 14842 - DNA, 1308 bp, Picrophilus torridus DSM 9790
  CDS (1)..(1308)
atggataatattttaaactatctttacgaattaaagcgtgagggtataaagcttggccttgatacaaccagggcctttgcagaacatcttggcaatccacaggataaatataaaaagatacatattgcaggaaccaatggaaagggttcaatatcaagctacatatataatatattaaggcagagatataatacaggattatacacgtcaccacatcttataaaatttaacgagagaattatatttaataaggaaatgatcagcgatgattatataataaattttatctctgaaaacagggactatatagataagctatcaaaaataaaaatgaatccaacattttttgagacaacaacagtcatggcctttaagtatttttatgatatgcatgctgattatgctgcaatagaggttggccttggcggccgtcttgattcaacaaacattataattccggagataagcataataggccagataggttacgagcactaccagaagcttggctgctcgcttacatccatagcatatgagaagggtggtataataaagcccggaatacccgttgtcctgcaggataaaaagcctgaggttctggcagagataaaaaaattatcacaggtgagaaaatcaaaattgatactatccgaggattactcaaaaagcacggagcctgagctatacaattttaagatggtctttgatttaaaaacgccgttaaacgagtatcatatagaatcaaataatctggggctctaccaggtaaaaaatataaaaacggccgttgcagcactggaaaacatggatacaagtataaataagcatgatgttgaaagcggtatagataaggccatatggcatggcaggatggagatcataagggcatccccgctggtaataatagactctgcacataatccgccagcagcaagcaatctggtaccatcgttcaaaaaattcataaaaaagaagccgcttttgttaattggcatgctttctgacaaggacgtcttttcatttttaacaattatgaggcagctatcagataaaatagttttaacaatgccgaatgagccggacagggccctggacccggataatataaaggatattgcatcatcaatatacagggatgtaaagataataaaggaccctttatcggcgtatgattactcattaaaaaacagtgactgcgttcttgtctgtggatcaatgtatttaataggcgatataatgtcaagggaaaaggttggcatccttccatttatagatattggtaaaaaaatcagtaaagaaattggttaa

SEQ ID NO: 14843 - protein, 435 aa, Picrophilus torridus DSM 9790
MDNILNYLYELKREGIKLGLDTTRAFAEHLGNPQDKYKKIHIAGTNGKGSISSYIYNILRQRYNTGLYTSPHLIKFNERIIFNKEMISDDYIINFISENRDYIDKLSKIKMNPTFFETTTVMAFKYFYDMHADYAAIEVGLGGRLDSTNIIIPEISIIGQIGYEHYQKLGCSLTSIAYEKGGIIKPGIPVVLQDKKPEVLAEIKKLSQVRKSKLILSEDYSKSTEPELYNFKMVFDLKTPLNEYHIESNNLGLYQVKNIKTAVAALENMDTSINKHDVESGIDKAIWHGRMEIIRASPLVIIDSAHNPPAASNLVPSFKKFIKKKPLLLIGMLSDKDVFSFLTIMRQLSDKIVLTMPNEPDRALDPDNIKDIASSIYRDVKIIKDPLSAYDYSLKNSDCVLVCGSMYLIGDIMSREKVGILPFIDIGKKISKEIG

SEQ ID NO: 14844 - DNA, 1329 bp, Rhodopseudomonas palustris
  CDS (1)..(1329)
atgagcgaaggctccgcgcccccggctccgctcggcgagttacgctcgcgcctgacgcagctgcatccggtcgcgatcgacctcacgctcggtcggatcgagcggctgctcgcggcgctcggccatcctgaacgcaagctcccgccggtgatccatgtcgccggcaccaacggcaagggctcgaccgtcgcgtttctgcgcgcgatcctggaagccaccgagctcaaggtccacgcctacacctcgccgcatctggtccgcgtcaacgagacgatccggatcgccggccggctggtcggcgacgaccagctgctgacggcactggcgcattgcgaacgcgtcaacgccggcgcgccgatcacgctgttcgagatcgagaccgccgccgcattgtggctgttcgcgcagcatcctgccgacgtcacgctgctggaggtcgggctcggcggccggctcgacgccaccaatgtgatcgagcatccgctcgcttgcgtgctgacgccgatcggcatcgaccacaccgagtttctgggcccgaccatcgccgacatcgccgccgagaaggccggcatcctgcgccgcggcgcgccggtgatcgtcgccgagcagcgcgacgaggcgatggaggtgatcgaacgcgacgccaagcggctgcgcgcaccgctgttcgcctgcggccagcaatggcacgttcagctcgaacacggccggctcgcctatcaggacgaacgcggcctgctcgatctcactgcgccgaagctgttcggccggcatcagatcgacaatgccggcctggcgatcgcgacgctgcgcgcgcagtcgcggtttacgatcccgcaggacgcctaccaggccggactgctggcagcggagtggccggcgcggatgcagaggatcacgtcgggcaaattgctcgacgacgcaccggccggctgcgagctgtggctcgacggcggccacaatgcggacggcggacgcgtcgcggccgcggcgctcggcgatctggaagaacgggtgtcgcggccgctggtgctgatcgccggcatgatggccaacaaggatgcagccgcgtttctcgccaacttcaccgggctgacgcggcacctgatcgcggtgtcgatcccgaaccgcgacggcgcgatgccgccggaacgcctcgccgacgcaggccgcgcgctcggcctgcgcgtcgaactggccgacgatgtccgggcggcgttgcggcgcatcgcgtcgctggcctacgaactcccgccgcggatcctgatcaccggatcactgtatctcgcgggccacgtgctgagcctcaacggtacaccgccgaattag

SEQ ID NO: 14845 - protein, 442 aa, Rhodopseudomonas palustris
MSEGSAPPAPLGELRSRLTQLHPVAIDLTLGRIERLLAALGHPERKLPPVIHVAGTNGKGSTVAFLRAILEATELKVHAYTSPHLVRVNETIRIAGRLVGDDQLLTALAHCERVNAGAPITLFEIETAAALWLFAQHPADVTLLEVGLGGRLDATNVIEHPLACVLTPIGIDHTEFLGPTIADIAAEKAGILRRGAPVIVAEQRDEAMEVIERDAKRLRAPLFACGQQWHVQLEHGRLAYQDERGLLDLTAPKLFGRHQIDNAGLAIATLRAQSRFTIPQDAYQAGLLAAEWPARMQRITSGKLLDDAPAGCELWLDGGHNADGGRVAAAALGDLEERVSRPLVLIAGMMANKDAAAFLANFTGLTRHLIAVSIPNRDGAMPPERLADAGRALGLRVELADDVRAALRRIASLAYELPPRILITGSLYLAGHVLSLNGTPPN

SEQ ID NO: 14846 - DNA, 1317 bp, Onion yellows phytoplasma
  CDS (1)..(1317)
atgattactgaaataactaacataaaagaagctattttgtggattgaaaaaagagaaattttaggcatgcgtttaggacttttgcgtgttttggctttgttaaaattattacatcatcctgaaaaaaaattagctatgattcatattgcaggtactaacggcaaaggttcaactgttaattatttaagttctttattgcaacaaagttgttccaaagtaggaacttttatttctcctcatattcaaaattacaatgaaagaattaaaattaatggcgagactatttcttgtaatgatttaataatttgggttcgtaaaattaaaaagttagtagaccaagcaagtcccaattctgctttatttagcattactccgtttgaaattatcaccgctattgcttttgattatttttatcataaaaaagttgatgtttgtgtaattgaagtaggtttgggaggtcttttagacagtaccaatgttatttatcccatcctaactggaattactaccattggcaaagatcacgaacatattttaggaaaaactcttaaagaaattgcttttcaaaaagcaggaattattaaacccaaaattcccttagttacaggaaatatttctccaaaagctttgttagttattgaacaacaagccatcaaaaacaaaactcccatttataaattcaaaaaagattacaacataacttatttaggaatgcaaacttggcaagaatgttttaattttaaaacaaaacaaatcacaataaaagccatcaaaactcctttaataggaaaatatcaacctgaaaatgctgcaatggcaatcaaactttattatttattttgtcagctgaaaaaatttcctttcttagaacaaaatgtttttacaggcattagcaaaactcaaattccagccagaatgcaaaaactaaattcaaatcctttaattattttagatggtgctcacaatgtgcatgccataagaaaattagtccaaacaacaatcaaacaatttagtaactaccgcatttctattttattttctgctttggaaaacaaaaatgtagtttctatgttgtaccaattattaaaaattcccaaagcccacatttatttaacaacttttaatcatccaaatagtattgaattagtacaaaaatatttgtttattgctccacaaagaattacaaaagtttttgattggcaagacaaattgaaggattttttacaacaaaaccaaactcaaaattgtaaagatttattgttaattataggctctctatattttgcctcagaagtaattcatttttttgatatttaa

SEQ ID NO: 14847 - protein, 438 aa, Onion yellows phytoplasma
MITEITNIKEAILWIEKREILGMRLGLLRVLALLKLLHHPEKKLAMIHIAGTNGKGSTVNYLSSLLQQSCSKVGTFISPHIQNYNERIKINGETISCNDLIIWVRKIKKLVDQASPNSALFSITPFEIITAIAFDYFYHKKVDVCVIEVGLGGLLDSTNVIYPILTGITTIGKDHEHILGKTLKEIAFQKAGIIKPKIPLVTGNISPKALLVIEQQAIKNKTPIYKFKKDYNITYLGMQTWQECFNFKTKQITIKAIKTPLIGKYQPENAAMAIKLYYLFCQLKKFPFLEQNVFTGISKTQIPARMQKLNSNPLIILDGAHNVHAIRKLVQTTIKQFSNYRISILFSALENKNVVSMLYQLLKIPKAHIYLTTFNHPNSIELVQKYLFIAPQRITKVFDWQDKLKDFLQQNQTQNCKDLLLIIGSLYFASEVIHFFDI

SEQ ID NO: 14848 - DNA, 1290 bp, Listeria monocytogenes str
  CDS (1)..(1290)
atgacattaaattcgtatgaagaagcattagattggattcacggaacgcttcgtctaggaataaagcctggactagctcgtatggagtatatgatggaaaagctaaatcatccggaaaaagcgaataagtgggtacatattgctggaacaaatggaaaaggctcaacacttacttttgttagaaatgctctagaagaagctggatatagaacgggaaccttcacttcaccatacattgaagtttttaatgaacgaattagtattaatggtgaaccgattagcgatgaaatgatcgtttcattagctaaccgaattaaacctattgcggaagagctagaaaaaactatttatggaccaccttcagaatttgaaattattacagctatgatgtttttatgctttgcggaatatgtttccattgatattggtattatcgaagtaggactaggcggaagactggactctacgaatattctagtgccactaatttctgtaattaccacgattgggatggatcatatggaattccttggggatacaatcgagcaaattgctagtgaaaaagctggcataattaagccaggaataccagttgtttcaggtgctatacaaaaagaagctcaagaagttatagctaagatagcaaaaaagaataaatccaatgttgctcaattaaatgagacttttttcatgcataatgaaaatggaaatataacttataaaactatatatggagaagaaataagcaatctttccattgggctgcttggtcttcatcaattgaataatgcggcggtagctattaaagtattacagtacttaaatacattttctacctttgaaattggtttggcggcaattaaaaaaggcttggaaaaagcattttggccaggaagaatggagaaaatcatttcaaatccatttattatgctggatggagcgcataatccagaaggtattaaaacattcgctcattccatccaaaagtattctgggcctaagaaaataatcgtgagtatattagctgataaaaactatcaagaaatgttaggaatgttaaagtccattcccaatacagaaataatactaactacttttgattatcctagagctatgatggcggaagaagtaatacaaataggaaaaaatgaaggtatttctttgaacccagattggcagcaagtattaggtaatctttacgaaacggagactaatacgaaaatctttattacaggatcgctttatttcatttcagaagtgcggaaatatttgttggcctcaaaacgttaa

SEQ ID NO: 14849 - protein, 429 aa, Listeria monocytogenes str
MTLNSYEEALDWIHGTLRLGIKPGLARMEYMMEKLNHPEKANKWVHIAGTNGKGSTLTFVRNALEEAGYRTGTFTSPYIEVFNERISINGEPISDEMIVSLANRIKPIAEELEKTIYGPPSEFEIITAMMFLCFAEYVSIDIGIIEVGLGGRLDSTNILVPLISVITTIGMDHMEFLGDTIEQIASEKAGIIKPGIPVVSGAIQKEAQEVIAKIAKKNKSNVAQLNETFFMHNENGNITYKTIYGEEISNLSIGLLGLHQLNNAAVAIKVLQYLNTFSTFEIGLAAIKKGLEKAFWPGRMEKIISNPFIMLDGAHNPEGIKTFAHSIQKYSGPKKIIVSILADKNYQEMLGMLKSIPNTEIILTTFDYPRAMMAEEVIQIGKNEGISLNPDWQQVLGNLYETETNTKIFITGSLYFISEVRKYLLASKR

SEQ ID NO: 14850 - DNA, 1290 bp, Wolbachia pipientis wMel
  CDS (1)..(1290)
atgatatatatgcctcattggcctaagccacttggtagcaggccgaatgatttttctcttgatcgcataaaaggctttcttagcaaactagataaccccgagaaaaaagtgcctcccgtaattcatatagctggaactaatgggaaaggctcaacactagcatttataagatatataatgcaagcagcagggtataaggtacacgcatacacttctccacatttagtgagttttaatgagaggatagtgatagccggcagctatatcgacgataatgaattatatagcttattagaagaatgtcgtgcagtaattgcagaacaacctatcactctgtttgaagctgcaactattgcagcttttttagctttttctcgtcataaagccgatataactttagttgaagtgggtatgggtggaaggcttgatgcaacaaatgttatagataatccgattttaacaataattacttccattgcacttgatcatacggaatatcttggccctactgtagaaattatagcaggtgaaaaggctggaataatgaaacctaatgttccttgcgtaatagcaccgcaagaaaaatctatagtgaacacgctagaacaccacgcaataaataagaaatctcccttgtatagaggaggtcttgaatggaattgcaaaaaaaagaacaacaaaatggtttttcaatcagctattcaatcaatagaatttcctttgccatctttaaagggtgatcatcaggtgattaatgcaggcaatgctattgcagcatgtagtattttaagtggaaagtatgaatttgatattggagaagaggatatcacttcaggtttacagtgcacttattggcctgcacggctagagtctataaaagaaggtaatttaattttcctactaccgaaagattggcaattatttttagatggtgcacacaataatgatggtgctagagtactatctcagtgggtaaaagataattttgctgaaggtatttatatggtttttggtgttactagtaacagaaatgtggaagagttcttagagcacttaaagccatatatcaagctactatgtgcggtttgtgttaagtctgaacctaaagcaacaaatacaagtttgattagggaaaaagccaataacataggaataaaagcagttgaatgtgaatcaattggcgatgcaatatcaaatcacatattaaaagcctctacccaaaacgtcaaaaccatactaatctgtggctcattgttcctagctagagacttcgctatggagaatagctaa

SEQ ID NO: 14851 - protein, 429 aa, Wolbachia pipientis wMel
MIYMPHWPKPLGSRPNDFSLDRIKGFLSKLDNPEKKVPPVIHIAGTNGKGSTLAFIRYIMQAAGYKVHAYTSPHLVSFNERIVIAGSYIDDNELYSLLEECRAVIAEQPITLFEAATIAAFLAFSRHKADITLVEVGMGGRLDATNVIDNPILTIITSIALDHTEYLGPTVEIIAGEKAGIMKPNVPCVIAPQEKSIVNTLEHHAINKKSPLYRGGLEWNCKKKNNKMVFQSAIQSIEFPLPSLKGDHQVINAGNAIAACSILSGKYEFDIGEEDITSGLQCTYWPARLESIKEGNLIFLLPKDWQLFLDGAHNNDGARVLSQWVKDNFAEGIYMVFGVTSNRNVEEFLEHLKPYIKLLCAVCVKSEPKATNTSLIREKANNIGIKAVECESIGDAISNHILKASTQNVKTILICGSLFLARDFAMENS

SEQ ID NO: 14852 - DNA, 1458 bp, Mycobacterium paratuberculosis
  CDS (1)..(1458)
atgagcgagccgcccgactgggcgccggagcacgacgttcccgacccggtccccaccccggacgagatcgccgcgctgctgcaggtcgaacacctgctggaccagcgctggccggagaccaagatcgagcccagcctgacccggatcagcgcactgctggacctgttgggctcgccgcagcgcgcctacccgtccatccacgtcgcgggcaccaacggcaagacctcggtggcccggatgatcgacgcgctggtcaccgcgctgcaccggcgcaccgggcgcaccaccagcccgcacctgcaatccgcggtggagcgcatctcgatcgacgccaagccgatcagcccggcccggtatgtcgacacctaccgcgaaatcgagccgttcgtgcagatggtcgatcagcaatcgcaagccgccgggggaccggcgatgagcaagttcgaggtgctcaccgcgatggcgttcgccgcgttcgccgacgccccggtcgacgtcgccgtggtcgaggtgggcatggggggacgctgggacgccaccaacgtggtcaacgccccggtcgcggtcatcaccccgatctccatcgaccacgtcgactacctgggccacgatctcgccgggatcgccggggagaaggccggcatcatcacccgggcgcccgcgggggcacccgacaccgtcgcggtcatcgcccagcagccgccggaggtgatggaggtgctgttggcgcagtgcgtgcaggccgacgccgcggtggcccgcgcgggctcggagttcgcggtgctgggccggcaggtcgcgatcggcgggcagctgctgcagctgcaggggctgggcggggtgtattccgacgtctacctgcccctgcacggcgagcaccaggcgcacaacgccgcgctggccctggcggcggtcgaggcgttcttcggcgccggcgcccagcgccagctcgacgtcgacgccgttcgtgccggtttcgccgccgtcacaagccccggccggcttgagcgaatgcgcagcgccccaacggttttcatcgacgccgcgcacaatcccgccggcgcggcggcactggcgcgcacgctggccgacgaattcgacttccgcttcctggtcggcgtgctcagcgtcctcgccgacaaggacgtcgacggcatcctggccgcgctgcagccggtgttccactccgtggtggtcacccacaacgggtccccgcgggcgctcgacgtcgagtcgctggccctggcggcgcgcgagcagttcggccccgatcgggtgagcaccgccgagaacctcagcgacgccatcgacgtcgcgaccgcgctggtcgacgacgccgtccgggacgggttggtggacgggcaggccgaggacttcgccgggaccgggatcgtcatcaccggctcggtggtcaccgccggcgcggcgcgaaccctgttcggtcgtgatccgcaatga

SEQ ID NO: 14853 - protein, 485 aa, Mycobacterium paratuberculosis
MSEPPDWAPEHDVPDPVPTPDEIAALLQVEHLLDQRWPETKIEPSLTRISALLDLLGSPQRAYPSIHVAGTNGKTSVARMIDALVTALHRRTGRTTSPHLQSAVERISIDAKPISPARYVDTYREIEPFVQMVDQQSQAAGGPAMSKFEVLTAMAFAAFADAPVDVAVVEVGMGGRWDATNVVNAPVAVITPISIDHVDYLGHDLAGIAGEKAGIITRAPAGAPDTVAVIAQQPPEVMEVLLAQCVQADAAVARAGSEFAVLGRQVAIGGQLLQLQGLGGVYSDVYLPLHGEHQAHNAALALAAVEAFFGAGAQRQLDVDAVRAGFAAVTSPGRLERMRSAPTVFIDAAHNPAGAAALARTLADEFDFRFLVGVLSVLADKDVDGILAALQPVFHSVVVTHNGSPRALDVESLALAAREQFGPDRVSTAENLSDAIDVATALVDDAVRDGLVDGQAEDFAGTGIVITGSVVTAGAARTLFGRDPQ

SEQ ID NO: 14854 - DNA, 1146 bp, Geobacter sulfurreducens
  CDS (1)..(1146)
atggccgggaccaatggcaaggggtcaacggccgcctttctggcctccattctggcggaagggggataccgggcaggacttttcacctctccccatcttacccgcttcaccgaacggttcaggatcaacggcacggagatcgccgaggaggccgccgcacgcgtggccgggcaggtcctggcgagcgcgccggagggcaccacctttttcgaggtggtgacggccatggcgctgctccatttcgtcgaggaaggggttgacgcagccattctcgaggcgggaatggggggcggcgccgatgccacgagcgctgccacgggaatcctgacggtcatcgctcccgttgccctcgatcattgcgagtggctgggcgagaccatcccggccatcgcccgggagaaggccggactcatcagggccggacggcctgtggtcctctcccggcagccggctgaagcccgtgacgtcttcattgagcgcggtcgcatcctgggggcccccctggtatgcttcggtgctgatttttccgccgcgtgggacgaatcgtcccttgcctatgacgggctgtcgcggcagctcgccggcctgcggcccggcatcggcggccgctatcagctggcgaacgcagccacggccctggccgccgcggaaatcctggccgacaacggcttccgcctcgattcccccgcgttgcgggcaggcattgacgcggcccgctggcccggcaggatggaactcttctccggcgcgccgcgggtgctgctggacggcgcccacaatcccgacggcgcccgggcgctcgccgagtcgctggccgactatccccgacggcgtctgatcgtggtgaccggcgtcatggcggacaaggatgcggcggggattctcgcacctgttctgcccctggcccatgaggtggtggcggtcactccggcggtggaacggggccttgatgccggccggctcgccgagctgtgccgggagaaggggctgaatgccgttgccggcggcaccgtcgccgaggggctcgccctcgcccggcagcgggccggcgagcaggatctcattctcgtctgcggttccctcttcacggtgggagaggcccgggcgattcttctttcgcagcaatacgagccgtttcgcggctga

SEQ ID NO: 14855 - protein, 381 aa, Geobacter sulfurreducens
MAGTNGKGSTAAFLASILAEGGYRAGLFTSPHLTRFTERFRINGTEIAEEAAARVAGQVLASAPEGTTFFEVVTAMALLHFVEEGVDAAILEAGMGGGADATSAATGILTVIAPVALDHCEWLGETIPAIAREKAGLIRAGRPVVLSRQPAEARDVFIERGRILGAPLVCFGADFSAAWDESSLAYDGLSRQLAGLRPGIGGRYQLANAATALAAAEILADNGFRLDSPALRAGIDAARWPGRMELFSGAPRVLLDGAHNPDGARALAESLADYPRRRLIVVTGVMADKDAAGILAPVLPLAHEVVAVTPAVERGLDAGRLAELCREKGLNAVAGGTVAEGLALARQRAGEQDLILVCGSLFTVGEARAILLSQQYEPFRG

SEQ ID NO: 14856 - DNA, 1221 bp, Ashbya gossypii
  CDS (1)..(1221)
atggagctgggactcgggcggataacacaagtgctgcggcagcttcacagcccgcatgaaaggatgcgcgtgctgcacgtggccggtacgaacggtaagggctcggtctgtgcgtacctcgcggcagtgctgcgcgcgggcggagagcgagtgggaaggttcacgagcccgcacctggtgcacccgcgggatgcgatcacggtggatggggaggtgatcggggcggcgacgtacgcggccctgaaggcggaggtggtcgcggcggggacatgcacggagtttgaggcgcaaacggcggtggcgttgacgcactttgcgcggttagagtgcacgtggtgtgtggtggaggtgggcgtgggcgggcggctggacgcaacgaacgttgtgccgggaggccgcaagctgtgcgccatcaccaaggtaggactagaccaccaggcgctgctcggcgggacgctggcggtggttgcgcgcgagaaggcggggattgtggtgccaggcgtgcggtttgtggcggtggacggaacgaacgcgccgagtgtgcttgcggaggtgcgtgctgcggcagcgaaggtgggggcggaggtgcacgagacgggaggggcgcctgtgtgtacggtttcatggggcgcagtggcggcgagcgcgctgccgctggcgggtgcgtaccaagtacagaacgcaggcgtggcgctagcgctgctagaccatctgcagcaactgggggagatctcggtgagtcacgcggcactggagcgcgggctcaaagcagtggagtggccgggacggctgcagcaggtggagtacgacctgggcggcgtccacgtcccactgctctttgacggggcgcacaacccctgtgctgcagaggagctggctcgctttctcaatgagaggtaccgcgggcccggaggctctccgctcatttacgtactggcggtgacatgtggcaaagagatcgatgcgcttctggcgccgctgttaaagccgcacgaccgagtgttcgccacatcgttcggagccgtggagagcatgccgtgggtagcggctatggcctccgaggacgttgcggcagcggctcgtcgctacacggcgcacgtgtctgcggtagcggacccgctggacgccctgcgggcggcagctgccgcccggggcgacgcaaaccttgtcgtttgcggctcgctttatcttgtgggcgagctgctgcgccgcgagcactag

SEQ ID NO: 14857 - protein, 406 aa, Ashbya gossypii
MELGLGRITQVLRQLHSPHERMRVLHVAGTNGKGSVCAYLAAVLRAGGERVGRFTSPHLVHPRDAITVDGEVIGAATYAALKAEVVAAGTCTEFEAQTAVALTHFARLECTWCVVEVGVGGRLDATNVVPGGRKLCAITKVGLDHQALLGGTLAVVAREKAGIVVPGVRFVAVDGTNAPSVLAEVRAAAAKVGAEVHETGGAPVCTVSWGAVAASALPLAGAYQVQNAGVALALLDHLQQLGEISVSHAALERGLKAVEWPGRLQQVEYDLGGVHVPLLFDGAHNPCAAEELARFLNERYRGPGGSPLIYVLAVTCGKEIDALLAPLLKPHDRVFATSFGAVESMPWVAAMASEDVAAAARRYTAHVSAVADPLDALRAAAAARGDANLVVCGSLYLVGELLRREH

SEQ ID NO: 14858 - DNA, 1242 bp, Gloeobacter violaceus PCC 7421
  CDS (1)..(1242)
atgacggctggaggttatctcgatcacctgcaaaaatttggcgttcacctgggcttggagcgcatccaggcgctgcttaagcgcctgggggagccgcaggttgccttccaagccgtgcatgtggcggggaccaatggtaaaggctcggtctgcgcttatctgagccatattttgcagacggccgggtatcggacggggcgctacacttcaccccatttgctcgactggaacgagcgcatctggattgacggtgcttttatctcggatggggctttgcaggcgtgcctggcaaaagtgaaagcctccgccgagcatttgccgaaaagtttgggggagcctacccagttcgagattgtcacggccgctgcgttcttgcactttgcccaatctgccgtcgaagtggcggtagtcgaggtcggactgggcggacgactcgacgccaccaacgtcttcgagcagccgccggcgagcgtgatcaccggtatcggcctggatcactgcgaccaactcggctccacgctggcggccatcgccgccgaaaaagccgggattttgcggtccggctgccccctggtctgcgcgccgctggccccggaagcgatgcaggtggtcactgaaaaggcactggcgttgggcgttgtgatcaccttggccgagcctgcccacgaggtcgccccgggtgaggcgcagtggcaaggatttcgttaccggctccccctcgcaggtggggtacagctgcaaaacagcgccaccgccctcgccacctgccaagtgctccgggagcggggactgcccattgatgaaacagcgatccgcaccggcctcgaaaacaccgtttggccgggacgctaccagtggcttggcgaacggttgctgctcgacggtgcccacaacgaagacagtgccgtgtacctgcgccgctatctggataccctccaccccaaagaatccatccgctggatcgtgggcattctcgaaagcaaggacgcgcgagccgtcttaaaagctttgctccgtccgggcgacgcttttgtagccgtccccgttcccgacgcccgctcccatccgcccgagaggctggcctccatggcgcagaccatgggcatacactccatcgcaagcgcctccggtttttctgaagcccttcagcttagcgatacagagcagttgacggtgatcgccggctctttgtacctggcgggggcggtgctgcgggactggccgcgcctccaaaagcaatga

SEQ ID NO: 14859 - protein, 413 aa, Gloeobacter violaceus PCC 7421
MTAGGYLDHLQKFGVHLGLERIQALLKRLGEPQVAFQAVHVAGTNGKGSVCAYLSHILQTAGYRTGRYTSPHLLDWNERIWIDGAFISDGALQACLAKVKASAEHLPKSLGEPTQFEIVTAAAFLHFAQSAVEVAVVEVGLGGRLDATNVFEQPPASVITGIGLDHCDQLGSTLAAIAAEKAGILRSGCPLVCAPLAPEAMQVVTEKALALGVVITLAEPAHEVAPGEAQWQGFRYRLPLAGGVQLQNSATALATCQVLRERGLPIDETAIRTGLENTVWPGRYQWLGERLLLDGAHNEDSAVYLRRYLDTLHPKESIRWIVGILESKDARAVLKALLRPGDAFVAVPVPDARSHPPERLASMAQTMGIHSIASASGFSEALQLSDTEQLTVIAGSLYLAGAVLRDWPRLQKQ

SEQ ID NO: 14860 - DNA, 1248 bp, Fusobacterium nucleatum subsp
  CDS (1)..(1248)
atggaggaaaaaatgaatattgatactttacttgaagaattatacgcttattctatgtttagtataagacttggtttagataatattaaagaaatttgtaaatatttaggaaatcctcaaaattcatataaggttatacacataactggaactaatggtaaaggttctgtttcaacaacagtagaaaaaattttattggaagcaggttataaagttggaaaatatacttcacctcatatacttgaatttaatgaaagaatatctttcaatgataagtatatcagtaatgaagatgttgctaggtattatgaaagggtaaaaaaaattatagataaatataatattcaagccacattctttgaagttactactgctatgatgtttgattattttaaggatatgaaagtagattatgtaattttagaagcaggtatgggtggaagatatgatgctacaaatatttgtgataatatagtatcagtaataacaaatgtaagcctagaacatacagaatatttaggagataccatctataaaattgcgaaggaaaaagcaggaataattaaaaactgtccttatacaatatttgctgataataatcctgatgtaaaaaaagctattgaggaagcaacagacaaatatgtaaatgttttagaaaaatataaggatagcacttatagcttagattttaaaactttctcaactaatatctttataaatggaaataaatatgaatattctctttttggagattatcaatataaaaattttctatgtgcctatgaggttgtaaaatatttaggtatagatgaaaatataataaaagaagctgttaaaaaggttgtatggcaatgtagatttgaagtttactctaaaaatccattagtaatttttgatggggctcataaccttgctggtgttgaagaacttactaaaattgtaaaacaacatttttcaaaagatgaagttacagtattggtatctattttaaaagacaaagatagactttcaatgtttaaaaaattaaatgaaatatcttctagtataattttaacttctataccaaataatccaagagcttcaactgctaaggaattatatgattatgttgaaaataaaaaagattttgaatatgaagaagacccaataaaagcatataatatagctttaagtaaaaaaagaaaacttactatatgttgtggctctttctatatattaataaaattaaaagagggattaaatggataa

SEQ ID NO: 14861 - protein, 415 aa, Fusobacterium nucleatum subsp
MEEKMNIDTLLEELYAYSMFSIRLGLDNIKEICKYLGNPQNSYKVIHITGTNGKGSVSTTVEKILLEAGYKVGKYTSPHILEFNERISFNDKYISNEDVARYYERVKKIIDKYNIQATFFEVTTAMMFDYFKDMKVDYVILEAGMGGRYDATNICDNIVSVITNVSLEHTEYLGDTIYKIAKEKAGIIKNCPYTIFADNNPDVKKAIEEATDKYVNVLEKYKDSTYSLDFKTFSTNIFINGNKYEYSLFGDYQYKNFLCAYEVVKYLGIDENIIKEAVKKVVWQCRFEVYSKNPLVIFDGAHNLAGVEELTKIVKQHFSKDEVTVLVSILKDKDRLSMFKKLNEISSSIILTSIPNNPRASTAKELYDYVENKKDFEYEEDPIKAYNIALSKKRKLTICCGSFYILIKLKEGLNG

SEQ ID NO: 14862 - DNA, 1281 bp, Rickettsia sibirica
  CDS (1)..(1281)
atgctaatgccgcattttccggtgccgacctggaaaaataacattaaatatgatcttgaaaatatagcaagacttttaagagccttaggtaactctcatttaaggcttcctcccgtcatacatatagcaggtacaaacggtaaaggttcaagtagtgctatgcttaaaagcatctttacgcttgccggttataaggtacattgctatacatctcctcatttattagaatttaatgaacgaatcgtagtagcaggtgagaaaatctcggataatgaattatggcaggtttgtgagcaggtgagggtagcaagcgaaaaatttaatattgaacctagcttctttgaaggtactacggcagcagcgtttctagcatttgagaaaacaaaagccgatatattaattttagagacgggactaggcggtcggttagacgcaacaaatatagtagcacaaccgttaattactttaattacacctatttcatatgatcatatgcatatgctgggtaatacattacccctaatagcagttgagaaagctggtattatgaagtcttgcgttccttgcgttataagtatgcaagttttggaagtttatgaaacattatttgccaaggctgaagagttagaagtaccgagtttctgttatgaatatgatttcggtattaaaaagacggacaacggatttatttattcatcacaaaattttacctatgagtttcctactccttcgctacttggtgatcatcaattaataaatgctgcaagcgttattgccttaataagccttattaacaaacaatttaatattagtaatgaggttattgctaaaggattacaaaatactatttggcctgctagaatcgaaaaaatagaaccgaaaaaatattctaaattaatatgtgataatgttcaaatttggatagacgtagctcacaataatagcggagctcaagttttggcaaattggatgcgtgataatttaaaatcatcgatatatttaatactcggtatgactaaaaataggaatattgaggaattttgctcttactttaaggatttgacaattaaaggttacggcgttaaagttttatccgaaccgctaagccatagtgcagaaacaatacatttggaaggcagaaagagtggtattgattttagcgaaagcgcctcactcgaagaagcgattagtgatataaagaagataaacggcgataataaagcaaatattataataaccggatcgctttatttagcttccgatttttataagttactatga

SEQ ID NO: 14863 - protein, 426 aa, Rickettsia sibirica
MLMPHFPVPTWKNNIKYDLENIARLLRALGNSHLRLPPVIHIAGTNGKGSSSAMLKSIFTLAGYKVHCYTSPHLLEFNERIVVAGEKISDNELWQVCEQVRVASEKFNIEPSFFEGTTAAAFLAFEKTKADILILETGLGGRLDATNIVAQPLITLITPISYDHMHMLGNTLPLIAVEKAGIMKSCVPCVISMQVLEVYETLFAKAEELEVPSFCYEYDFGIKKTDNGFIYSSQNFTYEFPTPSLLGDHQLINAASVIALISLINKQFNISNEVIAKGLQNTIWPARIEKIEPKKYSKLICDNVQIWIDVAHNNSGAQVLANWMRDNLKSSIYLILGMTKNRNIEEFCSYFKDLTIKGYGVKVLSEPLSHSAETIHLEGRKSGIDFSESASLEEAISDIKKINGDNKANIIITGSLYLASDFYKLL

SEQ ID NO: 14864 - DNA, 1476 bp, Plasmodium yoelii yoelii
  CDS (1)..(1476)
atggaaggtgaaataaaaacgtataatgaatgtttggaacaattatataaaacacactcaatcaaactagggcttggaagtacaaaaaaattgagtgaattatttggcaatccttataagaattataaaactattcatgtagctggtacaaatgggaaagggtcggtgtgtcataaaatttatttaggacttaaattaaaaaaatataaagtgggaatattttcttctcctcatatattttccttaagagaaagaataattataaatgatgaaccaataagtgaaaatgatttaattgctttagttaatgaagtatttaaaaaagcaaaaaaaataaatgcaagtccaacattttttgaaattataactctagttgcttttatatatttttctaatcaaaatgtagattatgcagttattgaaactggattaggaggaagattggatgcaaccaatattttggaaaaaccagaattagttataattacatcaattggttatgatcatttaaatatattagggaatgatttgaatcaaatatgtaatgaaaaaattggaatatttaagaaggatgctcaagttataataggtccatctgtttctatatatgtaaatgtttttgaaaaggcaaaagaattaaattgcaatatgcatattgttccaccagaacctagaggggaaacatataatgaagaaaatacgagaatagctatagaatctttaaaaatattaaatataaatgtagatagcgttttaaaatcgataatacctatcaaacctccattgagaatacaatatttagctgaagaacaaatggaacatataaaaaaaaagtacatacaaatggaaatgatagaaaataatactattttatcttatcctagtgctgttataatggatgtaggtcataatgaaactgctattgatagactatgtcgagatattaacttttttcataaagacaaaataataagagtgtgtatatctctaactaaacctaggaatttaaatatattccagccattaattgcacaatttcccgatgtcttaaaggatgttttttacttaccatcaatcaatgagcggacatatgactttgatgaaattgtggaaatgataaatgatgatgcatatataaataatgaactaaagaatcatatattaaatagttcaaaaaaagttaaccaatggttaatagcagaaaaggaaaaaaatggaaatttaattgataacaataaattatataaaagaggcacaattcctcttattgtaagaaatgcatttttggagtgttgcaaagacaattctgttctggtcatatgtggcactttttttattttcgaggaagttttaaaatcttttgatatatactcagaccaatatgtacatgcaggatacaatttttatgaacgagccatcagtagtatagagctagctaaaaggtgtgcaaacccgttaggattattaaatggctag

SEQ ID NO: 14865 - protein, 491 aa, Plasmodium yoelii yoelii
MEGEIKTYNECLEQLYKTHSIKLGLGSTKKLSELFGNPYKNYKTIHVAGTNGKGSVCHKIYLGLKLKKYKVGIFSSPHIFSLRERIIINDEPISENDLIALVNEVFKKAKKINASPTFFEIITLVAFIYFSNQNVDYAVIETGLGGRLDATNILEKPELVIITSIGYDHLNILGNDLNQICNEKIGIFKKDAQVIIGPSVSIYVNVFEKAKELNCNMHIVPPEPRGETYNEENTRIAIESLKILNINVDSVLKSIIPIKPPLRIQYLAEEQMEHIKKKYIQMEMIENNTILSYPSAVIMDVGHNETAIDRLCRDINFFHKDKIIRVCISLTKPRNLNIFQPLIAQFPDVLKDVFYLPSINERTYDFDEIVEMINDDAYINNELKNHILNSSKKVNQWLIAEKEKNGNLIDNNKLYKRGTIPLIVRNAFLECCKDNSVLVICGTFFIFEEVLKSFDIYSDQYVHAGYNFYERAISSIELAKRCANPLGLLNG

SEQ ID NO: 14866 - DNA, 1224 bp, Synechococcus sp
  CDS (1)..(1224)
atggcggaacatcagctatcggatctgatcccgcgctttgatctgcggggcatggacctgcagctggggcggatgcgccttgcccttcaggccctggggtctccctgtggagacattcctgcgattcaggtggctggaaccaacggcaagggctcaattgctagctttctcagcgcagcgctgcagcaggcaggcctccgcagtggcgtcaccacctcccctcacctggtgagctggtgtgagcggatcgcgattgatggcatccccatcagcgaaggccatctccgccagctcttgctggcccagcaagagctctgcgctgagcatcagctcacccccttcgagcaactgctcaccgcagccctggcgcactttcacgccgaggctgttgagctgttggtgcttgaggtgggattggggggtcggctggatgccaccaccgcccatcccaatcgacctgtgatcgccatggccagcatcggcctcgaccactgtgaacacctgggggccaccctgacggccatcgccgaggagaaggccgccgtgatcacaccaggatcacgggtgatcagctcagaccaaccggagccggtacggctggtgctggaacagacctgcagggccaataacgcggatctgcagtgggttgatcctctgcccagcgactggactctggggcttgctggaagctggcagcgccgcaacgcggccgtggcccgtggagcgctgcaggctctgcagcctctgggatggaacctggatgagaccacgatgcgggctggatttgccaaggccagttggagcggccgcctgcagaccgtgacctggcggggccatccgcttcttctcgatggcgcccacaacccacccgccgcgcagcaactggccctggagcggcagcgctggcaaggccatgggcagggtgtggtgtggatcctcggcatccaagcccacaagcaagcgctggagatgctgcagctgctgctgcagccccaggatcaggcctggatcgtgccggtctccaaccaccgcagctggacgcgtgatgcactcctgcaaaccatgccgcactggaaggatcagctcattgatgccgccagtcctgaggatgcgctgaagcgaatcgaagaaaccagagactggcctcaaccgatgcctgtgctcgccggttccctgtatctgatcggggatctgctcgagcaggggttggtgcaggcagagtga

SEQ ID NO: 14867 - protein, 407 aa, Synechococcus sp
MAEHQLSDLIPRFDLRGMDLQLGRMRLALQALGSPCGDIPAIQVAGTNGKGSIASFLSAALQQAGLRSGVTTSPHLVSWCERIAIDGIPISEGHLRQLLLAQQELCAEHQLTPFEQLLTAALAHFHAEAVELLVLEVGLGGRLDATTAHPNRPVIAMASIGLDHCEHLGATLTAIAEEKAAVITPGSRVISSDQPEPVRLVLEQTCRANNADLQWVDPLPSDWTLGLAGSWQRRNAAVARGALQALQPLGWNLDETTMRAGFAKASWSGRLQTVTWRGHPLLLDGAHNPPAAQQLALERQRWQGHGQGVVWILGIQAHKQALEMLQLLLQPQDQAWIVPVSNHRSWTRDALLQTMPHWKDQLIDAASPEDALKRIEETRDWPQPMPVLAGSLYLIGDLLEQGLVQAE

SEQ ID NO: 14868 - DNA, 1233 bp, Prochlorococcus marinus subsp
  CDS (1)..(1233)
atgattaatgtaaatattgagaattttgatttactctcgcccaaattagaaagggaaaatattcaattaggattatcaagaataaaaaatgcgttaagagatttagatgacccatgcaaaaatatacctgctattcaaattgttgggacaaatggtaaaggttcgattaccgcttttatagaaaacattctttatgcagataaaaagaatattggggttactacttcacctcaccttttagatatttgtgaaaggatcagagtgaataaagaaaagattagtaaggaagaatttgaaagactatttaagaaaataaaaaataatctttcaacccataaattatctccttttgaacaaattatctgttgtgcactaaatttttttgattttaaaaaagtagatttattaattcttgaagctggtttaggtggacgattagacgctactacagcccatcctttaagaccaataattgctattggcaatataggtttagaccataaagaatatcttggagactcaattgaaaaaattgcaaaagaaaaagtagctgtaattgaaaaaaatgcatttgttatttcttgtcgtcaagaagctgaagttgaggaaataattaaagcaagagttaaacaagtaaatgcaaaaatcatatggaaagaatcactatctaatgattacgaaattggtttaaaaggtaattttcaaaaacaaaacgcagctgttgctattggagtaattgaagaactaattaattttggctttaaggttaaagaaagctccattaaggaaggacttaagaatgcaaaatggagcgggaggttagaaataattaaatgttttaataaaaagattcttgttgattctgcacataattactctgcggcaaaagccctttcagaggaaaggaaaacttggaataataataaggaagggatttattggattttaggagtccaaatacacaaagatattgcctcaatgataaaagttcttattaaagaaaatgatcatatacttttagtcccagttcctaatcaagcaagttggaaattaaaagatctatctaatattaacgagctaaatcatttagatataaatgagtttgaaaaagttgatcttgcttttaattatcttttggagcttgaaaaatggccaaaatgtaatcctgtgcttacaggttcaatatttttagttgctgagtttattaaatttgcaaataatcaaaagttttaa

SEQ ID NO: 14869 - protein, 410 aa, Prochlorococcus marinus subsp
MINVNIENFDLLSPKLERENIQLGLSRIKNALRDLDDPCKNIPAIQIVGTNGKGSITAFIENILYADKKNIGVTTSPHLLDICERIRVNKEKISKEEFERLFKKIKNNLSTHKLSPFEQIICCALNFFDFKKVDLLILEAGLGGRLDATTAHPLRPIIAIGNIGLDHKEYLGDSIEKIAKEKVAVIEKNAFVISCRQEAEVEEIIKARVKQVNAKIIWKESLSNDYEIGLKGNFQKQNAAVAIGVIEELINFGFKVKESSIKEGLKNAKWSGRLEIIKCFNKKILVDSAHNYSAAKALSEERKTWNNNKEGIYWILGVQIHKDIASMIKVLIKENDHILLVPVPNQASWKLKDLSNINELNHLDINEFEKVDLAFNYLLELEKWPKCNPVLTGSIFLVAEFIKFANNQKF

SEQ ID NO: 14870 - DNA, 1242 bp, Prochlorococcus marinus
  CDS (1)..(1242)
atgtccaaacccacaagtccaagcaaggaagatttaagcgatctgattcctcgttttgatcagcgggggatggatcttgatcttgagcgcatgcaacaagcactgcaggccatgggaaacccctgtgcctctattccagccattcaggtcgtagggaccaatggcaaagggtctatcgccagcttcattgccagcagccttaaggctgctggcattcgcgtggggctgaccacctctcctcacctcgtgagctggtgtgaacggatcagcagcgatggtgagccgatctcaatcgttgagctacgccaacgactcaccgcccttcaaccccttgcccaaacccaccgactcacccccttcgagctgttgattgccacggcttttgatcacttcagatcccgcgaggtagagctgcttgtgcttgaggtaggcctcggaggacgcctcgatgccaccacagctcatccatacagaccaatcattgccatggccaacatcggcctcgaccactgcgaacaccttggttacagccttaaagagataacagcagaaaaaagcgccgtcatcagtcctggggctgctgtgatcagtgctcgtcaacaaactgaagtggcaagcattcttgaagacaaggcaaaacatcaacaggcccgcttgcaatgggtttcacccctcccagagaactgggacttgggactgccaggagtcttgcaacggcagaacgcggcggtagccaagggtgctcttgaatccctggccccacttggctggcgactcaatcaagacgtcattcgcacagggctggcccacgcctactggcctgcacgactgcagaccgttcactggcaaagccagccagtgctaattgatggtgcccataacccaccagcagccgaacggttggcccacgagcggcagcactggagcaatcaagagtttggggtttgctgggtgcttggtctacaggcccacaagcaagcaccagccatgcttcgccatttactcaagccaagcgatctggcttggatcgtgccggtgccggaacactgcagctggacgcagcaccaactcgcagcacactgccccgacctatcaagccaactccaatctgctgacaatgttgaacaggtcttctccatcctgctcaaacagaatcgatggccaaatccacctccagttgtagctggttccctctatttattaggtgatcttctcgcaaagcaaaccatccaggcagagtga

SEQ ID NO: 14871 - protein, 413 aa, Prochlorococcus marinus
MSKPTSPSKEDLSDLIPRFDQRGMDLDLERMQQALQAMGNPCASIPAIQVVGTNGKGSIASFIASSLKAAGIRVGLTTSPHLVSWCERISSDGEPISIVELRQRLTALQPLAQTHRLTPFELLIATAFDHFRSREVELLVLEVGLGGRLDATTAHPYRPIIAMANIGLDHCEHLGYSLKEITAEKSAVISPGAAVISARQQTEVASILEDKAKHQQARLQWVSPLPENWDLGLPGVLQRQNAAVAKGALESLAPLGWRLNQDVIRTGLAHAYWPARLQTVHWQSQPVLIDGAHNPPAAERLAHERQHWSNQEFGVCWVLGLQAHKQAPAMLRHLLKPSDLAWIVPVPEHCSWTQHQLAAHCPDLSSQLQSADNVEQVFSILLKQNRWPNPPPVVAGSLYLLGDLLAKQTIQAE

SEQ ID NO: 14872 - DNA, 1632 bp, Rhodopirellula baltica
  CDS (1)..(1632)
atgctaacgccgcgcgggcgatccatgtcccggcgtcaccgaccatttcaccccgatcacgatgattcagagatcgaaagcagatcgaccgtgatctcgcgaaaaagtgatgcctatcaagccgcactgggttggttggtcgaccgaattgactacgaaaagctggcatcctccggttcgcgttaccgttttacactggatcgaatgcgggatttgatccagcgtctgggccatggtcagcatctcacggtcgattcaactgaactcggccaaagccccccatccagcgagaatcaatcctccgtggttgaattggcgaggccggattcgatcgttcagccaagcaaatcaaccggcgttcaaatcgtccacctggcgggcaccaaaggaaaaggcagcgccgccaccatggtcgccgcactgctccactccgccggataccgtgttggtctttacacttcgccgcacctagtgaatctggaagaacgcttccgagtcgatggtgagatcgcgactccggaggagatgatcggactgatcgactccatgagaccgatcgtcgaagcgatgacggccgctcccatcggtggcccgtcgttctttgaactgaccacagcgatggcgattgaacactttcaccgacgacagtgcgacatctgggttttggaaaccggtttgggcggacggctcgacagcaccaatgtttttcaaagtcacgccaccgcgatcaccagcattgggctggatcaccaacacgttttgggtgatacggcagagctgatcgcagccgaaaaagcgggaattttcaaacgagacacgccagccatcaacggcgtccccgcaggtccagtgcgtgacgtaatcgtgcgaatcgccaaccaaatcggcgctccgctgatgcaccttggtgacgagatccagatcactccgaacacagagtcccagaaatgctggggcagcagcttccaaatcagcggacttggcgattggatgcccggggacacggtcgtcgatctaaagctcgaaggagcacaccagattcgcaacgccgcgatcgcgctggcgttggtcgatgccttgcccgacgtcacgcgaaaacttcgtcccgaacaatgcatccatcagtgtctatcgtcactgcaaatggaagctcgactggaacgtttcgatttatcggacgaccgggtggtgttgctagacacggctcacaatgccgactcgatcgaagcgatgctaaacgtattgaatcagcgtatggcggggcggcggcgattgtgcttgttcggcaccagcgccgacaagaatgtgctggcgatgctgcaaagaatgcagccgcacttcgaccaatggacgctcactcgatacgaaggcaacccgcgattcgtaccggtcgacgatttgaaccgaacggcactgcaagcaggcctgtctcccgatcgcatcacctcattcgaacaccccattgcggcagttcaaaacgccgtcaactctcttaacaccggagacgtcctggtcatctgcggctcgttctttctcgccgccgagattcgaccttggttggttcagtgttgcggttcgtcgtcggtttcaacgacttcttcgtcttcaaccgacggctcgtcgagcggttga

SEQ ID NO: 14873 - protein, 543 aa, Rhodopirellula baltica
MLTPRGRSMSRRHRPFHPDHDDSEIESRSTVISRKSDAYQAALGWLVDRIDYEKLASSGSRYRFTLDRMRDLIQRLGHGQHLTVDSTELGQSPPSSENQSSVVELARPDSIVQPSKSTGVQIVHLAGTKGKGSAATMVAALLHSAGYRVGLYTSPHLVNLEERFRVDGEIATPEEMIGLIDSMRPIVEAMTAAPIGGPSFFELTTAMAIEHFHRRQCDIWVLETGLGGRLDSTNVFQSHATAITSIGLDHQHVLGDTAELIAAEKAGIFKRDTPAINGVPAGPVRDVIVRIANQIGAPLMHLGDEIQITPNTESQKCWGSSFQISGLGDWMPGDTVVDLKLEGAHQIRNAAIALALVDALPDVTRKLRPEQCIHQCLSSLQMEARLERFDLSDDRVVLLDTAHNADSIEAMLNVLNQRMAGRRRLCLFGTSADKNVLAMLQRMQPHFDQWTLTRYEGNPRFVPVDDLNRTALQAGLSPDRITSFEHPIAAVQNAVNSLNTGDVLVICGSFFLAAEIRPWLVQCCGSSSVSTTSSSSTDGSSSG

SEQ ID NO: 14874 - DNA, 1236 bp, Prochlorococcus marinus subsp
  CDS (1)..(1236)
atgaacctaattaattacaaagaaaataatgattttgaagaattaataccttcatttaagtcaaagggaatgaatcttggacttgacagaatacaaaatgccttacaaaaaatggggaacccttgtcacaaagttcctgcaattcaaattgcagggactaacgggaaagggtctattacctgcttccttgaaagttgcctaacaaaaactcatattaaaactggatgcactacttcgcctcatctagttagctggtgcgaaagaatcagaattgatggtcaaatgatttcaccagaaaaacttcgaaaatttgtcaatgaagttaaattaattacaaagtctgagcaattaactccgtttgaacttgtaatagcctctgcatttaattatttttttgttaatcaagttgaattaattcttttagaagtaggactcgggggaagattagatgcaacaacagcacatccctggagaccaattattgcaatgggaaaaataagttttgatcactgtgaatatcttggggaaagtctagccaagatcacgaaagaaaaagctgctgtaatttcttatgggagtcacgtaattagtgcggaccaagaacctgaagttaagaaaatcctcgaagatactgtattaaagaaaaacgcaaagatttcttgggtttctccattatctaagcaatgggaattaggtatcgctggtgaaattcaaagagagaatgcagctgttgcaaaagcagtattagaatcccttcctacttttggctggaaaataaataataatcaaatcaaaaaaggtcttgcttcagcaaattggccaggaagacttcaaagtacaaaatgggaaggtctccctttgatacttgatggcgcacataacccagaagcaataagacaactctcaaaagaacgagctctctgggtaaatcaaagctcaattgttcattggataattggtatacagacgaataagaatgctcctgaaatgctacgtaatttgttaaaggaaaaagatattgcttggattgttcagatccctaaccatcaaagctggagcaaagatcaacttttaaaagcctgtccagaattgtctcatcaattaagaaaagcagaaagtattctaaaagttttagaacttttgagatcaaacaatcaatggccaacacctcctcctatagtaactggctctctttatttgataggtgatctaataaaaaacaaaatcatcacctaa

SEQ ID NO: 14875 - protein, 411 aa, Prochlorococcus marinus subsp
MNLINYKENNDFEELIPSFKSKGMNLGLDRIQNALQKMGNPCHKVPAIQIAGTNGKGSITCFLESCLTKTHIKTGCTTSPHLVSWCERIRIDGQMISPEKLRKFVNEVKLITKSEQLTPFELVIASAFNYFFVNQVELILLEVGLGGRLDATTAHPWRPIIAMGKISFDHCEYLGESLAKITKEKAAVISYGSHVISADQEPEVKKILEDTVLKKNAKISWVSPLSKQWELGIAGEIQRENAAVAKAVLESLPTFGWKINNNQIKKGLASANWPGRLQSTKWEGLPLILDGAHNPEAIRQLSKERALWVNQSSIVHWIIGIQTNKNAPEMLRNLLKEKDIAWIVQIPNHQSWSKDQLLKACPELSHQLRKAESILKVLELLRSNNQWPTPPPIVTGSLYLIGDLIKNKIIT

SEQ ID NO: 14876 - DNA, 1362 bp, Streptomyces avermitilis
  CDS (1)..(1362)
atgcccgcgcgtcccgccgaccccgagaccgacaaagcgctgcgcgaggtcgaggccgagctcgccacccgctggggcgagaccaaactggagccctccgtcagccgtatcaccgccctgatggacgtgctcggggacccgcagcgcgcgtacccctcgatccacatcacggggacgaacggcaagacctccaccgcccgcatgatcgaggccctcctcggcgccttcgacctgcgcaccggccggtacaccagcccgcacgtccagtcggtcaccgagcgcatcagcctcgacggcgccccgatctccgccgagcgcttcatcgagacgtacgacgacatcaagccgtacatcgagatggtcgacggccagcaggagttccggctctccttcttcgaggtcctgaccggcatggcgtacgcggccttcgcggacgcgcccgtcgacgtggcggtcgtggaggtggggatgggcggcagctgggacgccaccaacgtcatcgacggtgacgtcgccgtcgtcacgcccatcgacctcgaccacaccgaccggctcggcgagacacccggcgagatcgcctcggagaaggccggcatcgtcaagcaggacgccaccgtgatcctggcccagcagccggtggacgcggcgcaggtgctgctgaagaaggccgtggaggtcgacgcgaccgtggcccgggagggcctggagttcggggtcgtctcacgtcaggtcgccgtcggcggacagctgctgacgctgcgtggcctcggcggcgagtacgaggaggtgtacctgccgctgcacggtccgtaccaggcgcacaacgcggccgtcgcgctcgccgccgtcgaggcgttcttcggcgtcggctcccagcggcccgagccgctcgacctcgacacggtccgcaaggccttcgccgcggtgaccgcgccgggccgcctggaggtcgtacgccgctcgccgaccgtcgtcctggacgcggcccacaatccggcgggcgcccgcgccaccgcagaggccgtcggcgaggccttcgacttcagccggctcatcggagtggtgggggccagcggcgacaagaacgtccgggggctgctcgaggccttcgagccgatcttcgccgaggtcgtgatcacccagaactccagccatcgcgcgatggacgccgacgagctggccgcgatcgccgtggaggtcttcggcgaggaccgcgtccaggtcgagccgcgcctcgacgacgcgctggaggccgcgatcacactcgccgaggaagagggcgagttcgcgggcggcggcgtcctcgtcaccggctccgtcatcaccgtcggcgaggcccgactgctcctcgggaggggctga

SEQ ID NO: 14877 - protein, 453 aa, Streptomyces avermitilis
MPARPADPETDKALREVEAELATRWGETKLEPSVSRITALMDVLGDPQRAYPSIHITGTNGKTSTARMIEALLGAFDLRTGRYTSPHVQSVTERISLDGAPISAERFIETYDDIKPYIEMVDGQQEFRLSFFEVLTGMAYAAFADAPVDVAVVEVGMGGSWDATNVIDGDVAVVTPIDLDHTDRLGETPGEIASEKAGIVKQDATVILAQQPVDAAQVLLKKAVEVDATVAREGLEFGVVSRQVAVGGQLLTLRGLGGEYEEVYLPLHGPYQAHNAAVALAAVEAFFGVGSQRPEPLDLDTVRKAFAAVTAPGRLEVVRRSPTVVLDAAHNPAGARATAEAVGEAFDFSRLIGVVGASGDKNVRGLLEAFEPIFAEVVITQNSSHRAMDADELAAIAVEVFGEDRVQVEPRLDDALEAAITLAEEEGEFAGGGVLVTGSVITVGEARLLLGRG

SEQ ID NO: 14878 - DNA, 1362 bp, Enterococcus faecalis V583
  CDS (40)..(1362)
cttagttataatgtagaagaagacaaggagttggacaagatgcaattaacaatagaagaagccattgaatggattcatagccggttaccctttggttcaagacctggtttggatcggattaatgcgttattagaaaaaattgatcatccagaaaacaaagtgccaacgattcatatcgcaggaaccaatggtaaaggctcaaccgtgacatatttacgctgtctattagaagaaatgggcttgaaagtcggaacctttacctctccttatattgaatcatttaatgaaagaattgcgataaatggtcaaccaatttcagacgaacaattgattacctatgtggaaaagtatcaaccaatcattaaagaattagaccagatcactgaagtggctggaattacagaattcgaaacattgacaggaatggccttggactatttcgtgaatgaacaagtggatatcgccgttgttgaagttggcttaggtggattacttgatagcaccaatgtcgtgaagccattattgacgggaattacgacaattgggaaggatcacacagaaattttaggtgaaacaattgctgaaattgcctatcaaaaagcgggtattattaaagaaaaagtcccagtagtaacaggcaacatttgtgctgatgcgctagcagtcattgaaaaagtcgcacaagaaaaacagagtccaatttttcgttttggcaaagagtatcaagtggaatatctacatcctgatacacaatggggggaagtatttaatttctatggagaaatgggcaaactgacaaaaattaaagttcccttgttggggcgtcaccaagtagaaaatgcggcggtagctattcaattatttgacaagtattgccaactacaacatttgccatttaaagaacgagacattactcaagggttggctaaagcgcaatggccagctcgaatggaacgtcttagtgatgaaccgttgattgttttagatggtgcccacaatgatcatgcagtaaaacgcttagttgaaaacttgcgcaaagagtttccacaacacacgattcatattttattttcagctttagcaactaaagatgtggatgagatgattcaggacttaaagcaagtaccgaatgcgcatctttacttaactagcttcgattatcctaaagctattgcacttacagaaatggaaaaatatgaagacgatttaacagaaattgtgtctttatggcaatttggcttaggcgaaattttagaaaaaatgtcgacagatgatttattattagtaacaggttcattatattttgtttctcaagtaagagaattacttttaactataggaggaaatgatgaagaaatttga

SEQ ID NO: 14879 - protein, 440 aa, Enterococcus faecalis V583
MQLTIEEAIEWIHSRLPFGSRPGLDRINALLEKIDHPENKVPTIHIAGTNGKGSTVTYLRCLLEEMGLKVGTFTSPYIESFNERIAINGQPISDEQLITYVEKYQPIIKELDQITEVAGITEFETLTGMALDYFVNEQVDIAVVEVGLGGLLDSTNVVKPLLTGITTIGKDHTEILGETIAEIAYQKAGIIKEKVPVVTGNICADALAVIEKVAQEKQSPIFRFGKEYQVEYLHPDTQWGEVFNFYGEMGKLTKIKVPLLGRHQVENAAVAIQLFDKYCQLQHLPFKERDITQGLAKAQWPARMERLSDEPLIVLDGAHNDHAVKRLVENLRKEFPQHTIHILFSALATKDVDEMIQDLKQVPNAHLYLTSFDYPKAIALTEMEKYEDDLTEIVSLWQFGLGEILEKMSTDDLLLVTGSLYFVSQVRELLLTIGGNDEEI

SEQ ID NO: 14880 - DNA, 1386 bp, Tropheryma whipplei
  CDS (1)..(1386)
atgtcagagttttacaggcagattatgtcaagagccggcgaggccctcccgcagccgcggcttgatggcaccaaacttgccctatcgtatctgtcaaatcctcaagaatgtgctccggtaattcacatcaccggaacaaatgggaaaacaactgtaagcaggatgatagcctgcatcctaacatctctcgggctgcgtgtcggtttatttactagccctcacattaccgctctcgaggagagaattcagattgacatgaatcccgtccaggggcacatcttagagaaacactggttcgatattcagtttcagttgcggctcgcggatgctcatcttgagaaaaaaaactgcccaccgctgacattttttgagtgtatgacggttcttgcattttcatgctttgcagatacacctgtggatgtcatggtgcttgaggttggtatgggtggtgcttgggatgcaaccaatgttgtcgatgccagggtgtgtgtttttacgccaattgattttgaccatacaggtcgtttgggaagcaggttagaagagattgcacgcacaaaagctgggataatcaagccaggatcttttgttgtagctgcagaacaacatcaagttgtgcaagagtgccttgaggattattttgcatccataaatatcggatgccagagctatgacacagaattacctgacaaaataaggttctttgggcaagattttgactgtgattacaaacccgttgcgggagggcaaatactcgatttgcgtggtctatacggtgagtgcaacgaggtttttcttccactttttggtggatatcaggctaaaaacgctgccctgtccttagctgccgtggaaagcttttttggtagggtggaacatgatatagccctcgaggccttttcaaatataacgagcccagggcggcttcagattatttctaaaaatccagttgttttacttgatgcagcacataatccacatgcggcaaaacatctcgcaattgctctggatgaatttttttcctttgggaaaattgtgtttattctagcgtttttatccgataaagacattgaaggcataattcgtaatctaatgtcttttttacacggctcgctgcgtgtaacgagtgactccgtaggttacagtgaatcggaaagcacccggttcagtaaccctcgtgtaacatttgtcataacacaatcaacacacccgcgagcggttgccgctgatgtagcgtttagcattgctaaaagagttgtagctaacgagggacttatagtatgtgaaagtgcgaatgatgcgtttcagtacagtaccaggcttaacccggatgccattgttgtctccggctctatcagcattcttagtagttttattccgcgatga

SEQ ID NO: 14881 - protein, 461 aa, Tropheryma whipplei
MSEFYRQIMSRAGEALPQPRLDGTKLALSYLSNPQECAPVIHITGTNGKTTVSRMIACILTSLGLRVGLFTSPHITALEERIQIDMNPVQGHILEKHWFDIQFQLRLADAHLEKKNCPPLTFFECMTVLAFSCFADTPVDVMVLEVGMGGAWDATNVVDARVCVFTPIDFDHTGRLGSRLEEIARTKAGIIKPGSFVVAAEQHQVVQECLEDYFASINIGCQSYDTELPDKIRFFGQDFDCDYKPVAGGQILDLRGLYGECNEVFLPLFGGYQAKNAALSLAAVESFFGRVEHDIALEAFSNITSPGRLQIISKNPVVLLDAAHNPHAAKHLAIALDEFFSFGKIVFILAFLSDKDIEGIIRNLMSFLHGSLRVTSDSVGYSESESTRFSNPRVTFVITQSTHPRAVAADVAFSIAKRVVANEGLIVCESANDAFQYSTRLNPDAIVVSGSISILSSFIPR

SEQ ID NO: 14882 - DNA, 1362 bp, Tropheryma whipplei
  CDS (1)..(1362)
atgtcaagagccggcgaggccctcccgcagccgcggcttgatggcaccaaacttgccctatcgtatctgtcaaatcctcaagaatgtgctccggtaattcacatcaccggaacaaatgggaaaacaactgtaagcaggatgatagcctgcatcctaacatctctcgggctgcgtgtcggtttatttactagccctcacattaccgctctcgaggagagaattcagattgacatgaatcccgtccaggggcacatcttagagaaacactggttcgatattcagtttcagttgcggctcgcggatgctcatcttgagaaaaaaaactgcccaccgctgacattttttgagtgtatgacggttcttgcattttcatgctttgcagatacacctgtggatgtcatggtgcttgaggttggtatgggtggtgcttgggatgcaaccaatgttgtcgatgccagggtgtgtgtttttacgccaattgattttgatcatacaggtcgtttgggaagcaggttagaagagattgcacacacaaaagctgggataatcaagccaggatcttttgttgtagctgcagaacaacatcaagttgtgcaagagtgccttgaggattattttgcatccataaatatcggatgccagagctatgacacagaattacctgacaaaataaggttctttgggcaagattttgactgtgattacaaacccgttgcgggagggcaaatactcgatttgcgtggtctatacggtgagtgcaacgaggtttttcttccactttttggtggatatcaggctaaaaacgctgccctgtccttagctgccgtggaaagcttttttggtagggtggaacatgatatagtcctcgaggccttttcaaatataacgagcccagggcggcttcagattatttctaaaaatccagttgttttacttgatgcagcacataatccacatgcggcaaaacatctcgcaattgctctggatgaatttttttcctttgggaaaattgtgtttattttagcgtttttatccgataaagacattgaaggcataattcgtaatctaatgtcttttttacacggctcgctgcgtgtaacgagtgactccgtaggttacagtgaatcggaaagcacccggttcagtaaccctcgtgtaacatttgtcataacacaatcaacacacccgcgagcggttgccgctgatgtagcgtttagcattgctaaaagagttgtagctaacgagggacttatagtatgtgaaagtgcgaatgatgcgtttcagtacagtaccaggcttaatccggatgccattgttgtctccggctctatcagcattcttagtagttttattccgcgataa

SEQ ID NO: 14883 - protein, 453 aa, Tropheryma whipplei
MSRAGEALPQPRLDGTKLALSYLSNPQECAPVIHITGTNGKTTVSRMIACILTSLGLRVGLFTSPHITALEERIQIDMNPVQGHILEKHWFDIQFQLRLADAHLEKKNCPPLTFFECMTVLAFSCFADTPVDVMVLEVGMGGAWDATNVVDARVCVFTPIDFDHTGRLGSRLEEIAHTKAGIIKPGSFVVAAEQHQVVQECLEDYFASINIGCQSYDTELPDKIRFFGQDFDCDYKPVAGGQILDLRGLYGECNEVFLPLFGGYQAKNAALSLAAVESFFGRVEHDIVLEAFSNITSPGRLQIISKNPVVLLDAAHNPHAAKHLAIALDEFFSFGKIVFILAFLSDKDIEGIIRNLMSFLHGSLRVTSDSVGYSESESTRFSNPRVTFVITQSTHPRAVAADVAFSIAKRVVANEGLIVCESANDAFQYSTRLNPDAIVVSGSISILSSFIPR

SEQ ID NO: 14884 - DNA, 1326 bp, Methylobacterium extorquens
  CDS (1)..(1326)
atggaatcctccgacgcgttgatggcgcgcttcctcgccctgcatccgcgcacgatcgacctgtcgctcgggcgcatccagcgcctgctcgcggccctgaatcatcctgagcggcggctgccgccggtgattcacgtcgccggcaccaacggcaagggctcgaccatcgccttcatgcgggcaattctggaggcggggggcctggccgcccacgtctacacctcgccccacctcgtgcgcttccatgagcgcatccgcttagggggcatcggcggcggtcactacgtcgccgaagaccggctcgccgacgccttcgcccgctgcgaggcggccaacaagggcgatccgatcaccgtgttcgagatcaccacggcggccgccctgctgctgttttccgaatgccccgccgacgtgctgctgctggaagtgggcctcggcggccgggtcgatgccaccaacgtcatcgaccacccggcctgcgccgtggtcaccccgatcgggcgcgaccatgccgaatatctcggcgacaccgtggaggcggtggcgatggagaaggccggcatcttcaagcgcggctgcccggcggtgatcgccgcccaggattatgccggggccgatgccgtcctctgccgccaggccgagcggatcggcgcggtgccggtgcggatcggcaaccaggacttctccgtgcacgaggagagcgggcgcttcgtctaccaggacgagatcgacctgttcgatctgccgcggccccgcctcgccgggcgccaccagctcaccaatgccggcaccgccatcgcggccctgcgcgcggcgggcttcggcgacatcggcacggtcgccctcgaagccggcctgcgcaacgtcgattggccgggccggctccagcgcctcgtgcgcggggcgctcgccgagcggatgcccaaggacgccgagctgtggctcgacggcggccacaacgccgatggcgggcggatcctcgccgccgccatggccgatctcggcgagcgcagcgacgtgccgctggtgctgatcgtcgggctgctcggcaccaaggatgccgaaggcttcctgaagaacttcgtcggccttgcccgctcacttgtggcggtgccgatcaccggccagatggcggcgcggcccgccgaggaagtggcggagatcgcccgtgaggtcggcctctcggccgaggtcgctccgagcgtcgaggcggcgttggcggccctggcggacacggtcttcgagcgcccgccgcgggtcctcatctgcggttcgctttatctcgcgggcgccgtgctcgaagccaacggcacgatcccggtctga

SEQ ID NO: 14885 - protein, 441 aa, Methylobacterium extorquens
MESSDALMARFLALHPRTIDLSLGRIQRLLAALNHPERRLPPVIHVAGTNGKGSTIAFMRAILEAGGLAAHVYTSPHLVRFHERIRLGGIGGGHYVAEDRLADAFARCEAANKGDPITVFEITTAAALLLFSECPADVLLLEVGLGGRVDATNVIDHPACAVVTPIGRDHAEYLGDTVEAVAMEKAGIFKRGCPAVIAAQDYAGADAVLCRQAERIGAVPVRIGNQDFSVHEESGRFVYQDEIDLFDLPRPRLAGRHQLTNAGTAIAALRAAGFGDIGTVALEAGLRNVDWPGRLQRLVRGALAERMPKDAELWLDGGHNADGGRILAAAMADLGERSDVPLVLIVGLLGTKDAEGFLKNFVGLARSLVAVPITGQMAARPAEEVAEIAREVGLSAEVAPSVEAALAALADTVFERPPRVLICGSLYLAGAVLEANGTIPV

SEQ ID NO: 14886 - DNA, 1365 bp, Lactobacillus plantarum WCFS1
  CDS (1)..(1365)
atggatacagggacgattgaacaacgttatcaggacttattagcccaactaaatcaagccatgttagccaataatcatcagcgtgttccgttattacggcgcatcatggcacatcttggccaccctgaccattattaccatgtgatccatatcgctgggactaatggcaaaggctctacgggagccatgttagccagtatcctgcgggcgcaagggtatcaagttggccgcttcagcagccccgcgattaatgatgcgcgtgaacaactgcaatgcaatgggacgtggatcagtccagcggaatttatcgatacgtatcgtgagattctaccggttctgcaaaatatgggactgacagctagcgatgtctccatctttgaatggttctttctcattagtgtcgtttggtttcggaatcaaaacgtgcaatgggcggtcattgaagccggtttgggcggcttgtatgatgcgactaacgccttagccagtccccaactcacggtatttactaagattgccctcgatcataccgccattcttgggcccacgattaccgcgattgcgcaaaataagtcaaaaatcatcaagccccatacaacagcagtgacattggctgaccaacacccagaagccctggctgttttgcagaccgaagcgctcaatcaaggtgttcggctagtgaccgctaagcacgcgcaactgacggtgactgggcaaacactcacgcaaaccgtcgttgatgcgcacagtcagctttttgattggacgcaattaacggtcggactgagtggcacctatcagctacaaaatctgcggttggttttaactgtggttgcagtactacaacagcaacaagttaacttgacgaacagtgcggttcgccgaggcttgcaacaagtttccttgccaggccggttgaccgtattacaggagcaacctgtcattattgccgatggggcgcataatccggatggtatggcggcactagtggcaagtgtgaagcaattactcgctggtcgtaaattgatttggatcgtcggggtcttacaagataaggcctaccctaaaatgctggctgaactattaccggtagctgacgtcctgattacgaatacgcccgcaaatccagaacgagcgttatccgcgactaagctggccgacacggcgaacgcattattaacgcccacctttatgaccacggctgcgatgcaacgacagccagacttattgactgcaacgacgatcacggatgcgttaacgcaagctcagcagcaagcaaccagtaatagtgcgattattgtaacggggtcattttatgtcattcgtgagctccaacaggctggttggccggggttaagccaatga

SEQ ID NO: 14887 - protein, 454 aa, Lactobacillus plantarum WCFS1
MDTGTIEQRYQDLLAQLNQAMLANNHQRVPLLRRIMAHLGHPDHYYHVIHIAGTNGKGSTGAMLASILRAQGYQVGRFSSPAINDAREQLQCNGTWISPAEFIDTYREILPVLQNMGLTASDVSIFEWFFLISVVWFRNQNVQWAVIEAGLGGLYDATNALASPQLTVFTKIALDHTAILGPTITAIAQNKSKIIKPHTTAVTLADQHPEALAVLQTEALNQGVRLVTAKHAQLTVTGQTLTQTVVDAHSQLFDWTQLTVGLSGTYQLQNLRLVLTVVAVLQQQQVNLTNSAVRRGLQQVSLPGRLTVLQEQPVIIADGAHNPDGMAALVASVKQLLAGRKLIWIVGVLQDKAYPKMLAELLPVADVLITNTPANPERALSATKLADTANALLTPTFMTTAAMQRQPDLLTATTITDALTQAQQQATSNSAIIVTGSFYVIRELQQAGWPGLSQ

SEQ ID NO: 14888 - DNA, 1335 bp, Lactobacillus plantarum WCFS1
  CDS (1)..(1335)
atgattgacacttattcagcagcattagcctttattcacggccggactcagttcaaaaaagccccgacactcagtcgtatgcgccaattcttacatgaattgggtgatccacagttaaaggtggccggcattcacgtggcggggaccaatggcaaggggtcgacggttgcgaatttacgcgaattatttatggcagatgggctaacggtgggaactttcacgtcgccgttcattgttcgcttcaatgaacggatcagtgttgacggcacccccatcagcgatgaagaactcgttggtctggtgcaacagattcaaccgatcgttgccaagcttgacgcgacattggcaagtgggggccccacagaatttgagatcattaccgcaatgatgtttctttactttgctgctcagccaatcgatattgccattattgaagttgggttgggtgggttatacgattctaccaatgtctggacaccagccgttagtgtgattactacgatcggttatgatcatatgcaaattctaggtaatacattgacggcgattgcgactcaaaaagcaggtatcattaagacgcaggtgccggtaattgttggtaaattaccggctgaagcacagcaagtgatgattgataccaccatgagcaaacgggcgccgttgcggacgttgggagttgattttacaaccaaattattaccgccccaaggctggcaagaacggtttaactttgacgggttagaggcgcattttaaagacttgacaactccgctactgggagactatcaagttgataatgcggccgttgcaatagcggcgtacctaacttaccaccaagcgactcagctacccgtggtcactagcgacgtcaaaacggctgtggcagcaacacaatggcctggccgttttgaacgcttgaatcaggacccactgatcatgattgacggtgcgcacaatgagccggcagtaactgaattagcagctactttgagtgagcgatttggacagcaaatcgtttatgtcatctttgcggtcttagcggataagcagcatcaacaaatgattcagaccttgggcgcattacctaatgttcaactacggttgacacaattcgaaggtccgaacgcaaaacgtccagcgaccgacccgacgatgttggcgcatgaaatgccaaatggccggaccgctgaagtatttgataattggcaagctgccttgatgcagacactccaagaaatgtcgagtgatgatgcgttactactaacggggtcgttgtactttattagtgacgtacgggcttatttcaaggatggcagcgacttagaaactgattag

SEQ ID NO: 14889 - protein, 444 aa, Lactobacillus plantarum WCFS1
MIDTYSAALAFIHGRTQFKKAPTLSRMRQFLHELGDPQLKVAGIHVAGTNGKGSTVANLRELFMADGLTVGTFTSPFIVRFNERISVDGTPISDEELVGLVQQIQPIVAKLDATLASGGPTEFEIITAMMFLYFAAQPIDIAIIEVGLGGLYDSTNVWTPAVSVITTIGYDHMQILGNTLTAIATQKAGIIKTQVPVIVGKLPAEAQQVMIDTTMSKRAPLRTLGVDFTTKLLPPQGWQERFNFDGLEAHFKDLTTPLLGDYQVDNAAVAIAAYLTYHQATQLPVVTSDVKTAVAATQWPGRFERLNQDPLIMIDGAHNEPAVTELAATLSERFGQQIVYVIFAVLADKQHQQMIQTLGALPNVQLRLTQFEGPNAKRPATDPTMLAHEMPNGRTAEVFDNWQAALMQTLQEMSSDDALLLTGSLYFISDVRAYFKDGSDLETD

SEQ ID NO: 14890 - DNA, 1296 bp, Clostridium tetani
  CDS (1)..(1296)
atgaattataatgaagctatggaatatatacaaaacacaagtaaatatggtaacaatactggtactaagagagttgaaaaaatattagatattttaggtaacccacataagaatttaaaatgtatacatatagctggaaccaatggtaaaggctccataacatctatgattacatctatattaatagaatcaggatttaagataggcatgtatacatcaccatatatagaggaatttgaagaaagaattcaaataaatagagagaatattcccaaaagtgatttagcatattatactaccatagtatctgaagctatagaaaaagtagtttcaatggggtggggatatccaacagaatttgaaataataacttgtattatgtttttatattatagtaaaaaagaaatagactatgctataattgaagtaggattaggtggtaaatctgactctacaaatgttataaaacctttagttagcattataacgtcaataagttatgatcatgtgagcattttaggaaatactatagaagagatagctagtgaaaaagctggaataataaaagaaaatgtaccagttatattatatcctcaagaagaaggagcttataaagttatagaaaaaacttgtatggaaaaggatagtaaattaatatatatagatgaaaattcaatttatcatattcctaatgaggattttaataagtcttatcagttcttacaaataaaaacaaataaagatgaatataaagtgcagttatctttacttggaagccatcaaaggatgaattgtgcagtagctatctatgcaatagaacaactgatgcaaataggaataaaaataaaaaaagaagatattttaagggggctaagtaatgtgcaatggccaggaagacttgaaatattaaaaacaaatccattagtggtgatagatggtgcacataatttagatggcataacaaagcttaaagaaagtataaagcagtatttcagatataataaattaattttaattattggaatattaacagataaagatattcaaaagatggtgagaactattacgcctatagcaaataaagttattgcagttacacctaatagttatagagggaaaacatcccaagagttaataaaaacaatagaaaattataataaaaattgtgaagctttagaagattataaagaagcttatgttaaagctttagcttattgtgatgaagatgatatgattttaatatgtggttctttatatatgataggagatatgaggaaaattataagaaataggtaa

SEQ ID NO: 14891 - protein, 431 aa, Clostridium tetani
MNYNEAMEYIQNTSKYGNNTGTKRVEKILDILGNPHKNLKCIHIAGTNGKGSITSMITSILIESGFKIGMYTSPYIEEFEERIQINRENIPKSDLAYYTTIVSEAIEKVVSMGWGYPTEFEIITCIMFLYYSKKEIDYAIIEVGLGGKSDSTNVIKPLVSIITSISYDHVSILGNTIEEIASEKAGIIKENVPVILYPQEEGAYKVIEKTCMEKDSKLIYIDENSIYHIPNEDFNKSYQFLQIKTNKDEYKVQLSLLGSHQRMNCAVAIYAIEQLMQIGIKIKKEDILRGLSNVQWPGRLEILKTNPLVVIDGAHNLDGITKLKESIKQYFRYNKLILIIGILTDKDIQKMVRTITPIANKVIAVTPNSYRGKTSQELIKTIENYNKNCEALEDYKEAYVKALAYCDEDDMILICGSLYMIGDMRKIIRNR

SEQ ID NO: 14892 - DNA, 1344 bp, Bradyrhizobium japonicum USDA 110
  CDS (1)..(1344)
atgaacgcgtctcctgacagcgcaaagccgccgctcgacgaattgatcgggcggctgtcggccctgcatcagaagcgcatcgatcttgggctggagcggatgcatcgtctgctcgatcggctcggccaccccgaacgcaagctgcccccggtgatccacatcgccggcaccaatggcaagggctcgacgctcgcttatctgcgcgcgacgctggaagcggcagacctgcgcgtccacgcctacacctcgccgtatctggtccgcatcaacgaatgtttccggcttggtcgcctcggtggcggcgtgctggtcggcgacgacgaactgcgcgccgcgctggaagaagtcgagcgcgtcaatgccggcgagcctgccaccgtgttcgagctgaagacggctgccgcgtttcatctgttcgcgcagaatccggccgatgcggtgctgctcgaggtcggccttggcggccggctcgattcgaccaatgtggtcgatacgccggcggccaccgtgatcacgcctgtgagcatggaccacacggacttcctcggcgatacgctgacctccatcgccggcgagaaggccgcgatcatcaagcgcggcgtgcccgtggtttgcgccgagcagtcgggcgaggcgatggccgtgatcgaggcgcaggccaagcgcatgcgcgcgccgctgtttgccgcgaacgagagctggcacgtcaatgtcgagcatgggcgcctggtttattccgacgatcgcggcctgatggatctcgccgcgccgcgcctgttcggccgccaccagttcgacaatgccgggcttgcgatcgcgactttgcgcgcgatttcgacattcaaggtcaaccaggcggcgttcgaagccggcatcgtcggtgccgaatggccggcgcggatgcagcgcatcacctcgggcgagctgctctcctggggaccgcagggctcggagatctggctcgacggcgggcacaatgcggaaggtgggcgcgttgcggcggccgcgctcggcgatctcgaggaacgggtgtcgcggccgctggtcgtgatcgcgggcatgatggccaacaaggatgcgcaggccttcctcgccaatttcgccggcctcacccgtcacatcatcgcggtgccgattcccgacaccgagaatgcgatgccggccgaccgcctcgcggacgccgcgcgcagcctcggcatgcgggtcgagcccgcgccgggcatcgaggccgcgctgcgcgcgctgtcgaagctcgcctacgaggtgccgccgcgcatcctgatcaccggctcgctctatctcgccggccacgtgctcggcatcaacggcacgcctcctgcatga

SEQ ID NO: 14893 - protein, 447 aa, Bradyrhizobium japonicum USDA 110
MNASPDSAKPPLDELIGRLSALHQKRIDLGLERMHRLLDRLGHPERKLPPVIHIAGTNGKGSTLAYLRATLEAADLRVHAYTSPYLVRINECFRLGRLGGGVLVGDDELRAALEEVERVNAGEPATVFELKTAAAFHLFAQNPADAVLLEVGLGGRLDSTNVVDTPAATVITPVSMDHTDFLGDTLTSIAGEKAAIIKRGVPVVCAEQSGEAMAVIEAQAKRMRAPLFAANESWHVNVEHGRLVYSDDRGLMDLAAPRLFGRHQFDNAGLAIATLRAISTFKVNQAAFEAGIVGAEWPARMQRITSGELLSWGPQGSEIWLDGGHNAEGGRVAAAALGDLEERVSRPLVVIAGMMANKDAQAFLANFAGLTRHIIAVPIPDTENAMPADRLADAARSLGMRVEPAPGIEAALRALSKLAYEVPPRILITGSLYLAGHVLGINGTPPA

SEQ ID NO: 14894 - DNA, 1266 bp, Staphylococcus epidermidis ATCC 12228
  CDS (1)..(1266)
atgaattacctagacagcttgtattggatacacgaaagatctaaatttggtatcaaacctggcgtcaaacgtatggaatggatgctagaacaattaaataatccccaacataaaattagaggtattcatgtgggtggaacaaatggtaaaggttcaactgttgcatacttgagaaccgcattaattgagaacgattactcagttggaacatttacctcaccatttattgaaagtttcaatgaacgtattagtttaaacggtgtaccaattatgaacgatgaaattgttcaattagttgaacgagttaaacctgttagtgaagccttagagatagaaacagatttaggtggggctactgaatttgagattataacaacaatgatgttcctttattttggtgagataaatcctgttgattttgtgataattgaagcaggtttaggaattaaaaatgattcgacgaatgtttttaaacctgtgctatccatactcacaagtataggacttgaccatacagatatcttaggaacaacttatttagatattgcaaaagataaggcagctataattaaaccacatataccgattgtttatgctgtaaaaaatgacgatgctttaaagtatgtgagagattatgcgcttgaacagaacgcaaaaccaattgaattggatcgggagattaccgttgtctcccaagatgatgagttcacatatcggtataaagattatgaattagaaactatcattcttaatatgttaggggaacatcaaaaggaaaatgcagcacttgctattactgctctcattgaattaaatgaaagacaaatcatagaattagattttaataaaatgatagacggtatagaatctgtgaattggacaggtagaatagaacaagtaaaagaacaaccattaatggttattgatggtgctcataataatgaaagtattgatgcgttagtagacacaataagacattattatggaagagataaaattgatattttattttctgcaattaaaggaaagccaattcatagtatgattaacaaattaaatgatattgcatcaaaattctatatagcagattttgagtttccaaaagcattagctaaagaagaaattgccgaagaattgaaattagataatttacatttaattgatgattatgttgattttattgaaaattacgaaggtgatgggctgattattactggaagtttatacttcatcagcgaggtaaaagcaaaaattaattttaattaa

SEQ ID NO: 14895 - protein, 421 aa, Staphylococcus epidermidis ATCC 12228
MNYLDSLYWIHERSKFGIKPGVKRMEWMLEQLNNPQHKIRGIHVGGTNGKGSTVAYLRTALIENDYSVGTFTSPFIESFNERISLNGVPIMNDEIVQLVERVKPVSEALEIETDLGGATEFEIITTMMFLYFGEINPVDFVIIEAGLGIKNDSTNVFKPVLSILTSIGLDHTDILGTTYLDIAKDKAAIIKPHIPIVYAVKNDDALKYVRDYALEQNAKPIELDREITVVSQDDEFTYRYKDYELETIILNMLGEHQKENAALAITALIELNERQIIELDFNKMIDGIESVNWTGRIEQVKEQPLMVIDGAHNNESIDALVDTIRHYYGRDKIDILFSAIKGKPIHSMINKLNDIASKFYIADFEFPKALAKEEIAEELKLDNLHLIDDYVDFIENYEGDGLIITGSLYFISEVKAKINFN

SEQ ID NO: 14896 - DNA, 1287 bp, Wigglesworthia glossinidia brevipalpis
  CDS (1)..(1287)
atgaaaaaacttttaattcctaatacgcattcttctattaaagattggactaattatatttctaaattgcattacaaagaaatagatctaagattagacagagtatattactttgctaaaagattaaatttattaaaaccagcaccaattacaattgttgttggaggaacaaatggaaaaggaagcacatgtagatttttagaattaatgtttatatatagtaatataaaagtaggagtatatagttcaccacacttgattaattataatgaacgaattagacttcatggaaatgaagtttcagacgaggaatgtattaatgcaatgaattttattaataaaataataaaaaaaacatctatcagttattttgaatttagcacgttagtagctttattaatatttaaaagtaaaaaacttgatgttgttattctagaagtaggattaggaggtagattagatgccacaaatgtagtagatatagatatatctgtagttacaaatgtctcaatagatcatactgaatttttaggaaaaaattgttctgaaatagcaaaagaaaaatctggaatttttagatataaaaaattgtctatatttggtggatttaacaatcttttaaattttaaatcagcttctgaatattataaatcaataccatattttttgaatgttcattggttttataaaaaaaataaaaaatattggatgtggagtaataaaactaataatatatttcttccatatcctattctcaatatagagaatgcagctacagcattagctgtgataaaatctctaccttttacaataccttaccaatctatatttaaaggattaaaaacagcgactctacctggaaggtttcaaataattaataaaaaaccatttattatattagatgtagcacataatcctagttctgctaaacatttagcaaaaaaaattaaaagaataaaaaaaaatttttctattatttatgcaatcataggaatgttgtcagataaagatataaaaaacacattaaaatattttattaaaatcattgatatatggaactgtgcttctttatcagaatttccaagaggagcaagctgtgaagaaatatcaatttttttaaataaaaataaagaaaaaaacaatgtaaaaaattttaaaaatgttataagtgcttttaaatacgttataaacattgctacaaaaaaagattgtatattaatatttggatcattttatacaatatcttatattcttaaaaataaaaaaaatatttattataaaatataa

SEQ ID NO: 14897 - protein, 428 aa, Wigglesworthia glossinidia brevipalpis
MKKLLIPNTHSSIKDWTNYISKLHYKEIDLRLDRVYYFAKRLNLLKPAPITIVVGGTNGKGSTCRFLELMFIYSNIKVGVYSSPHLINYNERIRLHGNEVSDEECINAMNFINKIIKKTSISYFEFSTLVALLIFKSKKLDVVILEVGLGGRLDATNVVDIDISVVTNVSIDHTEFLGKNCSEIAKEKSGIFRYKKLSIFGGFNNLLNFKSASEYYKSIPYFLNVHWFYKKNKKYWMWSNKTNNIFLPYPILNIENAATALAVIKSLPFTIPYQSIFKGLKTATLPGRFQIINKKPFIILDVAHNPSSAKHLAKKIKRIKKNFSIIYAIIGMLSDKDIKNTLKYFIKIIDIWNCASLSEFPRGASCEEISIFLNKNKEKNNVKNFKNVISAFKYVINIATKKDCILIFGSFYTISYILKNKKNIYYKI

SEQ ID NO: 14898 - DNA, 1275 bp, Thermosynechococcus elongatus BP
  CDS (1)..(1275)
atggggctagctgtggctgatccactgacggcagcactgaggccctacgcccgctttggggtgcgcctgggccttgaacctatccaggcacttctgagtgccttggggtctccgcagttccaggtgcccttgatccacgttgcggggacaaatggcaaaggctccgtgtgtgcctatttggatagtgttttgcgggcagcgggctatcgcacgggtcgctatacctcgccccatctgttgagctggtgtgagcgcatttgtgtggatggtgaacccattgcccctgaggtctttttgaccctcattcaacaaattgaagcagtcctgccacaggtggcttatccccccagtcagtttgaagtgatcacggcggcggcatggctgtattttgcccagcagggggtagatgtggcggtgatggaggtgggcttggggggacgcttggatgcgacgaatgtgtgtcagccccctttggtgagtgtgattacctccattggttgggatcattggcagcggttgggcaatagcctgggggcaattgcgggcgaaaaggctggaattctcaagcagggtgtacctgctgttattggtccggttcctccagaggcaaagacagtgattgccgagcgtttagccgctttggcctgcccggccgtctggccagaaccggcccaaaggtgtgttgagcgtgctggttgggcaacttggggtggcatcgagtaccccttgcctttggcgggagagatgcagttggtcaattcagcgatcgcgatcgccacactgcaatgcctgcaagctcaaggttggcaaatttccctaacagcgattcaacagggcatggcacaaacccgctggccgggacgactgcaatggttacactggcaaggtcgacaactgctcattgatggtgcccacaatgctcccgcagctgcttacctacggcaatatgtggatcaattgggctggacagaggtgacttgggtcgtggggatcctagccaataaggatcacgaggggattctcaaccatctcctgcgagccggcgatcgcctgtggctggtgcccgtcccggatcacgctagcgctaacctagagcacttgaaggaccttgcctacacctgttgtcctaggctaggggaatgccgtctttttaacgatgtggctaaagccctcgacagggcgggcgatcgctgcgtggtctgtggctccctttacttaattgctcgtgttttgggggcgatcgcaagcaaagactctcaggtaactcaacgatag

SEQ ID NO: 14899 - protein, 424 aa, Thermosynechococcus elongatus BP
MGLAVADPLTAALRPYARFGVRLGLEPIQALLSALGSPQFQVPLIHVAGTNGKGSVCAYLDSVLRAAGYRTGRYTSPHLLSWCERICVDGEPIAPEVFLTLIQQIEAVLPQVAYPPSQFEVITAAAWLYFAQQGVDVAVMEVGLGGRLDATNVCQPPLVSVITSIGWDHWQRLGNSLGAIAGEKAGILKQGVPAVIGPVPPEAKTVIAERLAALACPAVWPEPAQRCVERAGWATWGGIEYPLPLAGEMQLVNSAIAIATLQCLQAQGWQISLTAIQQGMAQTRWPGRLQWLHWQGRQLLIDGAHNAPAAAYLRQYVDQLGWTEVTWVVGILANKDHEGILNHLLRAGDRLWLVPVPDHASANLEHLKDLAYTCCPRLGECRLFNDVAKALDRAGDRCVVCGSLYLIARVLGAIASKDSQVTQR

SEQ ID NO: 14900 - DNA, 1278 bp, Streptococcus mutans
  CDS (1)..(1278)
atgaattatcaagaagcattgacttggatacaggatagtttaaagtttgggattaaaccgggcttggaacgtatgacttggatgctagaaaaattgggcaatccccaacggcatatttgcggcatccatgttgtcggtactaatggtaaaggatccactgttaatgatttacaaactatttttagtgaagcaggttatcgggttgggacttttatttcaccttatattattgattttagagagcgaatctcaattaatggtcgaatgatcagtgaaagggatcttgttcatttagttcaattagccaaacctgtggttgaacgtctgcctcttgagactgatttggaagcagcgacagaatttgaaattatcacgcttttaatgtttctttatttcgggaaagtgcatccggttgatttggttattattgaggcaggaatgggcggactctacgactcaaccaatgtttttaaggcgcaagccgttatttgtacctccattggactggaccatcaggctgttttgggagagacttattctgatattgctcagcaaaaggtcggtgttttaaaagaaggagtcccttttatttttgctgaaaaacgtcctgatgttaaagctgttttttaccaaaaggccaaagaaactcagagccctatttatgagttagggcaaactttttatcttgtagataagggtgagaggtttgattttatttgcggtgataaaaagatttctgatattagattggccatgcaaggaaaccatcaaagagctaatgctgctttggctattatggctacccttttattgcaagagcattttcctaaggtaactgatactgttattcaaaaaagtctggttcataactactggataggaaggacagagtttatcaaagacaatcttatgattgatggtgctcataataatgaaagtgttgccgctttagtggaacttttaaaagagcagtatgctgataaaaagattcatattctttttgcagccattaataccaaaccaattgacagcatgttaaagcaattaaatcaattcactgatttgactgtgacaaccttttcttatcctgatgcccttcctttgaaagattatccacagatttacaaacaagtcagtaactttaagctttggctcaaaagattaagcaaggctcaaagagatgacttttatgtcattacaggatcgctctattttatttcacaagtcagaaaagttcttttgaaaaatgaagaaataggctataatagattgtattaa

SEQ ID NO: 14901 - protein, 425 aa, Streptococcus mutans
MNYQEALTWIQDSLKFGIKPGLERMTWMLEKLGNPQRHICGIHVVGTNGKGSTVNDLQTIFSEAGYRVGTFISPYIIDFRERISINGRMISERDLVHLVQLAKPVVERLPLETDLEAATEFEIITLLMFLYFGKVHPVDLVIIEAGMGGLYDSTNVFKAQAVICTSIGLDHQAVLGETYSDIAQQKVGVLKEGVPFIFAEKRPDVKAVFYQKAKETQSPIYELGQTFYLVDKGERFDFICGDKKISDIRLAMQGNHQRANAALAIMATLLLQEHFPKVTDTVIQKSLVHNYWIGRTEFIKDNLMIDGAHNNESVAALVELLKEQYADKKIHILFAAINTKPIDSMLKQLNQFTDLTVTTFSYPDALPLKDYPQIYKQVSNFKLWLKRLSKAQRDDFYVITGSLYFISQVRKVLLKNEEIGYNRLY

SEQ ID NO: 14902 - DNA, 1257 bp, Streptococcus mutans UA159
  CDS (1)..(1257)
atgaataaaacagaaacgctcaattggattcactcctttaaagccaagggacgacaagctgatttaaaacgcatgaattggctcttagaaaaattaggcaagccacaaactacatttcctgctattcacattgttggaaccaatggtaaaggatctacatgtagctatttacagcatattctgacagcatcaggctataaaacgggaagctttacttctccttatattactcgctttaatgaacgtattgccattgacgggaaggaaatttctgatcaggacttaaacaaggtcatttcgcttgtcaaacccattgttgaatcagtaaccgttgaaacccattatgaaaaagtcaccgaatttgaactcgtcacacttcttatgtttacctattttgcacaaatcaatcctgtagacattgccatcattgaagcaggaatcggtggacttaaggattcaacaaacgttttcaaagcattggcggttgtctgtccttcaataagttttgatcatcaagaaaaactgggaaatagtttagcacaaattgcccggcaaaaggtaggagtcttagatgaaaaggtcccctttatttttggccaaatgacttctgcagttaaacaagtgttttatgaagaaacccaattattaggctgcccaacttttgaatgcaataaagacttttcttttaaggaaaatggcaaagtttttgactttatttatcaagactttttgatatcagctattcacctaaaaatgttaggacaacaccaaaaagctaatgccagtcttgccattatgacgagtttaattctagctaaggtatttccaaatattaattccaaaacaataaggactggtcttcaatccaccatctggcctggacgttgtgaactattacaagctaatttgctgcttgatggcgcccacaatatagatgctattacaaagctgattcaagtgctaaaagacagctttagagataaaaccattcatattctctttgccgggctcaaacgtaaaccaatcgaaaaaatgttagcacaattagctgaatttgatctcagtgttacgagctttgatttttttgaagccttgcctttagaaaattacccacttagctatccaagagttgacaattggaaaaattggataactcaggcaacagcccattcagaccatctttatgttgtaacaggatctttctacttcatttcccaagttcgtaatcacctaatcgaaaagacaaggctccaatga

SEQ ID NO: 14903 - protein, 418 aa, Streptococcus mutans UA159
MNKTETLNWIHSFKAKGRQADLKRMNWLLEKLGKPQTTFPAIHIVGTNGKGSTCSYLQHILTASGYKTGSFTSPYITRFNERIAIDGKEISDQDLNKVISLVKPIVESVTVETHYEKVTEFELVTLLMFTYFAQINPVDIAIIEAGIGGLKDSTNVFKALAVVCPSISFDHQEKLGNSLAQIARQKVGVLDEKVPFIFGQMTSAVKQVFYEETQLLGCPTFECNKDFSFKENGKVFDFIYQDFLISAIHLKMLGQHQKANASLAIMTSLILAKVFPNINSKTIRTGLQSTIWPGRCELLQANLLLDGAHNIDAITKLIQVLKDSFRDKTIHILFAGLKRKPIEKMLAQLAEFDLSVTSFDFFEALPLENYPLSYPRVDNWKNWITQATAHSDHLYVVTGSFYFISQVRNHLIEKTRLQ

SEQ ID NO: 14904 - DNA, 1281 bp, Oceanobacillus iheyensis
  CDS (1)..(1281)
atgttatttgaacaaatagaacaatattttaataatagagaaacaataggggtacaacctggattagaaagagtgaaggaattattgaagtttgtcgactatccagataaagaccttcccactattcatatagctggtacaaatggaaaaggttctacgagtcaattcattcaatctgctctcatagctaatgattataaggttggatcttttacatctcctagtttttatggaataagaggatttattcaaatgaataacgagccagtatcggagaaggtattttcacaagcatttcaaaaaatgttgcctgccattgaaatgctagacaaagatgggaactccccgagtaactttgagatattaacggtattaagctttgtttgttttgaaaataatgtagatatcgcagttgtcgaagcgggcatgggaggaatgtgggatacgactaatgtaatttcgccaattgtaactgttatcactactatttcttatgaccatactgcattgttaggtgaaacgttagtagaaattgctgaacaaaaagcgggtataatcaagccgttaattccaatgataactggtgttaacggaactgcgtatgacataatagagaagaaaacggaagagatgaattcaccattatttgttttagacaaagattttacgtatgaatctataactatgaatcattttaaatttaatatatctaatcaacaatttgatatagatttagatatgaatggaaaacatcaacactataatgcttctatagccctttatgtattacatatacttcatgaacaaggctggcagttaacggaagataagataattaaaggggtagaacaagctagattacctggaagattagagaaaatccatagtaatccgtcaataattgtagatggcgcacataatatggaaggtatacattctttgatagacacgataaaacgacaggattctaaaagcggtcatcatattttatttgcagcttttaaggataaagacgtaagaaacatgataaattgtctgcaatcagacttgtcgaacgttaatgtaacaacatttgatcatgttcgcgctccctcctttgaggaattagaacaattagaaacaaagcagccaaaacgaatcgtttatgattggaaaaaatacttggaaacaatttttgaaaataaggatgaatgctattatattactggatctttacatttcatatcattagtaaaacaatatgttaatgatctgcagcgaaatatgttgaacgattcttag

SEQ ID NO: 14905 - protein, 426 aa, Oceanobacillus iheyensis
MLFEQIEQYFNNRETIGVQPGLERVKELLKFVDYPDKDLPTIHIAGTNGKGSTSQFIQSALIANDYKVGSFTSPSFYGIRGFIQMNNEPVSEKVFSQAFQKMLPAIEMLDKDGNSPSNFEILTVLSFVCFENNVDIAVVEAGMGGMWDTTNVISPIVTVITTISYDHTALLGETLVEIAEQKAGIIKPLIPMITGVNGTAYDIIEKKTEEMNSPLFVLDKDFTYESITMNHFKFNISNQQFDIDLDMNGKHQHYNASIALYVLHILHEQGWQLTEDKIIKGVEQARLPGRLEKIHSNPSIIVDGAHNMEGIHSLIDTIKRQDSKSGHHILFAAFKDKDVRNMINCLQSDLSNVNVTTFDHVRAPSFEELEQLETKQPKRIVYDWKKYLETIFENKDECYYITGSLHFISLVKQYVNDLQRNMLNDS

SEQ ID NO: 14906 - DNA, 1521 bp, Corynebacterium efficiens YS
  CDS (1)..(1521)
atggcaacacaagacgagcgtgaatacggcgaattcggcgacgtgacgctcaatgaggcaggactgtccctgccgttggatctcgcaggcgacctcgatgaggaacgggagaaccccgcgcccctggagatcaccccggaggaactggcgcagctggccatcgtcgaggcggaactcgatgagcgctggcaggaaaccaagatcgaccccaccttcaggcgcatgtcctatgtcatggacctgatgggcaagccacaggacacgttcgcctccatccatatcgcgggcaccaacggcaaaacctccaccacccgcatggtggagtcgctgctgcgtgccttccaccggcgcaccggccggaccaccagcccgcacctgcagctgatcaccgaacgcatcgcgatcgacgggaagccgatccacccgcgtgatttcgtgcgcatctacaacgaggtcaagccgtacctcgagatggccgatgaacactccctctccgagggtggcccgcggatgagcaagttcgagaccctgatcaccctggcctatgcagccttcgcggatgcgccggtggatgtcggtgtcatcgaggtcggcctgggtggtcgttgggatgccaccaatgtgatcaacgcgcaggtcgcggtgatcaccccggtgggcatggaccacaccgaccgcctcggcaacaccatcgccgagattgccggggagaaggccggcatcatcaaggcccgcccggccagcgatgatgtcaacgccccgcaggagaacgtggtcatcgtgggcaagcaggatccggaggccatgcgggtgatcctggagcaggccgccgagaccggttccgccgtggcgcgcctgggcatggagttcggcgtggtggagtccaccatcgccgtcggcggccagcagctggtcctgcgtggtctgggtggtgagtacaccgatatcttcctgccactctccggtgagcaccaggccgacaacgccgccaccgccctggccgccgtggaggcgttcttcggtgcctccgcggaccgcccgcttgatgctgacaccgtccgtcagggcttcgcccaggtggaatcaccgggccgtctggagcgtctgcgttccgccccgaccgtgttcatcgacgccgcccacaacccgcacggcgccgcggccctgggggcggcactggaccgggacttcgatttccgccgtctcatcggtgtcatcggtgtgctcggtgacaaggacgcccggggcatcctggggagcctcgagccctacctgcatgaggtggtgtgcacccagaccacctcggagcgtgcactggatgcctatgagctggccgagtacgcccgtgagatctacggtgatgaacgcgtgcacgtcgccgacaccctgccgggtgcggtggaactggccatcgagctggccgaggacaccgatgtccagtccggttccggtgtggtgatcaccggatccatcgtcaccgccggtgacgcgcgcaccctgttcggaaaggaacctgcatga

SEQ ID NO: 14907 - protein, 506 aa, Corynebacterium efficiens YS
MATQDEREYGEFGDVTLNEAGLSLPLDLAGDLDEERENPAPLEITPEELAQLAIVEAELDERWQETKIDPTFRRMSYVMDLMGKPQDTFASIHIAGTNGKTSTTRMVESLLRAFHRRTGRTTSPHLQLITERIAIDGKPIHPRDFVRIYNEVKPYLEMADEHSLSEGGPRMSKFETLITLAYAAFADAPVDVGVIEVGLGGRWDATNVINAQVAVITPVGMDHTDRLGNTIAEIAGEKAGIIKARPASDDVNAPQENVVIVGKQDPEAMRVILEQAAETGSAVARLGMEFGVVESTIAVGGQQLVLRGLGGEYTDIFLPLSGEHQADNAATALAAVEAFFGASADRPLDADTVRQGFAQVESPGRLERLRSAPTVFIDAAHNPHGAAALGAALDRDFDFRRLIGVIGVLGDKDARGILGSLEPYLHEVVCTQTTSERALDAYELAEYAREIYGDERVHVADTLPGAVELAIELAEDTDVQSGSGVVITGSIVTAGDARTLFGKEPA

SEQ ID NO: 14908 - DNA, 1590 bp, Bifidobacterium longum
  CDS (1)..(1590)
atgcgggacgtcgaactggacatcatgagccgcccgccggagcataacaccaccaatctggatctcgaccggatgaacctgatgctcgacatcctgggccacccggagcagtcgttccgcgtgattcatatcaccggcaccaacggcaaaggctccaccgcacgcatggccgaggccatctgccgcgcctacggtatgcgcaccggcctgtacacgtcgccgcatctggagaagatcaacgagcgtatcgccatcgacggccagcagctgtccgacgacgatttcatcgacatctgggaccagaccaaggatctcgtggccctggtggacgccaagatggaggagcaaggcaagccgaagatgagcttcttcgaggtgctcaccgccatggccatctggaagttcgccgacacgcccgtggacgtggccatcgtcgaggtcggcatgggaggcctgtgggacgccaccaacgtgctcaacgcggacgcggccatcatcggcccggtggacatggaccacatgcagtggctgggcgacaccgtcgaacagatcgccaccgagaaggccggcatcatcaagccgaactgcaccgccatcatcgggcctcagccgcatgaggaagccgtcatgccgattctcaccgaagccgccgaacgcaaccacgccatgctcgtgcgcgacggctacgaaatgaccgtgtccgaccgtatggccgcagtcggcggccagatcgccaccctgaccacgcccaacggcacttacgagggcgtgccgatcgccaagttcggcgagcatcaggcccacaacgcgcttgccgcgcttgccgcctctgaagtggtgattccggtcaatggcccgctggacggcgacttggtgggcgaggcgttgagctcggtcaagattcccggacgcatcgaacagatccgcacctcaccgaccatcattctggatggcggacacaacgtgaatgccgccgaagccctacgcaaggccatagaggaaagctacgacttcaagcagctggtcggcgtggtcgccatgatgcgcgacaagcaggtcgaggaatatctgggtgttctggagccgatcctgagctccgtggtggtcaccgagaactcgtggcgcgagcgtgtgatgccggccgatgagctcgagaagattgccgtggacgtgttcggccgtgaccgtgtgatcaaggaagcgaacctgcccgacgcgattcagactgccgtcaacatggtcgatgccgaggacgagctgggcgtgggctacggccacggcgtgcttatctgcggcagcttcgtcaccgccggcgacgcacgcctgatgcttgaggaacacgccagccccacgatgaggcaggccatggccgtccatcagccggcggtcgacccggacgattcggatcagccggcagacaaggccgaggatgaggccgccgacaacctcgaggattcggtgagcccggacgacttcgacgtgttcgacgtcctcggcctcggtaaggaacaggccagtgacgccggtaacgccggcaccggcacggccagtgccgacacaggcaccgacgattccgccgacgtccggtaa

SEQ ID NO: 14909 - protein, 529 aa, Bifidobacterium longum
MRDVELDIMSRPPEHNTTNLDLDRMNLMLDILGHPEQSFRVIHITGTNGKGSTARMAEAICRAYGMRTGLYTSPHLEKINERIAIDGQQLSDDDFIDIWDQTKDLVALVDAKMEEQGKPKMSFFEVLTAMAIWKFADTPVDVAIVEVGMGGLWDATNVLNADAAIIGPVDMDHMQWLGDTVEQIATEKAGIIKPNCTAIIGPQPHEEAVMPILTEAAERNHAMLVRDGYEMTVSDRMAAVGGQIATLTTPNGTYEGVPIAKFGEHQAHNALAALAASEVVIPVNGPLDGDLVGEALSSVKIPGRIEQIRTSPTIILDGGHNVNAAEALRKAIEESYDFKQLVGVVAMMRDKQVEEYLGVLEPILSSVVVTENSWRERVMPADELEKIAVDVFGRDRVIKEANLPDAIQTAVNMVDAEDELGVGYGHGVLICGSFVTAGDARLMLEEHASPTMRQAMAVHQPAVDPDDSDQPADKAEDEAADNLEDSVSPDDFDVFDVLGLGKEQASDAGNAGTGTASADTGTDDSADVR

SEQ ID NO: 14910 - DNA, 1284 bp, Lactococcus lactis
  CDS (1)..(1284)
atgtctattgaacaagcattagaatggatacattcacgattaaaatttaatattcgcccagggctaaatcgagtttcagcacttttagaattattaggcaatccagaggaatctttatcaatgattcacattgctggaacaaatgggaaaggatcaactgttgcctttacgcgctctatttttatgcaagctggcttaaaagttgcttcttttacgagtccttttattacgacttttggtgaacgaatgtctataaatgctcaaccaattcctgatgaaaagttaatttattatgtaaagatgattcaacctttagttgagcagcttgataatgatgctgagttgactggaattactgaatttgaaattattaccgcgatggcttttaaatattttgctgatgaaaaggttgatttggcggtaatcgaggttggcttgggtggactgcttgattcgacaaatgtcattagacccgttgtttctggaatcacaacaatcgggctagaccatattgatatcttgggttcaacgattgaagaaatcgcagctcaaaaagcaggtattattaaagctggaatacctgttgtggttggaaacattgaattaaaagctttgcgagttatttgggaagttgccagaaaaaatactgcgcgtatttatcagtatccttatgattaccgcaccgagttaaaagagcatgaacattttgatttctttgcaggtcaagaggcaattctggatttggaaaaatctttgattggcttgcatcaagtagaaaatgctggaatggccattgaattggcgctcgtctatgcgaataaagttggaattaacttgaatgaagagattattcgtgcgggaattcgtgaagctttttggcctgctcgaatggaaaaattaggcgaaaatcctttaattttacttgatggggctcataatgttcatgctatgaatcgtttgcttgagaacttggggaaagaattccctgataaaaaaattacaattattttttcagctattaccacaaaagatattaggcagatgataaaaatgcttcaaacggtaaaaaattctcgcttaattttgacaacttttgattatcctaaagctttagacttgaaagattttcggtatttagaggatgaaggggttgaattagcaccaagttgggaattagcgattgttcgtgcacaaaaagctttagatgaagatgagctcctattaatcactggttcgctctatttttcatcacaagttcgtgaatttttgaaaaaagaaaagtag

SEQ ID NO: 14911 - protein, 427 aa, Lactococcus lactis
MSIEQALEWIHSRLKFNIRPGLNRVSALLELLGNPEESLSMIHIAGTNGKGSTVAFTRSIFMQAGLKVASFTSPFITTFGERMSINAQPIPDEKLIYYVKMIQPLVEQLDNDAELTGITEFEIITAMAFKYFADEKVDLAVIEVGLGGLLDSTNVIRPVVSGITTIGLDHIDILGSTIEEIAAQKAGIIKAGIPVVVGNIELKALRVIWEVARKNTARIYQYPYDYRTELKEHEHFDFFAGQEAILDLEKSLIGLHQVENAGMAIELALVYANKVGINLNEEIIRAGIREAFWPARMEKLGENPLILLDGAHNVHAMNRLLENLGKEFPDKKITIIFSAITTKDIRQMIKMLQTVKNSRLILTTFDYPKALDLKDFRYLEDEGVELAPSWELAIVRAQKALDEDELLLITGSLYFSSQVREFLKKEK

SEQ ID NO: 14912 - DNA, 1278 bp, Streptococcus pyogenes
  CDS (1)..(1278)
atgacttatgaagagactctagaatggattcatgatcacttagttttcggcatcaagccaggcttaaaacgtatgctttgggttcttggacagttaggaaatccccaaaaaaatgtcaagggagtgcatatcgttggaactaacggaaaaggttccacggtcaatcatttacaacacatctttacgacagctggttatgaagtggggacctttacctctccttatattatggatttcaaagaacgtattagcataaatggtcgaatgatttcagaaaaagatttggtcattgctgctaatcgtattcgtcctttgacagagcgtctagttcgagagactgattttggagaggtaactgaatttgaagtgattactttgatcatgttcctctattttggtgatatgcatcctgtagatattgctattattgaagcaggccttggcggtctttatgattcgaccaatgtttttcaagcaatggttgtggtctgtccctcaattggtttagatcaccaagctattttgggagagacttacgctgatattgccgcccaaaaagctggtgttttagaagggggcgagacccttgtttttgccgttgaaaacccgtcagctcgagaggtttttttaacaaaagctgagcaggttggtgcttcaatctgggaatggcaagagcagtttcaaatggctgagaacgcatctggctatcgttttactagtcctttaggagttatttcagatattcacatcgctatgccaggacaccaccaagtgtctaatgcagctttagctattatgacttgcttaaccttgaaagaccgctatcctaggctaacttcagatcatataagggaaggtctagcaaatagtttgtggctaggccgtaccgaattattagcaccaaatctaatgattgatggggctcataacaatgaaagcgttgctgctttggtagccgtcttaaaaaataactacaatgataaaaagcttcatattttgtttggtgcgatcgacaccaagcctattgcagatatgttggttgctcttgagcaaataggtgacttgcaggttactagctttcattaccctaacgcctatccattggaaaaatgcccagaacgttttggtagggttgctgatttcaaagatttcttggccctgcgtaagcatgctaaagcagatgactttttcgtgattacagggtcactatattttatttcagaaattagacggtattggaaaaaacatattgaaaaaagcgttcttttaacccattaa

SEQ ID NO: 14913 - protein, 425 aa, Streptococcus pyogenes
MTYEETLEWIHDHLVFGIKPGLKRMLWVLGQLGNPQKNVKGVHIVGTNGKGSTVNHLQHIFTTAGYEVGTFTSPYIMDFKERISINGRMISEKDLVIAANRIRPLTERLVRETDFGEVTEFEVITLIMFLYFGDMHPVDIAIIEAGLGGLYDSTNVFQAMVVVCPSIGLDHQAILGETYADIAAQKAGVLEGGETLVFAVENPSAREVFLTKAEQVGASIWEWQEQFQMAENASGYRFTSPLGVISDIHIAMPGHHQVSNAALAIMTCLTLKDRYPRLTSDHIREGLANSLWLGRTELLAPNLMIDGAHNNESVAALVAVLKNNYNDKKLHILFGAIDTKPIADMLVALEQIGDLQVTSFHYPNAYPLEKCPERFGRVADFKDFLALRKHAKADDFFVITGSLYFISEIRRYWKKHIEKSVLLTH

SEQ ID NO: 14914 - DNA, 1377 bp, Corynebacterium glutamicum ATCC 13032
  CDS (1)..(1377)
atgctgcgccttgcccaggtggaagcagagttggatcaacgttggttggaaaccaaaattgatcccactttccgacgcatgagctacatgatggatctcatgggccaaccacagaattccttcccagcaattcacgtggctggcaccaacggtaagacctccaccacccgcatgatcgagtcgttgctgcgcgcattccaccgccgcaccggccggaccaccagcccgcacctgcagctggtaaccgaacgcatcgcgattgatggcaagcccatccacccgcgtgatttcgtgcggatctacgaagagattaagccctacatggagatgaccgacgcctggtcagaggccgagggcggaccgaagatgagcaagtttgaggcactcgtggccctcgcttacgcaggttttgccgacgctcctgttgacgtcgccgtcgttgaggttggtcttggcggacgctgggatgccactaacgtgatcaacgcagctgtttccgtgatcaccccggtgggcatggaccacgtggatcgcctgggcaacaccattggtgaaatcgctggtgaaaaggccggcatcatcaaggctcgtcctgcatctgaggatggcaccgagcctgagggcaacgttgtcatcgtgggcaagcaggagccagaagcaatgaacgtgattctgcagcaagccgtggacgtggacgcagctgttgctcgtttgaacatggaattcggcgtggtggaatccgccattgccgttggtggacagcagctcaccctgaagggtttgggcggcgaatacaccgacatcttcctcccactgtctggcgcgcaccaagcagataatgccgcggttgctctcgcagcagtggaagcatttttcggtgcatccgccggacgcccattggatatcgacacggtgcgcgaaggcttcgcacaagttcagtccccaggtcgcctcgagcgcctgcgctctgcaccaaccgtgttcatcgacgcagctcacaacccacacggtgccgcagcacttggtgcagcactagaccgtgactttgagttccgtcgcctcatcggtgtcatcggagtgctctgcgacaaggatgcccgcggcatcttggaatcacttgagccatacctgcatgaaattgtgtgcacccagactgcctcagagcgcgcattggacgcatacgatttagctgaatatgctcgagagatctacggcgatgagcgtgtgcacgtccaagaagatcttgctggcgcggtagaactcgctattgaactagcagaagacaccgatgtacagtccggatcaggtgttgtgatcaccggttcaatcgtgaccgccggcgatgcgcgcacgctgtttggaaaggaacctgcatga

SEQ ID NO: 14915 - protein, 458 aa, Corynebacterium glutamicum ATCC 13032
MLRLAQVEAELDQRWLETKIDPTFRRMSYMMDLMGQPQNSFPAIHVAGTNGKTSTTRMIESLLRAFHRRTGRTTSPHLQLVTERIAIDGKPIHPRDFVRIYEEIKPYMEMTDAWSEAEGGPKMSKFEALVALAYAGFADAPVDVAVVEVGLGGRWDATNVINAAVSVITPVGMDHVDRLGNTIGEIAGEKAGIIKARPASEDGTEPEGNVVIVGKQEPEAMNVILQQAVDVDAAVARLNMEFGVVESAIAVGGQQLTLKGLGGEYTDIFLPLSGAHQADNAAVALAAVEAFFGASAGRPLDIDTVREGFAQVQSPGRLERLRSAPTVFIDAAHNPHGAAALGAALDRDFEFRRLIGVIGVLCDKDARGILESLEPYLHEIVCTQTASERALDAYDLAEYAREIYGDERVHVQEDLAGAVELAIELAEDTDVQSGSGVVITGSIVTAGDARTLFGKEPA

SEQ ID NO: 14916 - DNA, 1269 bp, Streptococcus pyogenes
  CDS (1)..(1269)
atgactacctatgatagcatttcctggattcatacctttaaggctaatggtcgcaagaccgatttggccagaatggcttggttacttgaggcactaggccggccacaagacaaattccctgctattcacgttgttggaactaacggcaagggctctgtgacagcctacttacagcatatcctgtcaacttctggttatcaggtcggaacctttacatctccttttatcatctcttttcacgatcggatctgccttaatggccagcccatttcagacctagaattggcgcaatgtgtgagcgtgattagacccattctcactaaaatgtcccttgaaacaaattgggatagacctaccgagtttgagttagtgactctcataatgttttgctactttgccaatcttaaacctgttgatattgccattattgaggcagggattggtgggaaaaccgacgcaaccaatgtttttcatgctctggccgtcgtatgcccttccattagttttgatcaccaagaacgtttaggttatagcctagcagaaattgctcaccaaaaagcagaagttatcaaagctaaagaacccgttattatcggtcaacttgagcaggaggctagtcaagtctttcaacaagttacccaaaaagccggttcacgcttatatcaattaggaaaagattttttgctcaagccttcagaaaagacgttttcctttcaacacgataacttgaatttaaccaaactccgtctcaaactattaggtcaacatcaaaaagcgaatgcctgtttagccattatgacagctcaattacttagaaaatcctttcctaaaatatctccaaaaacgattcaaaaaggaattgagacaacaacttggcctggccggttcgaatttattcaacctaatcttctattagacggcgctcacaatccagattccattgctaaattaaagtctctactgcaagaagaatttcccaaacgtcctattcatatcctctttgcaggtctcaaacgtaagcctttagccgacttgctggctcaactagatacttttgaagtatctgtcacgacttttgatttccctgaagcaaatcttttagaggattatcctgataaatacccacaggtaaaagattacagagactggttacaaggttccgtaacatctgatgaactctttgttgttacagggtcactttattttatctccgaggtaaggcaatattgtctgagcaacgcaaatatctttaaaaacatattcccctaa

SEQ ID NO: 14917 - protein, 422 aa, Streptococcus pyogenes
MTTYDSISWIHTFKANGRKTDLARMAWLLEALGRPQDKFPAIHVVGTNGKGSVTAYLQHILSTSGYQVGTFTSPFIISFHDRICLNGQPISDLELAQCVSVIRPILTKMSLETNWDRPTEFELVTLIMFCYFANLKPVDIAIIEAGIGGKTDATNVFHALAVVCPSISFDHQERLGYSLAEIAHQKAEVIKAKEPVIIGQLEQEASQVFQQVTQKAGSRLYQLGKDFLLKPSEKTFSFQHDNLNLTKLRLKLLGQHQKANACLAIMTAQLLRKSFPKISPKTIQKGIETTTWPGRFEFIQPNLLLDGAHNPDSIAKLKSLLQEEFPKRPIHILFAGLKRKPLADLLAQLDTFEVSVTTFDFPEANLLEDYPDKYPQVKDYRDWLQGSVTSDELFVVTGSLYFISEVRQYCLSNANIFKNIFP

SEQ ID NO: 14918 - DNA, 1296 bp, Thermoanaerobacter tengcongensis
  CDS (1)..(1296)
atggggcaaatgacatatgaagaggctatccagtacattcacagtacttacaagttcggcatgaaattaggacttgaaaatataaaaaggcttttaggatatatggggaatcctgaaaaaaatctcaaaattatccatgtagcagggaccaatggaaaagggtccacttcttcttttataagcagcattttaaaagaagctggctataaagtggctctttatacttccccttacctggaagagtttgaagagaggatgaaaataaatggagaaaatatttccagggaaaagctcgtttactatgtagagtacataaagccaataattgcaaggatggtacaggaaggatataatcatccaacagagtttgaagtcatcactgccattgcttttaaatacttttccgatgaagaagtagactttgtggtgctggaagtaggactgggggggagatttgatgccacaaatgctatttcttcttcactcgtttcagttataacttctattgattatgaccatatggacaagcttggaaataccttaggcgatatagcctatgaaaaagcagggataataaagaagaaaggagttgtagtaagtttttaccagcaagaagaggccttaaaagtgattagtgatgcctgtgaggtaagagaagcctatttaactatcctggataaaaataatatagtgataaaagagcaaaattcagattttcaggtttttgattataaaaattttaaggatttgaagataactcttctgggtactcatcagatttataatgcttctcttgcggtggaagtcattcaaaaacttaagaatatttatggatatcagataagcgaagaggcaataaaaagaggcttaatgaatgcgaagtggcctgggagattagaagtcatgaaaaaaaggccgtacgtagtaatagacggtgcacacaatccgcaggggatgacagtactgaaagaaagcctgaaattatttaattataggagattaattttggttattgggatgcttaaagataaagaagtagataaaatgcttaatatcataactcctgtggcagatgtaattataactactactccgctaagcgatagagcctgtggggcaaaagaccttgccagcaaaatttctagaaatagtgtgttcgcagtagaccaaattgacaaggcagtgaatgaagcactaaaaatggcaggtgaagaggatatggtccttttttgtggatctctttacatgataggccatgtgaggaaattgttaagaggagtactaaataaaaaatga

SEQ ID NO: 14919 - protein, 431 aa, Thermoanaerobacter tengcongensis
MGQMTYEEAIQYIHSTYKFGMKLGLENIKRLLGYMGNPEKNLKIIHVAGTNGKGSTSSFISSILKEAGYKVALYTSPYLEEFEERMKINGENISREKLVYYVEYIKPIIARMVQEGYNHPTEFEVITAIAFKYFSDEEVDFVVLEVGLGGRFDATNAISSSLVSVITSIDYDHMDKLGNTLGDIAYEKAGIIKKKGVVVSFYQQEEALKVISDACEVREAYLTILDKNNIVIKEQNSDFQVFDYKNFKDLKITLLGTHQIYNASLAVEVIQKLKNIYGYQISEEAIKRGLMNAKWPGRLEVMKKRPYVVIDGAHNPQGMTVLKESLKLFNYRRLILVIGMLKDKEVDKMLNIITPVADVIITTTPLSDRACGAKDLASKISRNSVFAVDQIDKAVNEALKMAGEEDMVLFCGSLYMIGHVRKLLRGVLNKK

SEQ ID NO: 14920 - DNA, 1323 bp, Clostridium perfringens str
  CDS (1)..(1323)
atgaattatgatgaagctatggagtatattgttactgcatcaaggtttggaatgaatttaggattagatagaatagaaaaggttttggagtttttagggaatcctcataaggacactaagtttatacatattgggggaacaaatggcaaggggtcaactactgccatgataagttcagttttaagggaagctggttttaaggttggaatgtatacctctccttatttagaggaatttgaagagagaatacagattaatggggagaatataaataaagatgatttagcaattcttatgggagatgttaaaaaggctatagataaagttatggagcttggctatgaaagtccaactcagtttgaaataataactgctttaatgttttattatttttctaaaaagaaagttgattatgctgtcttagaagttggtttaggaggaagattagatgcaactaatgtggtccttcctgaggtagttgtacttacttcaataagcctagatcatatgaatattttaggaaataccatagaggaaattgcaaaggaaaagtgtggaataataaagagtggtgtgcctgtaatatcttatccacaagaagaaaaggccttagaagtaataaaagagagatgtaatgaattaggttgtaatttagaggttgttaatactgaagacataaaaaacataattatagataaagaaaaacatgttcagaaaatagaagtttcactagaagatgaaattttagaaatagatttaggtttacttggagatcatcaagtaaagaatttcttagtggcattaaaaaccttaattaaattaagaaataatggagtaaacataagcaatgaagctattaagcaagggtttaaaaaagtaagatggattggaagaatggaagtattaaatgaaaatcccttagttgttatagatggagctcacaatattgatggaataagaaatttgagaaatagtatagataaatattttaattttaaaaatataacattaatattaggggttctaggtgataaacaagtagatgaaatggtagaagaaataactagaggagtagataaggtagttatagttgaacctcatagtgatagggcagaggacattgaagatttatatattaaagttgaaaaatatgtaaaagaagtttttaaatttaaggattataaagaggcctataataaggcatattcttttactaatgatgatgatttattattaatttgtggttctttatatatggttggagatatgagaaaggccataagaaataatgataatacatccttaagaagtataaagtattag

SEQ ID NO: 14921 - protein, 440 aa, Clostridium perfringens str
MNYDEAMEYIVTASRFGMNLGLDRIEKVLEFLGNPHKDTKFIHIGGTNGKGSTTAMISSVLREAGFKVGMYTSPYLEEFEERIQINGENINKDDLAILMGDVKKAIDKVMELGYESPTQFEIITALMFYYFSKKKVDYAVLEVGLGGRLDATNVVLPEVVVLTSISLDHMNILGNTIEEIAKEKCGIIKSGVPVISYPQEEKALEVIKERCNELGCNLEVVNTEDIKNIIIDKEKHVQKIEVSLEDEILEIDLGLLGDHQVKNFLVALKTLIKLRNNGVNISNEAIKQGFKKVRWIGRMEVLNENPLVVIDGAHNIDGIRNLRNSIDKYFNFKNITLILGVLGDKQVDEMVEEITRGVDKVVIVEPHSDRAEDIEDLYIKVEKYVKEVFKFKDYKEAYNKAYSFTNDDDLLLICGSLYMVGDMRKAIRNNDNTSLRSIKY

SEQ ID NO: 14922 - DNA, 1266 bp, Streptococcus pyogenes
  CDS (1)..(1266)
atgaagctagaatggattcatgatcacttagttttcggcatcaagccaggcttaaaacgtatgctttgggttcttggacagttaggaaatccccagaaaaatgtcaagggagtgcatatcgttggaaccaacggaaaaggttccacggtcaatcatttacaacatatctttacgacagctggttatgaagtggggacctttacctctccttacattatggatttcaaagaacgtattagcataaatggtcgaatgatttcagaaaaagatttggttattgctgctaatcgtattcgtcctttgacagagcgtctagttcaagagactgattttggagaggtaactgaatttgaagtgattactttgatcatgttcctctattttggtgatatgcatcctgtagatattgctattattgaagcaggccttggcggtctttatgattcgaccaatgtttttcaagcaatggttgtggtctgtccctcaattggtttagatcaccaagctattttgggagagacttacgctgatattgccgcccaaaaagctggtgttttagaagggggcgagacccttgtttttgccgttgaaaacccgtcagctcgagaggtttttttaacaaaagctgagcaggttggtgcttcaatctgggaatggcaagagcagtttcaaatggctgagaacgcatctggctatcgttttactagtcctttaggagttatttcagatattcacatcgctatgccaggacaccaccaagtgtctaatgcagctttagctattatgacttgcttaaccttgaaagaccgctatcctaggctaacttcagatcatataagggaaggtctagcaaatagtttgtggctaggccgtaccgaattattagcaccaaatctaatgattgatggggctcataacaatgaaagcgttgctgctttggtagccgtcttaaaaaataactacaatgataaaaagcttcatattttgtttggtgcgatcgacaccaagcctattgcagatatgttggttgctcttgagcaaataggtgacttgcaggttactagctttcattaccctaacgcctatccattggaaaaatacccagaacgttttggtagggttgctgatttcaaagatttcttggccttgcgtaagcatgctaaagcagatgactttttcgtgattacagggtcactatattttatttcagaaattagacggtattggaaaaaacatattgaaaaaagcgttcttttaacccattaa

SEQ ID NO: 14923 - protein, 421 aa, Streptococcus pyogenes
MKLEWIHDHLVFGIKPGLKRMLWVLGQLGNPQKNVKGVHIVGTNGKGSTVNHLQHIFTTAGYEVGTFTSPYIMDFKERISINGRMISEKDLVIAANRIRPLTERLVQETDFGEVTEFEVITLIMFLYFGDMHPVDIAIIEAGLGGLYDSTNVFQAMVVVCPSIGLDHQAILGETYADIAAQKAGVLEGGETLVFAVENPSAREVFLTKAEQVGASIWEWQEQFQMAENASGYRFTSPLGVISDIHIAMPGHHQVSNAALAIMTCLTLKDRYPRLTSDHIREGLANSLWLGRTELLAPNLMIDGAHNNESVAALVAVLKNNYNDKKLHILFGAIDTKPIADMLVALEQIGDLQVTSFHYPNAYPLEKYPERFGRVADFKDFLALRKHAKADDFFVITGSLYFISEIRRYWKKHIEKSVLLTH

SEQ ID NO: 14924 - DNA, 1224 bp, Thermoplasma volcanium
  CDS (1)..(1224)
atgatgagggaatttgccgatatgcttggccatcctgagagagactttaggtctattcatataacaggatcaaacggtaaaggatcaacatctgcctttatatatagtatattgaggcagaagttcagtgttggagtatatacatcaccacatctagaaagattcaatgaaaggatcattgttgacaatgaagaagttccagatgaatacatagacggttttatagaaaaatataggccaaagtttgatgaactttccaaggtaaataggaaccctacattctttgaagtaactacaatgatggcttttcagtatttcaaggatcgtaaggtggattatgcgtccgttgaagttggtcttggcgggaggcttgatgctacaaacattatcatgccagaagtttcagttatagcgcaagtcggctatgaacatgcagataagttaggctgttctcttacgtctatagcttatgaaaaagctgggatcataaaggaagggagacctatagtgctccaggatgataagcctgaagttgtaaatgaagtaagaaggatagcgcaagttaagcattcccctttaattacccttgataggaacaagataaaaaatttacatgttgatgaaaacgggacggatttcgattttgacggtacaaacgatacttatcacatacatacttcgctgattggtgattaccaggctttgaacgcagcaactgcaatacttgcagttgaaaactctaaagtccaagtatacaaaaaagatatagagaccggtataagcaggactatatggcctggcaggcttgaaataatagatagatcaccgctcgtaataattgatgctgcacacaacccgccggcggcaaataaaatggtgagaaccgtcaagaaggtatttaaccgtgaaccgactattgtagcaggaattctctcggataaagacgcttattcgttttttagtgttttgaggcagttatccggaaagataatattcactacccccgaagagaaagaaagggcagtagatcctaacatactcatggctcaatatggcaatctattcagatcagctagagtaataccagatcctatttccgcgttcgaacatgctaagaaagtcgatgactttgtatttgttacaggatcaatatatctcatcggagttatacgaggactatatgataaggcgaatgaaaagaagggaacaaaaattgttgtataa

SEQ ID NO: 14925 - protein, 407 aa, Thermoplasma volcanium
MMREFADMLGHPERDFRSIHITGSNGKGSTSAFIYSILRQKFSVGVYTSPHLERFNERIIVDNEEVPDEYIDGFIEKYRPKFDELSKVNRNPTFFEVTTMMAFQYFKDRKVDYASVEVGLGGRLDATNIIMPEVSVIAQVGYEHADKLGCSLTSIAYEKAGIIKEGRPIVLQDDKPEVVNEVRRIAQVKHSPLITLDRNKIKNLHVDENGTDFDFDGTNDTYHIHTSLIGDYQALNAATAILAVENSKVQVYKKDIETGISRTIWPGRLEIIDRSPLVIIDAAHNPPAANKMVRTVKKVFNREPTIVAGILSDKDAYSFFSVLRQLSGKIIFTTPEEKERAVDPNILMAQYGNLFRSARVIPDPISAFEHAKKVDDFVFVTGSIYLIGVIRGLYDKANEKKGTKIVV

SEQ ID NO: 14926 - DNA, 1257 bp, Streptococcus suis
  CDS (1)..(1257)
atgaattatcaagaaactcgccggtggctatctagtcgtcctgcatcagatttagaaaatggcgttgcacgtgtcaactggattttggaacgcttggacaatccccagcttcaagtgccgaccgttcacttcgtaggtacaaatggcaagggctcgaccctcaacgccttacagtctatcttacggtcttcggattacaccgtcggtcgctttacctcaccgtctatcattgattttcgagagcagattgtatttgagcaggagatgatttcggaggaagattttgcaaggattgtgacagacttgcaacccttgattgaggacttggaccagacggctggactggatgccatctcggagtttgagattgtagtagtggctatgtttgtctactttgcccactaccagcgtcccgacattctcttggtggaggcgggcatgggtggtttgcaggatgcgaccaatgtccttgccccattggcagtagtttgcccgtccatcggcttggaccatcaggcttttttgggagagacccacgctgctatagcccgtcacaaggttgctgtcttgcgtgagcgggttcccctcctctatgcgaccgaccagtcagaagtggtggcagcatttgaggatcacgccagtcagcttcagagtccgacctatgcggtgggacgggagattcttttggaaaatagcagagcaggctttgctgtttcaagtactctcggccgtgtggaagaattaacactgcagatgcagggtcgtcaccaggaggtcaatgcagccttggcagtgacaacagctcagcttctcagccctgattttccaacaattaccaatgaaaccatccgccagggcttgtcccaagccatctggccgggccgcttagagttgattaggcctaatctcatgattgacggtgcccacaataatgaaagtatcgccgtcctgacacaactcttggaagaaaagtatgctgacagggatattgaaatcctctttgcggccatcaataccaagccagtggaccagatgttgtcccagcttagccaatttggacctgttagcgtgacgacctttgacgatttcagagcggtacagttaggagattatccgtcaggctatgaacgagttcagacctatcaggagtggttggagcaggtggacttggacaatcccaaacaactctacctgattacaggctcgctatatttcattacctatgtgaggaagtacattttagaagaacttgtatag

SEQ ID NO: 14927 - protein, 418 aa, Streptococcus suis
MNYQETRRWLSSRPASDLENGVARVNWILERLDNPQLQVPTVHFVGTNGKGSTLNALQSILRSSDYTVGRFTSPSIIDFREQIVFEQEMISEEDFARIVTDLQPLIEDLDQTAGLDAISEFEIVVVAMFVYFAHYQRPDILLVEAGMGGLQDATNVLAPLAVVCPSIGLDHQAFLGETHAAIARHKVAVLRERVPLLYATDQSEVVAAFEDHASQLQSPTYAVGREILLENSRAGFAVSSTLGRVEELTLQMQGRHQEVNAALAVTTAQLLSPDFPTITNETIRQGLSQAIWPGRLELIRPNLMIDGAHNNESIAVLTQLLEEKYADRDIEILFAAINTKPVDQMLSQLSQFGPVSVTTFDDFRAVQLGDYPSGYERVQTYQEWLEQVDLDNPKQLYLITGSLYFITYVRKYILEELV

SEQ ID NO: 14928 - DNA, 1257 bp, Streptococcus suis
  CDS (1)..(1257)
atgaattatcaagaaactcgccggtggctatctagtcgtcctgcatcagatttagaaaatggcgttgcacgtgtcaactggattttagaacgcttggacaatccccagcttcaagtgccgaccgtacactttgtgggcacaaatggcaagggctcgaccctcaacgccttacagtctatcttgcagtcttcggattacaccgtcggccgctttacatcaccgtctatcattgattttcgagagcagattgtctaccagcaggagatgatttcggaggaagattttgcgaggattgtgacagacttgcaacccttgatcgaggacttggaccagacggctggactggatgccatctcggagtttgagattgtagtagtggctatgtttgtctactttgcccactaccagcgtcccgatattctcttggtggaggccggcatgggtggtttgcaggatgcgaccaatgtccttgcccccttggcagtagtttgtccgtccatcggtttggaccatcaggcatttttgggagagacccacgctgctatagcccgtcacaaggtcgccgtcttgcgtgagggggttccgctcatctatgcgaccgaccagccagaagtggagacagtatttgaggagcatgcctgtcagcttcagagtccgacctatgcggtggggcgggagattcttttggaaaatagcagagcaggctttgcagtttcaagtcctctcggccgtgtggaagagttaacactacagatgcagggtcgtcaccaggaggtcaatgcagccttggcagtgacaacagctcagctcattaaacctcattttccaacaattaccaatgaaaccatccgccagggcttgtcccaagccatctggccgggtcgcttagagttgattaggcctaatctcatgattgacggtgcccacaataatgaaagtatcgccgtcctgacacaactcttggaagaaaagtatgctgacagggatattgaaatcctctttgcggccatcaataccaagccagtggaccagatgttgtcccagcttagccaatttggacctgttagcgtgacgacctttgacgatttcagagcggtacagttagaagattatccgtcaggctatgaacgagttcagacctatcaggagtgggtggagcaggcggacttggacaatcccaaaaaactctacctgattacaggctcgctatatttcattacctatgtgaggaagtacattttagaagaacttgtttag

SEQ ID NO: 14929 - protein, 418 aa, Streptococcus suis
MNYQETRRWLSSRPASDLENGVARVNWILERLDNPQLQVPTVHFVGTNGKGSTLNALQSILQSSDYTVGRFTSPSIIDFREQIVYQQEMISEEDFARIVTDLQPLIEDLDQTAGLDAISEFEIVVVAMFVYFAHYQRPDILLVEAGMGGLQDATNVLAPLAVVCPSIGLDHQAFLGETHAAIARHKVAVLREGVPLIYATDQPEVETVFEEHACQLQSPTYAVGREILLENSRAGFAVSSPLGRVEELTLQMQGRHQEVNAALAVTTAQLIKPHFPTITNETIRQGLSQAIWPGRLELIRPNLMIDGAHNNESIAVLTQLLEEKYADRDIEILFAAINTKPVDQMLSQLSQFGPVSVTTFDDFRAVQLEDYPSGYERVQTYQEWVEQADLDNPKKLYLITGSLYFITYVRKYILEELV

SEQ ID NO: 14930 - DNA, 1239 bp, Neurospora crassa
  CDS (1)..(1239)
atgatcgatctcggactggcccgcatcgggcgtcttcttcagcacacgccgcagacctggaaggccatccacgttgccggcaccaacggcaagggctcaatatgcgcctatctctcggctatgctcagtgccagcggtgtctcgtgtgcgaggttcacctcaccccatctcatcgaccgctgggactgcatcactatcaatgagaagcccgtctccgagacgatattccgtcaagtcgagggcttggtcaagcaacgggatcaggacgagaagatcggggccaccgagttcgagctccttgctgcgaccgcctttgagatctttcaccgtctgaaagttgagtatggcgtaatcgaggttggtctcggcgggaagctggacgctaccaacatcttgaagcacaagtccgttaccgtcatcgcaaaaattggtcttgatcaccagtccttcctaggaaacacggttgaggagatcgcgctgcaaaaagcaggcattatccgctccggcgttccctgtgtcgtcgatgacagcaacgagtcttcggtcctgaaagtgattcaagaccatgcgaaggaggtcggcggcgtagagctgcactatccctcatcagattccgccctgttgcagattctcaccaaagaaggctatgagccgcatcaagttcagaatctggcgtgcgcgttgttggcctttcgcttagcgtgtccggatgttgaccactcgatgagtcgtctcctccccatcgttaagcagctgcaatggcccggtcgtctgcaaaaaattgatctctttcccatcatcaggcagcatcaagaggctctgctggacggagcccacaatagccagtcggccgaagttttggctgggtatgtcaacaagcactaccgctcgcggagtcaatcaattacttgggttctggccgcttccaagggcaaagatgtggacagtattatgtcccacatcatacagccgagcgatcatgtcacggctgtgcagtttgggcaagtggatggaatgccgtgggttaaagccgaggacccggccaacttgatcaaccaggcaacccgttatggcgttgagactcaaaatacgcacaactcgggagatgatgtacgagctgccctcgaatgggcatccaaggctgcaggagataagccgattgttgttgctggaagtttgtacctggtctccagtgtcctgcgtctcatgcgtgaggcggaatcttaccaaaaggcgtga

SEQ ID NO: 14931 - protein, 412 aa, Neurospora crassa
MIDLGLARIGRLLQHTPQTWKAIHVAGTNGKGSICAYLSAMLSASGVSCARFTSPHLIDRWDCITINEKPVSETIFRQVEGLVKQRDQDEKIGATEFELLAATAFEIFHRLKVEYGVIEVGLGGKLDATNILKHKSVTVIAKIGLDHQSFLGNTVEEIALQKAGIIRSGVPCVVDDSNESSVLKVIQDHAKEVGGVELHYPSSDSALLQILTKEGYEPHQVQNLACALLAFRLACPDVDHSMSRLLPIVKQLQWPGRLQKIDLFPIIRQHQEALLDGAHNSQSAEVLAGYVNKHYRSRSQSITWVLAASKGKDVDSIMSHIIQPSDHVTAVQFGQVDGMPWVKAEDPANLINQATRYGVETQNTHNSGDDVRAALEWASKAAGDKPIVVAGSLYLVSSVLRLMREAESYQKA

SEQ ID NO: 14932 - DNA, 1275 bp, Thermoplasma acidophilum
  CDS (1)..(1275)
atgctctcaaatcttgattatctttatggattgaagagggaaggcattaaatttgacctcgatgtgatgagaggttttgctgacatgatcgggcatcctgagaacaggttcaaaagtttccatataacaggttcaaatggaaaaggatctacatcggaattcatatactcaatattaaggcaaaaattcagcgcagggatctatacatctccacacctgataaaattcaacgaacgcataatggtaaacgacagtatgatacctgatgattacatagattccttcataggaaaataccggccaatgatagaggatcttgccaagatcaacagaaacccaacattttttgaagtcacgaccatgatggcctttcagtacttcgccgatatgaaggttgactatgcctcagtggaggttgggctcggcggaaggcttgacgccaccaacataattatgcctctagtgagcgtgataacgcaggtgggctacgaacacgcagacaagcttggctgctcgcttacctctattgcatacgaaaaaggcggcataataaaggagggaaggccaatagtgcttcaggatcagaagcctgaagttgtgaagacgataaagagcatatctcaggtgcgcggatcgccactgatcatgctcgatccccaaaaaatacggggcctgaatctatccgaagctggcacatcgttcgatttcgaaggcatgaacgggacatatcaccttgaaaccgacctgataggtgaataccaggctctgaatgcagcgaccgccgtgcttgccatagaagcctctggaataggcctagaaaaaaatgacattgagagggggataaaaagcgcaaggtggcctggccgccttgaaataataagcagagatccgctgataatcatagatgcggcacacaatccacctgccgtgaacaagatggccaatacattccgcaaggtattcaccaagaagcccctcatagttgccggtatactatcagataaggattcatatgcatacttccacgtcatacgccagatctcagacaggataatattcacaaccccggaggagaaggaaagggcggtagatccaaagaaactctacgatctttacggccatctattttcagaggccagagtgatccctgatccaatagatgccgtgaacgaggccgcaaaaagatccgacttcgtcctggtcactggatcgatatacctcataggtgccgtgaaggagtactacgaaaagaagagagaaaaggtggttgcctga

SEQ ID NO: 14933 - protein, 424 aa, Thermoplasma acidophilum
MLSNLDYLYGLKREGIKFDLDVMRGFADMIGHPENRFKSFHITGSNGKGSTSEFIYSILRQKFSAGIYTSPHLIKFNERIMVNDSMIPDDYIDSFIGKYRPMIEDLAKINRNPTFFEVTTMMAFQYFADMKVDYASVEVGLGGRLDATNIIMPLVSVITQVGYEHADKLGCSLTSIAYEKGGIIKEGRPIVLQDQKPEVVKTIKSISQVRGSPLIMLDPQKIRGLNLSEAGTSFDFEGMNGTYHLETDLIGEYQALNAATAVLAIEASGIGLEKNDIERGIKSARWPGRLEIISRDPLIIIDAAHNPPAVNKMANTFRKVFTKKPLIVAGILSDKDSYAYFHVIRQISDRIIFTTPEEKERAVDPKKLYDLYGHLFSEARVIPDPIDAVNEAAKRSDFVLVTGSIYLIGAVKEYYEKKREKVVA

SEQ ID NO: 14934 - DNA, 1569 bp, Plasmodium falciparum
  CDS (1)..(1569)
atggaaaaaaatcaaaatgataaaagtaacaaaaatgatataattcacatgaatgataaaagtggaaattatgataaaaataatataaataattttattgataaaaatgatgagcatgatatgagtgacatattacataaaataaataatgaggaaaaaaaatatgaagaaataaaatcttacagtgagtgcttagaattattatataaaacacatgccctaaaattaggacttgataacccaaaaaaattgaacgaatcttttggtcacccttgtgataaatataaaactattcatattgcagggacaaatgggaaagggtctgtatgctataaaatatatacatgtcttaaaataaaaaaattcaaggtgggtcttttttcatcacctcatatattttctttaagagaaagaattatagtaaacgatgaaccaataagtgaaaaagagttaatacatttagtaaacgaagtattaaataaagccaaaaaattatatataaatccatctttttttgaaataattacattagttgcatttttacattttttaaataagaaggtagattatgctataatagaaacagggattggagggcgcttagatgcaactaatatattaaccaaaccagaagttattgtaattacttccataggatatgatcatttaaatatattaggtgataatttgcctattatatgtaatgaaaaaattggaatttttaaaaaagatgctaacgttgtaataggaccatcagtagctatttataaaaatgtttttgataaggcaaaagaattaaattgtactatacatactgtagtacctgaaccacgaggagaaagatataatgaagaaaattcaagaatagcattgcgcactttagaaatattaaatataagtatagattactttttaaagtccattataccaattaaaccacctttaagaattcaatatttagctaccgagcaaatacaacatataaagaaaaaattttcaccagataatttagaacacaatgtacaatatcctctagctgttattttagatgtaggccacaatgaaacggcaatagatagattgtgtaccgatattaattattttcataagggacaaaatataaggatatgtatatctataacaaagccgagaaacttgagtgtattccatccgttcatagctcaatttggcgacaccttaaaggatatattttaccttccatcattaaatgaaaggacctacgactttgaggaaatcgttgagatgttaaataatgaagaagaaataaaaaatgaaataaaagagctcatattaagtagctctaaaaaggttggtaaatggttagctcatgagaaacaaggaaatattaatgaagaagatgcacttaaattatacaaaagaggatgcataccattaataatcaaaaatgcatttcttgaatgttgcaaagacaatagtatattattagtatgtgggacgtttttcgtgtttgatgaggttttaaacgtttttgatattcactctgatatgcaagataccatttttatgaatgaaccatctcttgtttaa

SEQ ID NO: 14935 - protein, 522 aa, Plasmodium falciparum
MEKNQNDKSNKNDIIHMNDKSGNYDKNNINNFIDKNDEHDMSDILHKINNEEKKYEEIKSYSECLELLYKTHALKLGLDNPKKLNESFGHPCDKYKTIHIAGTNGKGSVCYKIYTCLKIKKFKVGLFSSPHIFSLRERIIVNDEPISEKELIHLVNEVLNKAKKLYINPSFFEIITLVAFLHFLNKKVDYAIIETGIGGRLDATNILTKPEVIVITSIGYDHLNILGDNLPIICNEKIGIFKKDANVVIGPSVAIYKNVFDKAKELNCTIHTVVPEPRGERYNEENSRIALRTLEILNISIDYFLKSIIPIKPPLRIQYLATEQIQHIKKKFSPDNLEHNVQYPLAVILDVGHNETAIDRLCTDINYFHKGQNIRICISITKPRNLSVFHPFIAQFGDTLKDIFYLPSLNERTYDFEEIVEMLNNEEEIKNEIKELILSSSKKVGKWLAHEKQGNINEEDALKLYKRGCIPLIIKNAFLECCKDNSILLVCGTFFVFDEVLNVFDIHSDMQDTIFMNEPSLV

SEQ ID NO: 14936 - DNA, 25 bp, Primer
atggatgatataagcggaaggcaaa

SEQ ID NO: 14937 - DNA, 24 bp, Primer
ctatactggcaagtgacagttgtg

SEQ ID NO: 14938 - DNA, 432 bp, Saccharomyces cerevisiae; identical to SEQ ID NO: 6880
  CDS (1)..(432)

SEQ ID NO: 14939 - protein, 143 aa, Saccharomyces cerevisiae; identical to SEQ ID NO: 6881

SEQ ID NO: 14940 - DNA, 309 bp, Arabidopsis thaliana (mouse-ear cress); identical to SEQ ID NO: 6882
  CDS (1)..(309)

SEQ ID NO: 14941 - protein, 102 aa, Arabidopsis thaliana (mouse-ear cress); identical to SEQ ID NO: 6883

SEQ ID NO: 14942 - DNA, 501 bp, Brucella melitensis; identical to SEQ ID NO: 6884
  CDS (28)..(306)

SEQ ID NO: 14943 - protein, 92 aa, Brucella melitensis; identical to SEQ ID NO: 6885

SEQ ID NO: 14944 - DNA, 324 bp, Nostoc sp. PCC 7120; identical to SEQ ID NO: 6886
  CDS (1)..(324)

SEQ ID NO: 14945 - protein, 107 aa, Nostoc sp. PCC 7120; identical to SEQ ID NO: 6887

SEQ ID NO: 14946 - DNA, 309 bp, Arabidopsis thaliana (mouse-ear cress); identical to SEQ ID NO: 6888
  CDS (1)..(309)

SEQ ID NO: 14947 - protein, 102 aa, Arabidopsis thaliana (mouse-ear cress); identical to SEQ ID NO: 6889

SEQ ID NO: 14948 - DNA, 540 bp, Arabidopsis thaliana (mouse-ear cress); identical to SEQ ID NO: 6890
  CDS (1)..(540)

SEQ ID NO: 14949 - protein, 179 aa, Arabidopsis thaliana (mouse-ear cress); identical to SEQ ID NO: 6891

SEQ ID NO: 14950 - DNA, 327 bp, vaccinia virus; identical to SEQ ID NO: 6892
  CDS (1)..(327)

SEQ ID NO: 14951 - protein, 108 aa, vaccinia virus; identical to SEQ ID NO: 6893

SEQ ID NO: 14952 - DNA, 312 bp, Arabidopsis thaliana (mouse-ear cress); identical to SEQ ID NO: 6894
  CDS (1)..(312)

SEQ ID NO: 14953 - protein, 103 aa, Arabidopsis thaliana (mouse-ear cress); identical to SEQ ID NO: 6895

SEQ ID NO: 14954 - DNA, 309 bp, Arabidopsis thaliana (mouse-ear cress); identical to SEQ ID NO: 6896
  CDS (1)..(309)

SEQ ID NO: 14955 - protein, 102 aa, Arabidopsis thaliana (mouse-ear cress); identical to SEQ ID NO: 6897

SEQ ID NO: 14956 - DNA, 309 bp, Arabidopsis thaliana (mouse-ear cress); identical to SEQ ID NO: 6898
  CDS (1)..(309)

SEQ ID NO: 14957 - protein, 102 aa, Arabidopsis thaliana (mouse-ear cress); identical to SEQ ID NO: 6899

SEQ ID NO: 14958 - DNA, 393 bp, Arabidopsis thaliana (mouse-ear cress); identical to SEQ ID NO: 6900
  CDS (1)..(393)

SEQ ID NO: 14959 - protein, 130 aa, Arabidopsis thaliana (mouse-ear cress); identical to SEQ ID NO: 6901

SEQ ID NO: 14960 - DNA, 589 bp, Bos primigenius taurus (cattle); identical to SEQ ID NO: 6902
  CDS (36)..(356)

SEQ ID NO: 14961 - protein, 106 aa, Bos primigenius taurus (cattle); identical to SEQ ID NO: 6903

SEQ ID NO: 14962 - DNA, 309 bp, Arabidopsis thaliana (mouse-ear cress); identical to SEQ ID NO: 6904
  CDS (1)..(309)

SEQ ID NO: 14963 - protein, 102 aa, Arabidopsis thaliana (mouse-ear cress); identical to SEQ ID NO: 6905

SEQ ID NO: 14964 - DNA, 309 bp, Arabidopsis thaliana (mouse-ear cress); identical to SEQ ID NO: 6906
  CDS (1)..(309)

SEQ ID NO: 14965 - protein, 102 aa, Arabidopsis thaliana (mouse-ear cress); identical to SEQ ID NO: 6907

SEQ ID NO: 14966 - DNA, 575 bp, Oryza sativa (rice); identical to SEQ ID NO: 6908
  CDS (45)..(383)

SEQ ID NO: 14967 - protein, 112 aa, Oryza sativa (rice); identical to SEQ ID NO: 6909

SEQ ID NO: 14968 - DNA, 333 bp, Saccharomyces cerevisiae; identical to SEQ ID NO: 6910
  CDS (1)..(333)

SEQ ID NO: 14969 - protein, 110 aa, Saccharomyces cerevisiae; identical to SEQ ID NO: 6911

SEQ ID NO: 14970 - DNA, 612 bp, Saccharomyces cerevisiae; identical to SEQ ID NO: 6912
  CDS (1)..(612)

SEQ ID NO: 14971 - protein, 203 aa, Saccharomyces cerevisiae; identical to SEQ ID NO: 6913

SEQ ID NO: 14972 - DNA, 321 bp, Homo sapiens (man); identical to SEQ ID NO: 6914
  CDS (1)..(321)

SEQ ID NO: 14973 - protein, 106 aa, Homo sapiens (man); identical to SEQ ID NO: 6915

SEQ ID NO: 14974 - DNA, 583 bp, Ricinus communis (castor bean); identical to SEQ ID NO: 6916
  CDS (44)..(352)

SEQ ID NO: 14975 - protein, 102 aa, Ricinus communis (castor bean); identical to SEQ ID NO: 6917

SEQ ID NO: 14976 - DNA, 531 bp, Arabidopsis thaliana (mouse-ear cress); identical to SEQ ID NO: 6918
  CDS (1)..(531)

SEQ ID NO: 14977 - protein, 176 aa, Arabidopsis thaliana (mouse-ear cress); identical to SEQ ID NO: 6919

SEQ ID NO: 14978 - DNA, 698 bp, Mesembryanthemum crystallinum (common ice plant); identical to SEQ ID NO: 6920
  CDS (60)..(464)

SEQ ID NO: 14979 - protein, 134 aa, Mesembryanthemum crystallinum (common ice plant); identical to SEQ ID NO: 6921

SEQ ID NO: 14980 - DNA, 441 bp, Caenorhabditis elegans; identical to SEQ ID NO: 6922
  CDS (1)..(441)

SEQ ID NO: 14981 - protein, 146 aa, Caenorhabditis elegans; identical to SEQ ID NO: 6923

SEQ ID NO: 14982 - DNA, 361 bp, Schizosaccharomyces pombe; identical to SEQ ID NO: 6924
  CDS (24)..(329)

SEQ ID NO: 14983 - protein, 101 aa, Schizosaccharomyces pombe; identical to SEQ ID NO: 6925

SEQ ID NO: 14984 - DNA, 501 bp, Schizosaccharomyces pombe; identical to SEQ ID NO: 6926
  CDS (1)..(501)

SEQ ID NO: 14985 - protein, 166 aa, Schizosaccharomyces pombe; identical to SEQ ID NO: 6927

SEQ ID NO: 14986 - DNA, 309 bp, Arabidopsis thaliana (mouse-ear cress); identical to SEQ ID NO: 6928
  CDS (1)..(309)

SEQ ID NO: 14987 - protein, 102 aa, Arabidopsis thaliana (mouse-ear cress); identical to SEQ ID NO: 6929

SEQ ID NO: 14988 - DNA, 312 bp, Arabidopsis thaliana (mouse-ear cress); identical to SEQ ID NO: 6930
  CDS (1)..(312)

SEQ ID NO: 14989 - protein, 103 aa, Arabidopsis thaliana (mouse-ear cress); identical to SEQ ID NO: 6931

SEQ ID NO: 14990 - DNA, 391 bp, Arabidopsis thaliana (mouse-ear cress); identical to SEQ ID NO: 6932
  CDS (33)..(341)

SEQ ID NO: 14991 - protein, 102 aa, Arabidopsis thaliana (mouse-ear cress); identical to SEQ ID NO: 6933

SEQ ID NO: 14992 - DNA, 330 bp, Neurospora crassa; identical to SEQ ID NO: 6934
  CDS (1)..(330)

SEQ ID NO: 14993 - protein, 109 aa, Neurospora crassa; identical to SEQ ID NO: 6935

SEQ ID NO: 14994 - DNA, 533 bp, Fritillaria agrestis; identical to SEQ ID NO: 6936
  CDS (39)..(353)

SEQ ID NO: 14995 - protein, 104 aa, Fritillaria agrestis; identical to SEQ ID NO: 6937

SEQ ID NO: 14996 - DNA, 330 bp, Plasmodium yoelii yoelii; identical to SEQ ID NO: 6938
  CDS (1)..(330): m means a or c

SEQ ID NO: 14997 - protein, 109 aa, Plasmodium yoelii yoelii; identical to SEQ ID NO: 6939
  misc_feature (54)..(54): Xaa can be Asn or His

SEQ ID NO: 14998 - DNA, 294 bp, Bordetella bronchiseptica; identical to SEQ ID NO: 6940
  CDS (1)..(294)

SEQ ID NO: 14999 - protein, 97 aa, Bordetella bronchiseptica; identical to SEQ ID NO: 6941

SEQ ID NO: 15000 - DNA, 342 bp, Triticum aestivum; identical to SEQ ID NO: 6942
  CDS (1)..(342)

SEQ ID NO: 15001 - protein, 113 aa, Triticum aestivum; identical to SEQ ID NO: 6943

SEQ ID NO: 15002 - DNA, 324 bp, Aphelenchus avenae; identical to SEQ ID NO: 6944
  CDS (1)..(324)

SEQ ID NO: 15003 - protein, 107 aa, Aphelenchus avenae; identical to SEQ ID NO: 6945

SEQ ID NO: 15004 - DNA, 327 bp, Cowpox virus; identical to SEQ ID NO: 6946
  CDS (1)..(327)

SEQ ID NO: 15005 - protein, 108 aa, Cowpox virus; identical to SEQ ID NO: 6947

SEQ ID NO: 15006 - DNA, 495 bp, Oryza sativa; identical to SEQ ID NO: 6948
  CDS (1)..(495)

SEQ ID NO: 15007 - protein, 164 aa, Oryza sativa; identical to SEQ ID NO: 6949

SEQ ID NO: 15008 - DNA, 270 bp, Vibrio vulnificus; identical to SEQ ID NO: 6950
  CDS (1)..(270)

SEQ ID NO: 15009 - protein, 89 aa, Vibrio vulnificus; identical to SEQ ID NO: 6951

SEQ ID NO: 15010 - DNA, 525 bp, Arabidopsis thaliana; identical to SEQ ID NO: 6952
  CDS (1)..(525)

SEQ ID NO: 15011 - protein, 174 aa, Arabidopsis thaliana; identical to SEQ ID NO: 6953

SEQ ID NO: 15012 - DNA, 608 bp, Arabidopsis thaliana; identical to SEQ ID NO: 6954
  CDS (68)..(445)

SEQ ID NO: 15013 - protein, 125 aa, Arabidopsis thaliana; identical to SEQ ID NO: 6955

SEQ ID NO: 15014 - DNA, 340 bp, Arabidopsis thaliana; identical to SEQ ID NO: 6956
  CDS (1)..(309)

SEQ ID NO: 15015 - protein, 102 aa, Arabidopsis thaliana; identical to SEQ ID NO: 6957

SEQ ID NO: 15016 - DNA, 618 bp, Arabidopsis thaliana; identical to SEQ ID NO: 6958
  CDS (54)..(461)

SEQ ID NO: 15017 - protein, 135 aa, Arabidopsis thaliana; identical to SEQ ID NO: 6959

SEQ ID NO: 15018 - DNA, 420 bp, Populus tremula x Populus tremuloides; identical to SEQ ID NO: 6960
  CDS (1)..(420)

SEQ ID NO: 15019 - protein, 139 aa, Populus tremula x Populus tremuloides; identical to SEQ ID NO: 6961

SEQ ID NO: 15020 - DNA, 664 bp, Mus musculus; identical to SEQ ID NO: 6962
  CDS (37)..(507)

SEQ ID NO: 15021 - protein, 156 aa, Mus musculus; identical to SEQ ID NO: 6963

SEQ ID NO: 15022 - DNA, 508 bp, Tilia platyphyllos; identical to SEQ ID NO: 6964
  CDS (28)..(375)

SEQ ID NO: 15023 - protein, 115 aa, Tilia platyphyllos; identical to SEQ ID NO: 6965

SEQ ID NO: 15024 - DNA, 604 bp, Deschampsia antarctica; identical to SEQ ID NO: 6966
  CDS (85)..(426)

SEQ ID NO: 15025 - protein, 113 aa, Deschampsia antarctica; identical to SEQ ID NO: 6967

SEQ ID NO: 15026 - DNA, 327 bp, Plasmodium berghei; identical to SEQ ID NO: 6968
  CDS (1)..(327)

SEQ ID NO: 15027 - protein, 108 aa, Plasmodium berghei; identical to SEQ ID NO: 6969

SEQ ID NO: 15028 - DNA, 498 bp, Homo sapiens; identical to SEQ ID NO: 6970
  CDS (1)..(498)

SEQ ID NO: 15029 - protein, 165 aa, Homo sapiens; identical to SEQ ID NO: 6971

SEQ ID NO: 15030 - DNA, 456 bp, Theileria parva; identical to SEQ ID NO: 6972
  CDS (1)..(456)

SEQ ID NO: 15031 - protein, 151 aa, Theileria parva; identical to SEQ ID NO: 6973

SEQ ID NO: 15032 - DNA, 336 bp, Arabidopsis thaliana; identical to SEQ ID NO: 6974
  CDS (1)..(336)

SEQ ID NO: 15033 - protein, 111 aa, Arabidopsis thaliana; identical to SEQ ID NO: 6975

SEQ ID NO: 15034 - DNA, 383 bp, Mus musculus; identical to SEQ ID NO: 6976
  CDS (15)..(383)

SEQ ID NO: 15035 - protein, 122 aa, Mus musculus; identical to SEQ ID NO: 6977

SEQ ID NO: 15036 - DNA, 318 bp, Caenorhabditis elegans; identical to SEQ ID NO: 6978
  CDS (1)..(318)

SEQ ID NO: 15037 - protein, 105 aa, Caenorhabditis elegans; identical to SEQ ID NO: 6979

SEQ ID NO: 15038 - DNA, 324 bp, Trypanosoma brucei; identical to SEQ ID NO: 6980
  CDS (1)..(324)

SEQ ID NO: 15039 - protein, 107 aa, Trypanosoma brucei; identical to SEQ ID NO: 6981

SEQ ID NO: 15040 - DNA, 336 bp, Plasmodium falciparum; identical to SEQ ID NO: 6982
  CDS (1)..(336)

SEQ ID NO: 15041 - protein, 111 aa, Plasmodium falciparum; identical to SEQ ID NO: 6983

SEQ ID NO: 15042 - DNA, 654 bp, Homo sapiens; identical to SEQ ID NO: 6984
  CDS (11)..(505)

SEQ ID NO: 15043 - protein, 164 aa, Homo sapiens; identical to SEQ ID NO: 6985

SEQ ID NO: 15044 - DNA, 478 bp, Drosophila melanogaster; identical to SEQ ID NO: 6986
  CDS (48)..(392)

SEQ ID NO: 15045 - protein, 114 aa, Drosophila melanogaster; identical to SEQ ID NO: 6987

SEQ ID NO: 15046 - DNA, 351 bp, Drosophila melanogaster; identical to SEQ ID NO: 6988
  CDS (1)..(351)

SEQ ID NO: 15047 - protein, 116 aa, Drosophila melanogaster; identical to SEQ ID NO: 6989

SEQ ID NO: 15048 - DNA, 644 bp, Homo sapiens; identical to SEQ ID NO: 6990
  CDS (26)..(481)

SEQ ID NO: 15049 - protein, 151 aa, Homo sapiens; identical to SEQ ID NO: 6991

SEQ ID NO: 15050 - DNA, 572 bp, Gallus gallus; identical to SEQ ID NO: 6992
  CDS (47)..(352)

SEQ ID NO: 15051 - protein, 101 aa, Gallus gallus; identical to SEQ ID NO: 6993

SEQ ID NO: 15052 - DNA, 321 bp, Homo sapiens; identical to SEQ ID NO: 6994
  CDS (1)..(321)

SEQ ID NO: 15053 - protein, 106 aa, Homo sapiens; identical to SEQ ID NO: 6915

SEQ ID NO: 15054 - DNA, 531 bp, Lycopersicon esculentum; identical to SEQ ID NO: 6996
  CDS (45)..(371)

SEQ ID NO: 15055 - protein, 108 aa, Lycopersicon esculentum; identical to SEQ ID NO: 6997

SEQ ID NO: 15056 - DNA, 473 bp, Mus musculus; identical to SEQ ID NO: 6998
  CDS (9)..(332)

SEQ ID NO: 15057 - protein, 107 aa, Mus musculus; identical to SEQ ID NO: 6999

SEQ ID NO: 15058 - DNA, 575 bp, Sus scrofa; identical to SEQ ID NO: 7000
  CDS (24)..(344)

SEQ ID NO: 15059 - protein, 106 aa, Sus scrofa; identical to SEQ ID NO: 7001

SEQ ID NO: 15060 - DNA, 432 bp, Saccharomyces cerevisiae; identical to SEQ ID NO: 6880
  CDS (1)..(432)

SEQ ID NO: 15061 - protein, 143 aa, Saccharomyces cerevisiae; identical to SEQ ID NO: 6881

SEQ ID NO: 15062 - DNA, 441 bp, Caenorhabditis elegans; identical to SEQ ID NO: 6922
  CDS (1)..(441)

SEQ ID NO: 15063 - protein, 146 aa, Caenorhabditis elegans; identical to SEQ ID NO: 6923

SEQ ID NO: 15064 - DNA, 324 bp, Rattus norvegicus; identical to SEQ ID NO: 7006
  CDS (1)..(324)

SEQ ID NO: 15065 - protein, 107 aa, Rattus norvegicus; identical to SEQ ID NO: 7007

SEQ ID NO: 15066 - DNA, 378 bp, Arabidopsis thaliana; identical to SEQ ID NO: 7008
  CDS (1)..(378)

SEQ ID NO: 15067 - protein, 125 aa, Arabidopsis thaliana; identical to SEQ ID NO: 7009

SEQ ID NO: 15068 - DNA, 651 bp, Ashbya gossypii; identical to SEQ ID NO: 7010
  CDS (1)..(651)

SEQ ID NO: 15069 - protein, 216 aa, Ashbya gossypii; identical to SEQ ID NO: 7011

SEQ ID NO: 15070 - DNA, 336 bp, Ashbya gossypii; identical to SEQ ID NO: 7012
  CDS (1)..(336)

SEQ ID NO: 15071 - protein, 111 aa, Ashbya gossypii; identical to SEQ ID NO: 7013

SEQ ID NO: 15072 - DNA, 25 bp, Primer
atggagaccaatttttccttcgact

SEQ ID NO: 15073 - DNA, 26 bp, Primer
ctattgaaataccggcttcaatattt

SEQ ID NO: 15074 - DNA, 1716 bp, Saccharomyces cerevisiae; identical to SEQ ID NO: 230
  CDS (1)..(1716)

SEQ ID NO: 15075 - protein, 571 aa, Saccharomyces cerevisiae; identical to SEQ ID NO: 231

SEQ ID NO: 15076 - DNA, 2817 bp, Neurospora crassa; identical to SEQ ID NO: 1285
  CDS (1)..(2817)

SEQ ID NO: 15077 - protein, 938 aa, Neurospora crassa; identical to SEQ ID NO: 239

SEQ ID NO: 15078 - DNA, 2658 bp, Mus musculus; identical to SEQ ID NO: 1287
  CDS (1)..(2658)

SEQ ID NO: 15079 - protein, 885 aa, Mus musculus; identical to SEQ ID NO: 245

SEQ ID NO: 15080 - DNA, 2583 bp, Xenopus laevis; identical to SEQ ID NO: 246
  CDS (1)..(2583)

SEQ ID NO: 15081 - protein, 860 aa, Xenopus laevis; identical to SEQ ID NO: 247

SEQ ID NO: 15082 - DNA, 2568 bp, Homo sapiens; identical to SEQ ID NO: 1291
  CDS (1)..(2568)

SEQ ID NO: 15083 - protein, 855 aa, Homo sapiens; identical to SEQ ID NO: 241

SEQ ID NO: 15084 - DNA, 2625 bp, Homo sapiens; identical to SEQ ID NO: 242
  CDS (1)..(2625)

SEQ ID NO: 15085 - protein, 874 aa, Homo sapiens; identical to SEQ ID NO: 243

SEQ ID NO: 15086 - DNA, 2076 bp, Caenorhabditis elegans; identical to SEQ ID NO: 1295
  CDS (1)..(2076)

SEQ ID NO: 15087 - protein, 691 aa, Caenorhabditis elegans; identical to SEQ ID NO: 235

SEQ ID NO: 15088 - DNA, 1782 bp, Schizosaccharomyces pombe; identical to SEQ ID NO: 1297
  CDS (1)..(1782)

SEQ ID NO: 15089 - protein, 593 aa, Schizosaccharomyces pombe; identical to SEQ ID NO: 237

SEQ ID NO: 15090 - DNA, 26 bp, Primer
atgaatgatcctcgtgaaattttagc

SEQ ID NO: 15091 - DNA, 25 bp, Primer
ttatattatctcaagatcgctggca

SEQ ID NO: 15092 - DNA, 603 bp, Saccharomyces cerevisiae; identical to SEQ ID NO: 1305
  CDS (1)..(603)

SEQ ID NO: 15093 - protein, 200 aa, Saccharomyces cerevisiae; identical to SEQ ID NO: 1306

SEQ ID NO: 15094 - DNA, 714 bp, Candida albicans; identical to SEQ ID NO: 1307
  CDS (1)..(714)

SEQ ID NO: 15095 - protein, 237 aa, Candida albicans; identical to SEQ ID NO: 1308

SEQ ID NO: 15096 - DNA, 24 bp, Primer
atggcaggtatcaagttgacgcat

SEQ ID NO: 15097 - DNA, 28 bp, Primer
tcattttgttaatagttttttgtatgct

SEQ ID NO: 15098 - DNA, 1062 bp, Escherichia coli K12; identical to SEQ ID NO: 2732
  CDS (1)..(1062)

SEQ ID NO: 15099 - protein, 353 aa, Escherichia coli K12; identical to SEQ ID NO: 2733

SEQ ID NO: 15100 - DNA, 1444 bp, Pseudomonas fluorescens; identical to SEQ ID NO: 2734
  CDS (156)..(1214)

SEQ ID NO: 15101 - protein, 352 aa, Pseudomonas fluorescens; identical to SEQ ID NO: 2735

SEQ ID NO: 15102 - DNA, 1484 bp, Haemophilus influenzae; identical to SEQ ID NO: 2736
  CDS (278)..(1342)

SEQ ID NO: 15103 - protein, 354 aa, Haemophilus influenzae; identical to SEQ ID NO: 2737

SEQ ID NO: 15104 - DNA, 1131 bp, Thermus aquaticus; identical to SEQ ID NO: 2738
  CDS (62)..(1084)

SEQ ID NO: 15105 - protein, 340 aa, Thermus aquaticus; identical to SEQ ID NO: 2739

SEQ ID NO: 15106 - DNA, 1196 bp, Aquifex pyrophilus; identical to SEQ ID NO: 2740
  CDS (51)..(1097)

SEQ ID NO: 15107 - protein, 348 aa, Aquifex pyrophilus; identical to SEQ ID NO: 2741

SEQ ID NO: 15108 - DNA, 1023 bp, Rickettsia prowazekii; identical to SEQ ID NO: 2742
  CDS (1)..(1023)

SEQ ID NO: 15109 - protein, 340 aa, Rickettsia prowazekii; identical to SEQ ID NO: 2743

SEQ ID NO: 15110 - DNA, 1329 bp, Myxococcus xanthus; identical to SEQ ID NO: 2744
  CDS (201)..(1229)

SEQ ID NO: 15111 - protein, 342 aa, Myxococcus xanthus; identical to SEQ ID NO: 2745

SEQ ID NO: 15112 - DNA, 1394 bp, Legionella pneumophila; identical to SEQ ID NO: 2746
  CDS (166)..(1212)

SEQ ID NO: 15113 - protein, 348 aa, Legionella pneumophila; identical to SEQ ID NO: 2747

SEQ ID NO: 15114 - DNA, 1224 bp, Treponema pallidum subsp. pallidum (syphilis spirochete); identical to SEQ ID NO: 2748
  CDS (1)..(1224): k means g or t/u

SEQ ID NO: 15115 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 15116 - DNA, 1050 bp, Clostridium acetobutylicum; identical to SEQ ID NO: 2750
  CDS (1)..(1050)

SEQ ID NO: 15117 - protein, 349 aa, Clostridium acetobutylicum; identical to SEQ ID NO: 2751

SEQ ID NO: 15118 - DNA, 1047 bp, Listeria innocua; identical to SEQ ID NO: 2752
  CDS (1)..(1047)

SEQ ID NO: 15119 - protein, 348 aa, Listeria innocua; identical to SEQ ID NO: 2753

SEQ ID NO: 15120 - DNA, 1137 bp, Brucella melitensis; identical to SEQ ID NO: 2754
  CDS (1)..(1137)

SEQ ID NO: 15121 - protein, 378 aa, Brucella melitensis; identical to SEQ ID NO: 2755

SEQ ID NO: 15122 - DNA, 1062 bp, Salmonella enterica subsp. enterica serovar Typhi; identical to SEQ ID NO: 2756
  CDS (1)..(1062)

SEQ ID NO: 15123 - protein, 353 aa, Salmonella enterica subsp. enterica serovar Typhi; identical to SEQ ID NO: 2757

SEQ ID NO: 15124 - DNA, 1074 bp, Nostoc sp. PCC 7120; identical to SEQ ID NO: 2758
  CDS (1)..(1074)

SEQ ID NO: 15125 - protein, 357 aa, Nostoc sp. PCC 7120; identical to SEQ ID NO: 2759

SEQ ID NO: 15126 - DNA, 1044 bp, Xylella fastidiosa; identical to SEQ ID NO: 2760
  CDS (1)..(1044)

SEQ ID NO: 15127 - protein, 347 aa, Xylella fastidiosa; identical to SEQ ID NO: 2761

SEQ ID NO: 15128 - DNA, 1164 bp, Lactococcus lactis subsp. lactis; identical to SEQ ID NO: 2762
  CDS (1)..(1164)

SEQ ID NO: 15129 - protein, 387 aa, Lactococcus lactis subsp. lactis; identical to SEQ ID NO: 2763

SEQ ID NO: 15130 - DNA, 2025 bp, Borrelia burgdorferi (Lyme disease spirochete); identical to SEQ ID NO: 2764
  CDS (25)..(1122)

SEQ ID NO: 15131 - protein, 365 aa, Borrelia burgdorferi (Lyme disease spirochete); identical to SEQ ID NO: 2765

SEQ ID NO: 15132 - DNA, 1728 bp, Deinococcus radiodurans; identical to SEQ ID NO: 2766
  CDS (399)..(1490)

SEQ ID NO: 15133 - protein, 363 aa, Deinococcus radiodurans; identical to SEQ ID NO: 2767

SEQ ID NO: 15134 - DNA, 1071 bp, Caulobacter crescentus; identical to SEQ ID NO: 2768
  CDS (1)..(1071)

SEQ ID NO: 15135 - protein, 356 aa, Caulobacter crescentus; identical to SEQ ID NO: 2769

SEQ ID NO: 15136 - DNA, 1199 bp, Thermotoga maritima; identical to SEQ ID NO: 2770
  CDS (67)..(1137)

SEQ ID NO: 15137 - protein, 356 aa, Thermotoga maritima; identical to SEQ ID NO: 2771

SEQ ID NO: 15138 - DNA, 1662 bp, Arabidopsis thaliana (mouse-ear cress); identical to SEQ ID NO: 2772
  CDS (368)..(1498)

SEQ ID NO: 15139 - protein, 376 aa, Arabidopsis thaliana (mouse-ear cress); identical to SEQ ID NO: 2773

SEQ ID NO: 15140 - DNA, 1038 bp, Aquifex aeolicus; identical to SEQ ID NO: 2774
  CDS (1)..(1038)

SEQ ID NO: 15141 - protein, 345 aa, Aquifex aeolicus; identical to SEQ ID NO: 2775

SEQ ID NO: 15142 - DNA, 1062 bp, Chlamydophila pneumoniae, Chlamydia pneumoniae; identical to SEQ ID NO: 2776
  CDS (1)..(1062)

SEQ ID NO: 15143 - protein, 353 aa, Chlamydophila pneumoniae, Chlamydia pneumoniae; identical to SEQ ID NO: 2777

SEQ ID NO: 15144 - DNA, 1047 bp, Neisseria meningitidis; identical to SEQ ID NO: 2778
  CDS (1)..(1047)

SEQ ID NO: 15145 - protein, 348 aa, Neisseria meningitidis; identical to SEQ ID NO: 2779

SEQ ID NO: 15146 - DNA, 1032 bp, Campylobacter jejuni; identical to SEQ ID NO: 2780
  CDS (1)..(1032)

SEQ ID NO: 15147 - protein, 343 aa, Campylobacter jejuni; identical to SEQ ID NO: 2781

SEQ ID NO: 15148 - DNA, 1065 bp, Chlamydia muridarum, Chlamydia trachomatis MoPn; identical to SEQ ID NO: 2782
  CDS (1)..(1065)

SEQ ID NO: 15149 - protein, 354 aa, Chlamydia muridarum, Chlamydia trachomatis MoPn; identical to SEQ ID NO: 2783

SEQ ID NO: 15150 - DNA, 1050 bp, Bacillus halodurans; identical to SEQ ID NO: 2784
  CDS (1)..(1050)

SEQ ID NO: 15151 - protein, 349 aa, Bacillus halodurans; identical to SEQ ID NO: 2785

SEQ ID NO: 15152 - DNA, 1229 bp, Streptococcus pneumoniae; identical to SEQ ID NO: 2786
  CDS (26)..(1192)

SEQ ID NO: 15153 - protein, 388 aa, Streptococcus pneumoniae; identical to SEQ ID NO: 2787

SEQ ID NO: 15154 - DNA, 1251 bp, Agrobacterium tumefaciens; identical to SEQ ID NO: 2788
  CDS (1)..(1251)

SEQ ID NO: 15155 - protein, 416 aa, Agrobacterium tumefaciens; identical to SEQ ID NO: 2789

SEQ ID NO: 15156 - DNA, 1044 bp, Staphylococcus aureus; identical to SEQ ID NO: 2790
  CDS (1)..(1044)

SEQ ID NO: 15157 - protein, 347 aa, Staphylococcus aureus; identical to SEQ ID NO: 2791

SEQ ID NO: 15158 - DNA, 1506 bp, Acinetobacter calcoaceticus; identical to SEQ ID NO: 2792
  CDS (403)..(1452)

SEQ ID NO: 15159 - protein, 349 aa, Acinetobacter calcoaceticus; identical to SEQ ID NO: 2793

SEQ ID NO: 15160 - DNA, 1479 bp, Brucella abortus; identical to SEQ ID NO: 2794
  CDS (316)..(1398)

SEQ ID NO: 15161 - protein, 360 aa, Brucella abortus; identical to SEQ ID NO: 2795

SEQ ID NO: 15162 - DNA, 981 bp, Streptococcus pyogenes; identical to SEQ ID NO: 2796
  CDS (1)..(981)

SEQ ID NO: 15163 - protein, 326 aa, Streptococcus pyogenes; identical to SEQ ID NO: 2797

SEQ ID NO: 15164 - DNA, 1349 bp, Leptospira biflexa; identical to SEQ ID NO: 2798
  CDS (107)..(1270)

SEQ ID NO: 15165 - protein, 387 aa, Leptospira biflexa; identical to SEQ ID NO: 2799

SEQ ID NO: 15166 - DNA, 1762 bp, Xanthomonas campestris pv. campestris; identical to SEQ ID NO: 2800
  CDS (159)..(1190)

SEQ ID NO: 15167 - protein, 343 aa, Xanthomonas campestris pv. campestris; identical to SEQ ID NO: 2801

SEQ ID NO: 15168 - DNA, 1212 bp, Aeromonas salmonicida; identical to SEQ ID NO: 2802
  CDS (151)..(1212)

SEQ ID NO: 15169 - protein, 353 aa, Aeromonas salmonicida; identical to SEQ ID NO: 2803

SEQ ID NO: 15170 - DNA, 1433 bp, Azotobacter vinelandii; identical to SEQ ID NO: 2804
  CDS (311)..(1360)

SEQ ID NO: 15171 - protein, 349 aa, Azotobacter vinelandii; identical to SEQ ID NO: 2805

SEQ ID NO: 15172 - DNA, 1108 bp, Acetobacter polyoxogenes; identical to SEQ ID NO: 2806
  CDS (35)..(1081)

SEQ ID NO: 15173 - protein, 348 aa, Acetobacter polyoxogenes; identical to SEQ ID NO: 2807

SEQ ID NO: 15174 - DNA, 1230 bp, Neisseria gonorrhoeae; identical to SEQ ID NO: 2808
  CDS (133)..(1179)

SEQ ID NO: 15175 - protein, 348 aa, Neisseria gonorrhoeae; identical to SEQ ID NO: 2809

SEQ ID NO: 15176 - DNA, 1649 bp, Bacteroides fragilis; identical to SEQ ID NO: 2810
  CDS (351)..(1307)

SEQ ID NO: 15177 - protein, 318 aa, Bacteroides fragilis; identical to SEQ ID NO: 2811

SEQ ID NO: 15178 - DNA, 1349 bp, Methylobacillus sp; identical to SEQ ID NO: 2812
  CDS (293)..(1327)

SEQ ID NO: 15179 - protein, 344 aa, Methylobacillus sp; identical to SEQ ID NO: 2813

SEQ ID NO: 15180 - DNA, 1320 bp, Vibrio anguillarum; identical to SEQ ID NO: 2814
  CDS (166)..(1212)

SEQ ID NO: 15181 - protein, 348 aa, Vibrio anguillarum; identical to SEQ ID NO: 2815

SEQ ID NO: 15182 - DNA, 1394 bp, Anabaena variabilis; identical to SEQ ID NO: 2816
  CDS (125)..(1201)

SEQ ID NO: 15183 - protein, 358 aa, Anabaena variabilis; identical to SEQ ID NO: 2817

SEQ ID NO: 15184 - DNA, 1334 bp, Bacillus subtilis; identical to SEQ ID NO: 2818
  CDS (215)..(1258)

SEQ ID NO: 15185 - protein, 347 aa, Bacillus subtilis; identical to SEQ ID NO: 2819

SEQ ID NO: 15186 - DNA, 1348 bp, Proteus mirabilis; identical to SEQ ID NO: 2820
  CDS (151)..(1218)

SEQ ID NO: 15187 - protein, 355 aa, Proteus mirabilis; identical to SEQ ID NO: 2821

SEQ ID NO: 15188 - DNA, 1384 bp, Pseudomonas aeruginosa; identical to SEQ ID NO: 2822
  CDS (145)..(1185)

SEQ ID NO: 15189 - protein, 346 aa, Pseudomonas aeruginosa; identical to SEQ ID NO: 2823

SEQ ID NO: 15190 - DNA, 1352 bp, Pseudomonas cepacia; identical to SEQ ID NO: 2824
  CDS (223)..(1266)

SEQ ID NO: 15191 - protein, 347 aa, Pseudomonas cepacia; identical to SEQ ID NO: 2825

SEQ ID NO: 15192 - DNA, 1047 bp, Synechococcus sp; identical to SEQ ID NO: 2826
  CDS (1)..(1047)

SEQ ID NO: 15193 - protein, 348 aa, Synechococcus sp; identical to SEQ ID NO: 2827

SEQ ID NO: 15194 - DNA, 1190 bp, Aquaspirillum magnetotacticum; identical to SEQ ID NO: 2828
  CDS (112)..(1146)

SEQ ID NO: 15195 - protein, 344 aa, Aquaspirillum magnetotacticum; identical to SEQ ID NO: 2829

SEQ ID NO: 15196 - DNA, 1841 bp, Rhizobium leguminosarum bv. viciae; identical to SEQ ID NO: 2830
  CDS (32)..(1087)

SEQ ID NO: 15197 - protein, 351 aa, Rhizobium leguminosarum bv. viciae; identical to SEQ ID NO: 2831

SEQ ID NO: 15198 - DNA, 1047 bp, Rhizobium meliloti; identical to SEQ ID NO: 2832
  CDS (1)..(1047)

SEQ ID NO: 15199 - protein, 348 aa, Rhizobium meliloti; identical to SEQ ID NO: 2833

SEQ ID NO: 15200 - DNA, 2762 bp, Mycobacterium tuberculosis; identical to SEQ ID NO: 2834
  CDS (311)..(2683)

SEQ ID NO: 15201 - protein, 790 aa, Mycobacterium tuberculosis; identical to SEQ ID NO: 2835

SEQ ID NO: 15202 - DNA, 1249 bp, Methylomonas clara; identical to SEQ ID NO: 2836
  CDS (123)..(1151)

SEQ ID NO: 15203 - protein, 342 aa, Methylomonas clara; identical to SEQ ID NO: 2837

SEQ ID NO: 15204 - DNA, 1065 bp, Enterobacter agglomerans; identical to SEQ ID NO: 2838
  CDS (1)..(1065)

SEQ ID NO: 15205 - protein, 354 aa, Enterobacter agglomerans; identical to SEQ ID NO: 2839

SEQ ID NO: 15206 - DNA, 1125 bp, Streptomyces lividans; identical to SEQ ID NO: 2840
  CDS (1)..(1125)

SEQ ID NO: 15207 - protein, 374 aa, Streptomyces lividans; identical to SEQ ID NO: 2841

SEQ ID NO: 15208 - DNA, 1347 bp, Rhodobacter sphaeroides; identical to SEQ ID NO: 2842
  CDS (220)..(1251)

SEQ ID NO: 15209 - protein, 343 aa, Rhodobacter sphaeroides; identical to SEQ ID NO: 2843

SEQ ID NO: 15210 - DNA, 1065 bp, Vibrio cholerae; identical to SEQ ID NO: 2844
  CDS (1)..(1065)

SEQ ID NO: 15211 - protein, 354 aa, Vibrio cholerae; identical to SEQ ID NO: 2845

SEQ ID NO: 15212 - DNA, 1068 bp, Rhodobacter capsulatus; identical to SEQ ID NO: 2846
  CDS (1)..(1068)

SEQ ID NO: 15213 - protein, 355 aa, Rhodobacter capsulatus; identical to SEQ ID NO: 2847

SEQ ID NO: 15214 - DNA, 1533 bp, Helicobacter pylori; identical to SEQ ID NO: 2848
  CDS (275)..(1318)

SEQ ID NO: 15215 - protein, 347 aa, Helicobacter pylori; identical to SEQ ID NO: 2849

SEQ ID NO: 15216 - DNA, 1065 bp, Synechocystis sp; identical to SEQ ID NO: 2850
  CDS (1)..(1065)

SEQ ID NO: 15217 - protein, 354 aa, Synechocystis sp; identical to SEQ ID NO: 2851

SEQ ID NO: 15218 - DNA, 1351 bp, Arabidopsis thaliana (mouse-ear cress); identical to SEQ ID NO: 2852
  CDS (1)..(1320)

SEQ ID NO: 15219 - protein, 439 aa, Arabidopsis thaliana (mouse-ear cress); identical to SEQ ID NO: 2853

SEQ ID NO: 15220 - DNA, 1392 bp, Pseudomonas putida; identical to SEQ ID NO: 2854
  CDS (111)..(1178)

SEQ ID NO: 15221 - protein, 355 aa, Pseudomonas putida; identical to SEQ ID NO: 2855

SEQ ID NO: 15222 - DNA, 1053 bp, Mycobacterium tuberculosis; identical to SEQ ID NO: 2856
  CDS (1)..(1053)

SEQ ID NO: 15223 - protein, 350 aa, Mycobacterium tuberculosis; identical to SEQ ID NO: 2857

SEQ ID NO: 15224 - DNA, 1053 bp, Wolinella succinogenes; identical to SEQ ID NO: 2858
  CDS (1)..(1053)

SEQ ID NO: 15225 - protein, 350 aa, Wolinella succinogenes; identical to SEQ ID NO: 2859

SEQ ID NO: 15226 - DNA, 1110 bp, Vibrio vulnificus; identical to SEQ ID NO: 2860
  CDS (1)..(1110)

SEQ ID NO: 15227 - protein, 369 aa, Vibrio vulnificus; identical to SEQ ID NO: 2861

SEQ ID NO: 15228 - DNA, 1068 bp, Photorhabdus luminescens; identical to SEQ ID NO: 2862
  CDS (1)..(1068)

SEQ ID NO: 15229 - protein, 355 aa, Photorhabdus luminescens; identical to SEQ ID NO: 2863

SEQ ID NO: 15230 - DNA, 1110 bp, Gloeobacter violaceus; identical to SEQ ID NO: 2864
  CDS (1)..(1110)

SEQ ID NO: 15231 - protein, 369 aa, Gloeobacter violaceus; identical to SEQ ID NO: 2865

SEQ ID NO: 15232 - DNA, 1053 bp, Chromobacterium violaceum; identical to SEQ ID NO: 2866
  CDS (1)..(1053)

SEQ ID NO: 15233 - protein, 350 aa, Chromobacterium violaceum; identical to SEQ ID NO: 2867

SEQ ID NO: 15234 - DNA, 1128 bp, Synechococcus sp; identical to SEQ ID NO: 2868
  CDS (1)..(1128)

SEQ ID NO: 15235 - protein, 375 aa, Synechococcus sp; identical to SEQ ID NO: 2869

SEQ ID NO: 15236 - DNA, 1128 bp, Rhodopirellula baltica; identical to SEQ ID NO: 2870
  CDS (1)..(1128)

SEQ ID NO: 15237 - protein, 375 aa, Rhodopirellula baltica; identical to SEQ ID NO: 2871

SEQ ID NO: 15238 - DNA, 1113 bp, Prochlorococcus marinus subsp; identical to SEQ ID NO: 2872
  CDS (1)..(1113)

SEQ ID NO: 15239 - protein, 370 aa, Prochlorococcus marinus subsp; identical to SEQ ID NO: 2873

SEQ ID NO: 15240 - DNA, 1140 bp, Prochlorococcus marinus; identical to SEQ ID NO: 2874
  CDS (1)..(1140)

SEQ ID NO: 15241 - protein, 379 aa, Prochlorococcus marinus; identical to SEQ ID NO: 2875

SEQ ID NO: 15242 - DNA, 1140 bp, Prochlorococcus marinus; identical to SEQ ID NO: 2876
  CDS (1)..(1140)

SEQ ID NO: 15243 - protein, 379 aa, Prochlorococcus marinus; identical to SEQ ID NO: 2877

SEQ ID NO: 15244 - DNA, 1038 bp, Helicobacter hepaticus; identical to SEQ ID NO: 2878
  CDS (1)..(1038)

SEQ ID NO: 15245 - protein, 345 aa, Helicobacter hepaticus; identical to SEQ ID NO: 2879

SEQ ID NO: 15246 - DNA, 1119 bp, Haemophilus ducreyi; identical to SEQ ID NO: 2880
  CDS (1)..(1119)

SEQ ID NO: 15247 - protein, 372 aa, Haemophilus ducreyi; identical to SEQ ID NO: 2881

SEQ ID NO: 15248 - DNA, 1048 bp, Campylobacter lari; identical to SEQ ID NO: 2882
  CDS (9)..(1043)

SEQ ID NO: 15249 - protein, 344 aa, Campylobacter lari; identical to SEQ ID NO: 2883

SEQ ID NO: 15250 - DNA, 1077 bp, Burkholderia fungorum; identical to SEQ ID NO: 2884
  CDS (1)..(1077)

SEQ ID NO: 15251 - protein, 358 aa, Burkholderia fungorum; identical to SEQ ID NO: 2885

SEQ ID NO: 15252 - DNA, 963 bp, Mycobacteriophage CJW1; identical to SEQ ID NO: 2886
  CDS (1)..(963)

SEQ ID NO: 15253 - protein, 320 aa, Mycobacteriophage CJW1; identical to SEQ ID NO: 2887

SEQ ID NO: 15254 - DNA, 1563 bp, Zymomonas mobilis; identical to SEQ ID NO: 2888
  CDS (231)..(1250)

SEQ ID NO: 15255 - protein, 339 aa, Zymomonas mobilis; identical to SEQ ID NO: 2889

SEQ ID NO: 15256 - DNA, 1038 bp, Bacillus megaterium; identical to SEQ ID NO: 2890
  CDS (1)..(1038)

SEQ ID NO: 15257 - protein, 345 aa, Bacillus megaterium; identical to SEQ ID NO: 2891

SEQ ID NO: 15258 - DNA, 1038 bp, Bacillus megaterium; identical to SEQ ID NO: 2892
  CDS (1)..(1038)

SEQ ID NO: 15259 - protein, 345 aa, Bacillus megaterium; identical to SEQ ID NO: 2893

SEQ ID NO: 15260 - DNA, 1044 bp, Bacillus amyloliquefaciens; identical to SEQ ID NO: 2894
  CDS (1)..(1044)

SEQ ID NO: 15261 - protein, 347 aa, Bacillus amyloliquefaciens; identical to SEQ ID NO: 2895

SEQ ID NO: 15262 - DNA, 1047 bp, Listeria monocytogenes; identical to SEQ ID NO: 2896
  CDS (1)..(1047): m means a or c

SEQ ID NO: 15263 - protein, 348 aa, Listeria monocytogenes; identical to SEQ ID NO: 2897
  misc_feature (228)..(228): Xaa can be Pro or Gln

SEQ ID NO: 15264 - DNA, 1035 bp, Oryza sativa; identical to SEQ ID NO: 2898
  CDS (1)..(1035)

SEQ ID NO: 15265 - protein, 344 aa, Oryza sativa; identical to SEQ ID NO: 2899

SEQ ID NO: 15266 - DNA, 1035 bp, Campylobacter lari; identical to SEQ ID NO: 2900
  CDS (1)..(1035)

SEQ ID NO: 15267 - protein, 344 aa, Campylobacter lari; identical to SEQ ID NO: 2901

SEQ ID NO: 15268 - DNA, 2035 bp, Borrelia hermsii; identical to SEQ ID NO: 2902
  CDS (256)..(1326)

SEQ ID NO: 15269 - protein, 356 aa, Borrelia hermsii; identical to SEQ ID NO: 2903

SEQ ID NO: 15270 - DNA, 1487 bp, Chlamydomonas reinhardtii; identical to SEQ ID NO: 2904
  CDS (121)..(1365)

SEQ ID NO: 15271 - protein, 414 aa, Chlamydomonas reinhardtii; identical to SEQ ID NO: 2905

SEQ ID NO: 15272 - DNA, 1669 bp, Streptococcus suis; identical to SEQ ID NO: 2906
  CDS (469)..(1500)

SEQ ID NO: 15273 - protein, 343 aa, Streptococcus suis; identical to SEQ ID NO: 2907

SEQ ID NO: 15274 - DNA, 1439 bp, Peanut witches; identical to SEQ ID NO: 2908
  CDS (218)..(1228)

SEQ ID NO: 15275 - protein, 336 aa, Peanut witches; identical to SEQ ID NO: 2909

SEQ ID NO: 15276 - DNA, 1377 bp, Myxococcus xanthus; identical to SEQ ID NO: 2910
  CDS (201)..(1277)

SEQ ID NO: 15277 - protein, 358 aa, Myxococcus xanthus; identical to SEQ ID NO: 2911

SEQ ID NO: 15278 - DNA, 1404 bp, Acidiphilium facilis; identical to SEQ ID NO: 2912
  CDS (187)..(1251)

SEQ ID NO: 15279 - protein, 354 aa, Acidiphilium facilis; identical to SEQ ID NO: 2913

SEQ ID NO: 15280 - DNA, 1059 bp, Actinobacillus actinomycetemcomitans; identical to SEQ ID NO: 2914
  CDS (1)..(1059)

SEQ ID NO: 15281 - protein, 352 aa, Actinobacillus actinomycetemcomitans; identical to SEQ ID NO: 2915

SEQ ID NO: 15282 - DNA, 1565 bp, Alcaligenes eutrophus; identical to SEQ ID NO: 2916
  CDS (194)..(1255)

SEQ ID NO: 15283 - protein, 353 aa, Alcaligenes eutrophus; identical to SEQ ID NO: 2917

SEQ ID NO: 15284 - DNA, 1047 bp, Amycolatopsis mediterranei; identical to SEQ ID NO: 2918
  CDS (1)..(1047)

SEQ ID NO: 15285 - protein, 348 aa, Amycolatopsis mediterranei; identical to SEQ ID NO: 2919

SEQ ID NO: 15286 - DNA, 1035 bp, Bacteroides thetaiotaomicron; identical to SEQ ID NO: 2920
  CDS (1)..(1035)

SEQ ID NO: 15287 - protein, 344 aa, Bacteroides thetaiotaomicron; identical to SEQ ID NO: 2921

SEQ ID NO: 15288 - DNA, 1194 bp, Bifidobacterium longum; identical to SEQ ID NO: 2922
  CDS (1)..(1194)

SEQ ID NO: 15289 - protein, 397 aa, Bifidobacterium longum; identical to SEQ ID NO: 2923

SEQ ID NO: 15290 - DNA, 1062 bp, Bordetella pertussis; identical to SEQ ID NO: 2924
  CDS (1)..(1062)

SEQ ID NO: 15291 - protein, 353 aa, Bordetella pertussis; identical to SEQ ID NO: 2925

SEQ ID NO: 15292 - DNA, 1089 bp, Bradyrhizobium japonicum; identical to SEQ ID NO: 2926
  CDS (1)..(1089)

SEQ ID NO: 15293 - protein, 362 aa, Bradyrhizobium japonicum; identical to SEQ ID NO: 2927

SEQ ID NO: 15294 - DNA, 2058 bp, Campylobacter fetus; identical to SEQ ID NO: 2928
  CDS (401)..(1438)

SEQ ID NO: 15295 - protein, 345 aa, Campylobacter fetus; identical to SEQ ID NO: 2929

SEQ ID NO: 15296 - DNA, 1458 bp, Chloroflexus aurantiacus; identical to SEQ ID NO: 2930
  CDS (116)..(1171)

SEQ ID NO: 15297 - protein, 351 aa, Chloroflexus aurantiacus; identical to SEQ ID NO: 2931

SEQ ID NO: 15298 - DNA, 1053 bp, Chlamydophila caviae; identical to SEQ ID NO: 2932
  CDS (1)..(1053)

SEQ ID NO: 15299 - protein, 350 aa, Chlamydophila caviae; identical to SEQ ID NO: 2933

SEQ ID NO: 15300 - DNA, 1087 bp, Chromatium vinosum; identical to SEQ ID NO: 2934
  CDS (1)..(1044)

SEQ ID NO: 15301 - protein, 347 aa, Chromatium vinosum; identical to SEQ ID NO: 2935

SEQ ID NO: 15302 - DNA, 1346 bp, Clostridium perfringens; identical to SEQ ID NO: 2936
  CDS (172)..(1230)

SEQ ID NO: 15303 - protein, 352 aa, Clostridium perfringens; identical to SEQ ID NO: 2937

SEQ ID NO: 15304 - DNA, 1053 bp, Clostridium tetani; identical to SEQ ID NO: 2938
  CDS (1)..(1053)

SEQ ID NO: 15305 - protein, 350 aa, Clostridium tetani; identical to SEQ ID NO: 2939

SEQ ID NO: 15306 - DNA, 1161 bp, Corynebacterium efficiens; identical to SEQ ID NO: 2940
  CDS (1)..(1161)

SEQ ID NO: 15307 - protein, 386 aa, Corynebacterium efficiens; identical to SEQ ID NO: 2941

SEQ ID NO: 15308 - DNA, 1402 bp, Corynebacterium glutamicum; identical to SEQ ID NO: 2942
  CDS (133)..(1263)

SEQ ID NO: 15309 - protein, 376 aa, Corynebacterium glutamicum; identical to SEQ ID NO: 2943

SEQ ID NO: 15310 - DNA, 1409 bp, Corynebacterium pseudotuberculosis; identical to SEQ ID NO: 2944
  CDS (223)..(1332)

SEQ ID NO: 15311 - protein, 369 aa, Corynebacterium pseudotuberculosis; identical to SEQ ID NO: 2945

SEQ ID NO: 15312 - DNA, 1032 bp, Coxiella burnetii; identical to SEQ ID NO: 2946
  CDS (1)..(1032)

SEQ ID NO: 15313 - protein, 343 aa, Coxiella burnetii; identical to SEQ ID NO: 2947

SEQ ID NO: 15314 - DNA, 1047 bp, Enterococcus faecalis; identical to SEQ ID NO: 2948
  CDS (1)..(1047)

SEQ ID NO: 15315 - protein, 348 aa, Enterococcus faecalis; identical to SEQ ID NO: 2949

SEQ ID NO: 15316 - DNA, 1072 bp, Erwinia carotovora; identical to SEQ ID NO: 2950
  CDS (1)..(1029)

SEQ ID NO: 15317 - protein, 342 aa, Erwinia carotovora; identical to SEQ ID NO: 2951

SEQ ID NO: 15318 - DNA, 1137 bp, Fusobacterium nucleatum; identical to SEQ ID NO: 2952
  CDS (1)..(1137)

SEQ ID NO: 15319 - protein, 378 aa, Fusobacterium nucleatum; identical to SEQ ID NO: 2953

SEQ ID NO: 15320 - DNA, 1613 bp, Herbaspirillum seropedicae; identical to SEQ ID NO: 2954
  CDS (199)..(1254)

SEQ ID NO: 15321 - protein, 351 aa, Herbaspirillum seropedicae; identical to SEQ ID NO: 2955

SEQ ID NO: 15322 - DNA, 1143 bp, Lactobacillus plantarum; identical to SEQ ID NO: 2956
  CDS (1)..(1143)

SEQ ID NO: 15323 - protein, 380 aa, Lactobacillus plantarum; identical to SEQ ID NO: 2957

SEQ ID NO: 15324 - DNA, 1101 bp, Leptospira interrogans; identical to SEQ ID NO: 2958
  CDS (1)..(1101)

SEQ ID NO: 15325 - protein, 366 aa, Leptospira interrogans; identical to SEQ ID NO: 2959

SEQ ID NO: 15326 - DNA, 1126 bp, Mycoplasma mycoides; identical to SEQ ID NO: 2960
  CDS (79)..(1116)

SEQ ID NO: 15327 - protein, 345 aa, Mycoplasma mycoides; identical to SEQ ID NO: 2961

SEQ ID NO: 15328 - DNA, 1050 bp, Mycobacterium smegmatis; identical to SEQ ID NO: 2962
  CDS (1)..(1050)

SEQ ID NO: 15329 - protein, 349 aa, Mycobacterium smegmatis; identical to SEQ ID NO: 2963

SEQ ID NO: 15330 - DNA, 1044 bp, Oceanobacillus iheyensis; identical to SEQ ID NO: 2964
  CDS (1)..(1044)

SEQ ID NO: 15331 - protein, 347 aa, Oceanobacillus iheyensis; identical to SEQ ID NO: 2965

SEQ ID NO: 15332 - DNA, 1071 bp, Paracoccus denitrificans; identical to SEQ ID NO: 2966
  CDS (1)..(1071)

SEQ ID NO: 15333 - protein, 356 aa, Paracoccus denitrificans; identical to SEQ ID NO: 2967

SEQ ID NO: 15334 - DNA, 1320 bp, Pasteurella haemolytica; identical to SEQ ID NO: 2968
  CDS (157)..(1263)

SEQ ID NO: 15335 - protein, 368 aa, Pasteurella haemolytica; identical to SEQ ID NO: 2969

SEQ ID NO: 15336 - DNA, 1500 bp, Pasteurella multocida; identical to SEQ ID NO: 2970
  CDS (175)..(1239)

SEQ ID NO: 15337 - protein, 354 aa, Pasteurella multocida; identical to SEQ ID NO: 2971

SEQ ID NO: 15338 - DNA, 1023 bp, Porphyromonas gingivalis; identical to SEQ ID NO: 2972
  CDS (1)..(1023)

SEQ ID NO: 15339 - protein, 340 aa, Porphyromonas gingivalis; identical to SEQ ID NO: 2973

SEQ ID NO: 15340 - DNA, 1824 bp, Prevotella ruminicola; identical to SEQ ID NO: 2974
  CDS (501)..(1523)

SEQ ID NO: 15341 - protein, 340 aa, Prevotella ruminicola; identical to SEQ ID NO: 2975

SEQ ID NO: 15342 - DNA, 978 bp, Proteus vulgaris; identical to SEQ ID NO: 2976
  CDS (1)..(978)

SEQ ID NO: 15343 - protein, 325 aa, Proteus vulgaris; identical to SEQ ID NO: 2977

SEQ ID NO: 15344 - DNA, 1047 bp, Pseudomonas oleovorans; identical to SEQ ID NO: 2978
  CDS (1)..(1047)

SEQ ID NO: 15345 - protein, 348 aa, Pseudomonas oleovorans; identical to SEQ ID NO: 2979

SEQ ID NO: 15346 - DNA, 1068 bp, Pseudomonas putida; identical to SEQ ID NO: 2980
  CDS (1)..(1068)

SEQ ID NO: 15347 - protein, 355 aa, Pseudomonas putida; identical to SEQ ID NO: 2981

SEQ ID NO: 15348 - DNA, 1110 bp, Pseudomonas syringae; identical to SEQ ID NO: 2982
  CDS (46)..(1110)

SEQ ID NO: 15349 - protein, 354 aa, Pseudomonas syringae; identical to SEQ ID NO: 2983
